United States Patent 7,745,391 (HUMAN THROMBOSPONDIN POLYPEPTIDE) - sequence listing, part 60

SEQ ID NO: 198671 - DNA, 567 bp, Homo sapiens
aaaaatagaatggatttttaaaaaaacttacattctaattaggtctcaatgctgcagagaaaatagtgtaccagtgcaaactctacactgtggtataaggcacaggattttcccgctgcgcttccaaggatagggtcatcctattataactgtttaataataggggattgtgtgtattttcttatatatcttcttgcaattccatgtttctgaagtgtgagattcaggtcaaggtcaatgtgtggccagttgtttataaagtattaagaatctcatgaaggagaaatacagtttagatgtagattttcttacgataactcaaattatgtttaaatgacaaaaactaggtaggtattgaggaggtaaatatctctatttttcatttcttaacattacactacaatatgtgtaatatttagaatttgaattaggaagaactttaacttttttattccttagggtattactgatctctaaacaagatgtttaattagcagaattatagcatcttagataaaattggttatttttaacttaatcacgtagttgatgctacagaaatgaatt

SEQ ID NO: 198672 - DNA, 677 bp, Homo sapiens
gctagatagatgacagatggatgataggtagatagataattgataaatagatataaatgaccgatggacaggcagacatagatacattgattaggtagatgatagatggatagatagaagatagatggtggatgggtgggtagataggcagatagacagttagaaagatagatgatagatagataggaaggaatttattaggggaattggctcataccattgtggaggccaagatgtaccacagaaggccgtccgcaagctggaggcccaggaaagccagtatcgtggctcagtccaagtctgcaggcctcaggactgggaagctgttgatgtaactcttagtttaaggccaaaggtttgagagcctggggaactgctggagaactgggagttctaagtccaagggcaggagaggaaggcatcccacctccaggagaaagagggaattcaccttttctctgcctttttgttgtctggcaatggaatggtgtcatccatattgagggaggatctttaccactcagcccaccaactcacatgcccatctcctccagaaacaccctcacagacacacccagaagcgatgcgttaccagccatcccttaatccagccaaactgacacctgccgtcagccaccacacaggctcagaagaatcgtggttgcatggtgatggtc

SEQ ID NO: 198673 - DNA, 459 bp, Homo sapiens
ctactagtaatccatagtggcatcatctttcaagtccaaaagatgacaatatgtgaaaagaaaaaaagtggtagaagttagcattaattattcatatagcagatagtcttgacggagcagagtataaatagaaaaaagaaaaatcaaagagatgttcttcagagtttctatgttccaacaggttttgtgtgtaaggggccacttgtctccaatgatcatacccgtagaaaaatacagtacccttcgctcttattggaagataatggtgctgagaaacctagtttggtgatcaagccctgttcgcacaacctactaaatatgtatcccttaactctttgcaatttccaattatcaggcaaccatgcatgatgtaaggaaggttagtgtgacatcacttaagaatcttttccttactttaacttgtataaggtattaccttaagccagcagtccccaatcg

SEQ ID NO: 198674 - DNA, 458 bp, Homo sapiens
agaaaaatgggctagatttaaaagggcatgtcactgaaggctacctaaatatccaattaatatttgaaaaggtgtttccttactaatttcatcagtaatcgggggatgaaaagcaaaaacattactacgcactctgcaaatggactcagatgtgaaagactagaaatcccacgtataggcaagaatgtggaacaatggaaactatcaaacttgtggtagaagtgtaaattggtacaagtattttagaaaactatttggtattatctactgaagtttaatgtaatactatgacccagcaattctaggtatatatcctcagaaatgtgtgcacacgtggaccaaaacacatatacaagagtttatggtagtatcacttatgatagccccaatgggtaaaaacccaaatgttcaacaatagacagacaaattttggtatattcatacaatggaatagctgc

SEQ ID NO: 198675 - DNA, 614 bp, Homo sapiens
tctgttcaggttatgagcagttgggcatgttgactagaatatcaaggggtcacttgtgaaattgtaagtttcatgggtagcgaaaagagatctgacctagaaagcattgtgctgagtgctgacctcttcattctgttttacgttaccccatccctgcttctgtagcacctgtctgtgtgttctaattattggtgtccttgtctttctcgcccatggaaacttgagggcaaggaccaagtctcatttctctatatgtccctggtgctgaacacagtgaccagcagggtgagggaacacgtccatgagcacacgaatgcttctttcggcacaagtgcctgaggacatatcttcatgcctcacctctacaaaagaaagaaagaaagagagagagagagagagagagagagagaacgaaagagagaaagaaagaaagaaagaaagaaagaaagaaagaaagaaagaaagaaagaaagaaagaggcatagtagttgattgctaagtgttctctgcttgtttgatgaaacacctgccttcaggaagacaatttctgacagatcgggctctctttttgttagtactgtgtaagttctttatgtagacgagtgctgtcgagt

SEQ ID NO: 198676 - DNA, 421 bp, Homo sapiens
cagctatcataactatgctcatcaactaaaaaggaaactttcagataatatgctttgctgaaatgaggaagtaaatgaggaaggaaatgagaaagagcagaaatggggtcaagaaaacaacaatccagtctgggcacggtagctcctacgtgcctgtaatcccagcactttgggacaccaaagtgggcagattacttgagcccagaagttcccagccagcctggtcaacgtggcagaaccctgtctctgcaaaaaaatacagaaattatccagatgtgatgatgcacgcctatagtcccagctactcaggaggctgaggtggaaggatctatagtgcctaggaggttgaggctgcagtgagctgtgatcacaccactgcactccagcctggatgacagagtgagaccctgtctcaaaaaaa

SEQ ID NO: 198677 - DNA, 784 bp, Homo sapiens
ggaaatggtttctctcggatgcctcatctcctactactttccccctttgcagcttctgtctactttctaaactgggataaaggagagaaaaagtttatttttcttaaagccatgctcagttctgtctaaatcagaacagggtcaccattgacaccactctcacccttggtaattcttcatctctccagtgtgaattgaggaatcctttgagtcttattatcaagccagggaactttatgaagcaatccactcaggtcttttatatcactgcataacttctgttttcactgtgattaaaataagataattgaaggtgttcatgtgtcatactcaaaacaattttgttttgctggacatatcctaatgaccaaggattttgtccttttgttttttgagatggattctcactctattgtccaggctggagtgcagtggcacaatcacggctcactgcagcctatacctcctgagctcaagccatcttcctgcctctgtctcccaagtagctgggactttaggtgggcaccaccacacctggctaattttttaaattacatttttttgtagatacggaggagtcttgctatgttgcccaggctgatctcagactcctgaactcaagcgatccttccaccttggcctcccaaagtgctgaagttataaacatgttgccactgtgcctggcttattttgtctctttttttgatcccaccctatccctttgagtgtggtgagatgcatgggaacagaaggctgtattccctcaaatgagttaatttggaaa

SEQ ID NO: 198678 - DNA, 396 bp, Homo sapiens
cttgctcagatcagatactcagtaaaagatatgaggaacaaattcagaaagcttaaagaacttgcctctgagtcatagcattgaagtgatagaacttctaattggggaaacttgataagtttaatgccactccaagatggctgtattacatattcaaatctaagaaatcttcatatacaatgacagaaattagggtgaataggattggtttaggatagaacttcaactgagaattaagccctaaggttttaaggcatacattgtaatgaattcatttatttcctatgcagctagaaggtactagctgtgtacattattgggagatttgcaatgtagtcactcatcgttttctttggagcttaattctcttgtggaatcctgattgggaaaggctgg

SEQ ID NO: 198679 - DNA, 331 bp, Homo sapiens
ttcactgagtgcccactgggttatattctgggagccgaggccacagcagtgaacaaagcacacaaaaccccccgccccatgggggctccgttctagtgggtccatttatcatcaaacatctattaatatctctagaatgtgcccatcaggacaccatccagatgctgctgcgcttttccaggccacacagaggggacaccctccaggtgcatcctgcatgaatatcaggctcaaccgtgctttcagggtaggaagcagagggcatttgaagagtcctttcccttccttcattcatttgttgtctccttgaataaatgctgttgaaaaccta

SEQ ID NO: 198680 - DNA, 474 bp, Homo sapiens
tttgatgtagcatacctttcttgaatacggtttagaatcttcctgctggttggtcttatttcaatagatgccttctttgctgaaatgaaatccttgtaaacaaggagtgcagaagaaataccaaagcaaaaaactaaagctcaagttgaagctttgcaaccaggtcttgaatcctaagaaggcactgctcagacgggctggtgttccacaaccaaccacaattatttgaatacaaataattcattcataattcatgaggccattttcattttacacattttaaacctttacaccttttagttggggaacttctaaacttacccaagattgagagactagtagaattaaccatataatgtataatatagctgcagacagataatgtataatgtatctgccacccagcttagacaattattaccatgttgccaatctcatttcaccaaccagtgtgaagagaggggtaccgagctc

SEQ ID NO: 198681 - DNA, 266 bp, Homo sapiens
tgtaatcccagcactttggaatgccgaggtgggagggtcactcaagctcaggcgctcaagaccagcctggccaacatagtgagagccctggttttttcaaaaaatttttaaataaattatctgggtgtagtagtgcacacttgtggtcctagctactcaggaggctgaggtgggaggatagcttgagcccaggagttcaaggctgcagggagccatgattacacttctgcactccagcctgggtgacagagtgacaccctgtctca

SEQ ID NO: 198682 - DNA, 323 bp, Homo sapiens
tccctctcctccatctgctgacaaccaccatcctactttctgactactctgggaacctcatacaagaggaatcatacaatatttgtcctttcgtgactggcctgtttcagcgcaacgtattcaaagttcatccatgttgtaacctgtcaggatttccttcagcatcttaaaaatataatttgaatatagtttttttttttttttcaagaaaccaactatttacaaccattacaaagtcctacaatctgccacatcagttttacacagggaagggaattagaagaagggaatcacgtcaatcacagacatcctgtcgagcatgt

SEQ ID NO: 198683 - DNA, 796 bp, Homo sapiens
agagaataaagggaggaaacacgaactgaggtggggtgcaggagccaaggcaggccctcaaagtgtgcatcgatgccttcaaaagccagctgcagtattcggccacctgcgatccctgggtgcccgccatcagcccttgctcctctctcttgccttggataggacagaagttgacacttgggggctcttggagaaccatttggagcacgtggaactcaagagtgaatcacttattttttgctgtgtggcagcagggcctccctagacaggacatattcgggggcttgcagccaggtaggggagtggaagtacctcctctcaccccacacacgggaattggagatgaggcagccgatcctgcctgcttgagtctcagctgtcattttccaggctggcagcaccagcaggagaacccgtgtgtccgccgggctttctttaaaatgcaccgagtgcaacccagtcctccttgtgtaaactttctccaactggccagatggtttgcttctatttaaggcagtgagagtatttcctacggcctgctgccccctggcctttgttttgccccgggaaggccattcctcgaaagggaagctgagcaggagttgcacttcccagcagcagggattgtcggcgcccacccccatggcaggcctagaaccctttgccaagtgcctctgcctggagggaccgtgtttgtaacttgactccctctgtcccttccaaatctgcttgtgctgtgttttcttagatggtcatgaagtctccccctactctcccagcccagttccagctccgc

SEQ ID NO: 198684 - DNA, 302 bp, Homo sapiens
attgcgccactgcactctagcctgggcgacagtagcagactccatctcaaaaataaataagtaaataaacagttaataaggttctgaaaaataagtaaagtaatagagatagagataaaattgtataattgctcagggaagcattacagcaggatattccccctgaatgttaacttcagctgaatagttgaggattgtaaactccgctgaaggagttcttagtacaatttaaatagccttaccagaagcacaccaaccaatgttacctcttctagtggtaatgtaagcatactttaggcaat

SEQ ID NO: 198685 - DNA, 730 bp, Homo sapiens
taaagttgtgacagggttgtaaagcaaggtaagaacaatctcatgagtcaaatgaaggtaagcgctcctggaggcaagggagtctctatgaagaggaatcagtattttctgagtcaatcaaattaaatcctttcatgtatcccattttagtttggggggacactactctttcattatcaaactcttactttcacatactacacaagactgtgaattcagctgagtttggaatttggaaacctatataattaaactttgaatttgatctttgactatctcaaccctgtggctgcaagaaaggagatattcttttagctggttttcaatctatgccctaaattagaattttgagaatgtcattccttttttatttagctgttcagcgtctttagaaacaacacctccagcccattcctgataccaatttataagagtcaggatttttagctagaaacaaaaaataaccaagttcaactgatgaagcagaataggacattattacaaggatttgggggtagttcatagaatcattaggaatcctagacaattagggacagggctttgcaccaaaaactatgctcaaaatcacaccatagaaatgatctaatgagaaccccactgtggccttcaccaaacaaaagttgttgcaacctgcactgcacacagaactggctctgtgtactaaatgccactaatagcatagcttccattactgatacaaagtttagtc

SEQ ID NO: 198686 - DNA, 482 bp, Homo sapiens
gtaaatagaaaaaatataactaaatggctcctaggtccctgctagcgctaacttctcgtgtgatcagtgcttctaaaattgcaatgtgtccaggtggggaagttcatttaccccctatctggtttacgctcacttaagggagtgatttctttcctctgaggctctcatcttgcccattattcagagtgagctgcctcctggtgtgctgtcaaaatacatcagcttcaaagacaaacacacacctttcaatcccagtccaagagagtttactgtataatttatgataatgttaagtctgtttctcataaatgttaatggtgctacattttttttcatagatgggtaattctcagaaaagcagctggatgttaaaagttacttttttttttttttttaacataaactgcctcagccaacaaatctgattaaaacaaaactctccaggattgcaaggcacaaagattctgctaatgttagtaagt

SEQ ID NO: 198687 - DNA, 502 bp, Homo sapiens
atctatcagctcaaattaggtgataaagctaaaataagtaggaaaaataagtataagggtatacagtatctaagcttacatgcctttagcacgagacgaaaaaaattaaaatataataataacaaatatatgggaaaattggaaaatcaaactcaatattgaacgaagttagccacagcctgagtggggcaccagattgaaatcaattagaagaattaattaatggcatatcttgaatccaagaaagaccaatcacctataagggattcaacctgttcattttgcagtgagaaaaatcactcttgatagtcacagctttgagttttatacccttgcccaaatattcagtcgatatgtaaatttagctgttgatgtggtaattctaatatgcttgggatgatacagttgttttttttagtgagttttcgttgaaatctttttttttttttaaccctggaaagattcagacttttgtacagaaataataaagcttactttacta

SEQ ID NO: 198688 - DNA, 312 bp, Homo sapiens
tctttcttcagcccaaaccagttttatcgctctgtgatttcctgtggcccttgatctatgccagtggctcatatacttggttcatccagggatcctttcaaaatcctgatacccacattgggctctaggacaagatttctcaaactcagcactattggcatctcagaccggatcacttttcattgtgaggggctgtcctgtgcattgaggatgtttagcagcatccctggcctccacaccactaggtgccagtactcctcccacccccaagtggagaaagccaaaaatgtctccagatactgtcaaatatcc

SEQ ID NO: 198689 - DNA, 726 bp, Homo sapiens
acctatagtcccagctactcaggaggctgaggcaagagaatctcttaagcccaagagtccgaggctgcagtgagatatgatcacaccactgcactccagcctgggtgacagggctcatccctaaaataataggactcgtctctaaaaataaatgcatgcagtcattcatttattgatcactaattatgtaccaatcactgctttacactacattttacttgttttatatcttctaatcaaattacaaaccttatagtgtgagaattatttgaatctccatttacaaatggggagacaggtgaagagaggttaattagcttggacaaagttacacacagatttcaaaccctgagcttactttgctaactacttccttgaggacacagcttagacctgtttcatggaggcacaaataaagacatgcatattaacagacacacttcattatctgaacatttctttcctctggaatacataacccaaaatgaaatgatataatgttctctttagtgagaagaggattctttgtcatgttcttggcctatttaaagccctgtaatgcagtcctaatatctcacatatccgtacagctgctaaaatcatctttcatgcgtagcactttgatttttgtcactctgtgttctgaagcctgccagtcgttttgttctggcatatggcatcctagaagggcaaatcctaattaggactattactactatattaata

SEQ ID NO: 198690 - DNA, 630 bp, Homo sapiens
gtggccttcctccacctcagctgcaagaggctttcctcttttactaatccacctcagcacagaccctttacgggtgtcgggctgggggacagtcaggtctttctcatcccatgaggctatatttcagactatcacatggggagaaagcttggacgataccctgctttcaagggcagaggtccctgcggctttccacagtgcattgtgcccctggtttattgagactagagaatggcgatgacttttaccaagtatactgctgatggacacgcccccactgatattgtttttaatgcagcgtgggaggggaggatatgacacgcgatatcgcaagtagtagaaacacccctttgatagtgttcttaatattcagggaggaagaagatgatgttactcccaatacagacggatgtacaccctctgtacaccgagggtgtacacccgtctgtgaaggagttcgtaatctccagaggtggagatgatattactcacaatatggtaaacaggctgtgagtccatcgcggatcctcagagccaggtggggaagaggggctggctgtcagtcccctcctcgcggggggtgcctcccccactgctatggggatcccaagagccagtgggggaagaggt

SEQ ID NO: 198691 - DNA, 224 bp, Homo sapiens
gggaggagggcggagaggaaggaaagtggagaaaaatgcagactcagaagcagtccatataacagctcaaaaagagctagccggcgatattatcacaacgatacagtacaaatcaaagcaaaaataaaaataatttggccgatacagcaggctacactgccaagaacccagatggcggccttcctgcggccatccgcacgggcctcctcaccccccatctctcc

SEQ ID NO: 198692 - DNA, 466 bp, Homo sapiens
ataggctataacatagagcctcggtgtatggcaggctatgccatctaggtttatgtaggtatactctatgatgttcatacaataaaatcacctaagaaagcatttttcagatcatatccctaccctatcattaaatgacatatgacttcatatatattcattctgtgaaagaaacttaactcacgtctaagtcaatgggtgaaattactgacaactcttatttctatgaactcaggatgagtttaatgaatgcatttccctcactctattctggtctgcaagactggacacaatacaaagacaataaatatggatggtttatggggaaataaatcatactcttttcaggaagataatattaaaaagtaataggattttataacttacatttacaatttttattagagatatgtacactactgtttctgtattttgtctaagaaaacatgaatctaaaattggtaaa

SEQ ID NO: 198693 - DNA, 280 bp, Homo sapiens
aactctgtctcctgggttcaagtgactctcatgcctcagccaccctagtaactgggattacaggcacccaccaccacgcctggcctcgtatttttagtagagatggggttttgccatattgcccaggctggtctcaaactcccagccccaggtgatccgactgcctcaccctcccaaagtgctgggattagaggcatgagccactgcgcctggcctggtgactaagtagttttctaagagattaataaagccttgggaaattggaatggggctcatttta

SEQ ID NO: 198694 - DNA, 337 bp, Homo sapiens
gggcaacagagcaagactctgtctcaaaaaaacaaaaacaaaatgaggttattagaatgggccttaatctagtacgactggtatccctatgagaaggggaaatttgaaccaagacacacacacagaataccacgtgaagatgaaggcagagatctggctgacacgtctgtctataagctgagaaataccaaggcttgccactagaccaccagaaccaggagagaagcgtggcagattctccctcacagccttcagaggaagctgactctgctggcacttttacctcaaaggccaggccccagaactgtgaaataatacatctctcttggttgagcca

SEQ ID NO: 198695 - DNA, 127 bp, Homo sapiens
ctgacaatcctcagctgccaaacatccctggaatggccttctcctaggcatcttgtcccagaagagaattaaagcctggattaagtaaagttaaatatataccaactctatgacccaacaatgtcac

SEQ ID NO: 198696 - DNA, 406 bp, Homo sapiens
cactttgggaggtctcagtgcctgaggatgggcagagagacttggttgagctgacatgtttgggactctgaccatgtgcctggtcttaaacgggtggtcatgacctcctgttacagtagaggccgtgcagtccttagcaggggcagacgcacctccgggtggtcgtgacctcctgttgcagtagaggctgttgcaatccttagcaggggcaaatccacccctgcaatctggtcccatcttgttccattttcaagggccttgctcttcaggttcccccttcccccttgtcatctggtctgagggagcatgtccacccccagcgcaacacgaacagcagcagccaggctttccctccctcccgccatctcctgccgctctgccttccttgccagcctcactctgctct

SEQ ID NO: 198697 - DNA, 697 bp, Homo sapiens
gatgaccagaggtcactttcattgccattttccatttggtgggttttggccggcttctttacctcagcctgctttatcagcaaggtctttctgacctgtatcttatgtgacctcctatctcatcttgtgatttagaatgcctaacctgcgaatgcagcccagtaggtctcagccttattttacccagcctctattcaaaatagagttgctctggttcagatgactgataaattgattgaatattgcttaccagtggtttgagcttccttgctgtacttagctagtgttttattaagtaaggctatgtttgtactaggaacactaatttctgaaggggatataaatttttccagtttatatgagcagcacttagtggtcattaaattggatactactacattaagaaactaccattgcagaattctctatgagtatggcattataatccagattggtttaaaatgttagctaaactgaatcaaagaaactgtactgagttcctattaagcagctaacttgtttatgttcaattgttgcttagaagcctttgtattctgtttgagttgttaaaacttcagacaaactaaattcaacagagttaactgaacaaagaatgatttgcagatcagcagcctctggaactagaataggttcagagtgactctggggtagctacatggttggatagtatttgtgg

SEQ ID NO: 198698 - DNA, 433 bp, Homo sapiens
gcccacctcagccttccaaagtgctgggattataggcatgagccacagtgcctggcccaggctgggatatattttatatcctggacttttaagtcacaattttacaaaaagctctgcagatgagttttgaggatttgctgagtggggtgcactgcctgcctctgagttttgaggggggctcacgtggtttgggcaccatcccggcctcaccccagcaccccctaacccccggagtgtgggtgcgagtggcactgacccaggagccctgtcctacctggatgttgatctcgttgtgccattcggtgatctccaccacttcctgctccaacagcttgcgtgaacgctcgctgccctccagggctgagcgcacctcctccagctccgtctgcagcaggctcaagcgccgctcctgcaggttgtactgcttccgcag

SEQ ID NO: 198699 - DNA, 251 bp, Homo sapiens
tctaacttcccaccttcagcaagcccaaagggtattttaattttgtccccatgtggcataaaagtacaagctcctttgctagaggccaaaaagctactacagagtagctgcagccttgttcatgttttctgctctgaatttttgtcctctctttttcctagtctccctggattttctttactctctttagttttggactgtgaattttaaaaagatgctttcatagcatctttaaatcaagcatttttagg

SEQ ID NO: 198700 - DNA, 435 bp, Homo sapiens
tgggtggggacacagccaaaccacatcagcagggtagtggtagaaagagcatcaagtgaatttggccctttgtaaacgtataaaaagacaacaatataattacagctgtcttattaacttttttttaaaaactttctattttgaaacttcaggcttaatagaaaagtttaaaaaatagagaattcccatatccccttccctgagctttccctgtgttaaattcttgtataaccataatagagttatcaaaactaagaagtcatcactggtactgtataattaactaaactacagagtttatttggatttctccaatttttccactaatgtccttgttctattccaggattcactgcaggatcccacattgcacttacttagttgttgtatctttttggtttcttcagaccagtgacagttcctcagtatttccct

SEQ ID NO: 198701 - DNA, 827 bp, Homo sapiens
  misc_feature (710)..(710): n is a, c, g, or t
  misc_feature (722)..(722): n is a, c, g, or t
  misc_feature (816)..(816): n is a, c, g, or t
cagtaggagttagttagcaaagagccgaggccgggcgcgcgaccctcgtccttctgcccctggccgcacactttgcgcacatctctttttctgcatggtggatattatttttcattatccttttctgggtgctatgggtgatcattccaagaagaagcccgggacggccatgtgcgtgggctgcgggagtcagatccacgaccagtttatcctgcgggtgtcgcccgacctcgagtggcacgcggcctgcctcaagtgtgccgagtgcagccagtacctggacgagacgtgcacgtgcttcgtgagagacgggaagacctactgcaagcgggactacgtcaggctgttcggcatcaagtgcgccaagtgccaggtgggcttcagcagcagcgacctggtgatgagggcgcgggacagcgtgtaccacatcgagtgcttccgctgctccgtgtgcagccgccagctgctgcctggggacgctgcgggagcacgagctgctctgccgcgccgaccacggcctcctgctcgagcgcgccgcggcggcagccgcgcaccccggcccgcttcccggcgcccgcggctgcatctgcccgacgctgggtcgggccggcagcccgcgtgcgcccgcacgtgcacaagcagacggagaagacgacccgcgtgcggactgtgctgaacgagaagcagtgcacactctgggactgctacgncgccaaccgggnccgagctctcatgaaggagcagctggtggagatgaccggcctgagcccgcgggtcatccgcgtctggttccagaacaagcgctgcaaggacaanaagaaatccat

SEQ ID NO: 198702 - DNA, 412 bp, Homo sapiens
aatatattttctgttactaaatgtataatctatagtgaaaacaaacatatcttcagcacatgtaaggcaaagcttttaaaaatataaagagaatttagcaaaaggacaattacaatgaaagattttaaggtatcactctcactctatgattggataagttatcaaaaatccataacagcaacaaattgaacaaaacaataagatgattcactaaccaactttgaatcctcatctgtctccatatttcaggccaaaaagagcattctaataagtcccaaaaggtaacctttgatatatgccatagtctgttttgcataagaaaggaaggaaagggaatggaggcaaggatgaaagaaggaagggggaatggaggaagcaaggaaagaagaaaggaaggaagaaaggaaggaga

SEQ ID NO: 198703 - DNA, 470 bp, Homo sapiens
cagtaaatagttctgcaggctcaagggcttgggaggggaccaaggcattcctagaagtttaagaaaagattccattgtctccatttcctccctccttgtccatgtgcccatgttcataaaaagataaaatgatcttctgggcatccatcagtgaaaaagagtttttttttttaaaaaagtctctgaggccaggcgcggtggctcacgcctgtaatcccaacagtttgggaggctgaagcagatggatcacttgaggtcaggagtttgagaccagcctggccaacatggcgaaaccctgtctctactaaaaatacaaaaattagccgggccgtggtggcgcatgtctgtaatcccagctactcgggaggctaagggaggagaatctcttgaacctgggaggcggatgttgcagtgagctgatatcaggccactgtagtccagcctgggcaacagagtgagactcgtctcaa

SEQ ID NO: 198704 - DNA, 436 bp, Homo sapiens
caatataaatggtagtccatttgcaatctgttccactttatgggcaccacttgtaagtcatggtagctgggcaggttggggtggagggacaggaaagctaaggccaatagcagctcctgtggtggtgtgtgtgtctgtagcagtgcaggtgcttcgaggttccctgggcccaagaggacgaagggtctgcaccaactgatagtggcacccttgggtagtttgaattaattacctgttatgatcagccccctttgataaaagttttagggtgttccggaaaaccttgtcactcggtgatggtttggtgtaagggtctggttagagcaggatcagatgatatttacatgtttcatatgctgtaacagtacaattctgatacttcagacagatatttaagcaattcctaacagtacattttaaacatcaaattgaacca

SEQ ID NO: 198705 - DNA, 545 bp, Homo sapiens
ggcagggatatgggggaccccagtggcctggtcagtctgtcgtctgtgacgctatccacgacctgtggccagatggccagctacccactgactctggtgcgcaccaggatgcaggcccaagataccgtggagggctcaaatcccaccatgcgcggagtcctccagcggatcctggcccagcagggctggctagggctgtaccgaggcatgacccccacgctactgaaggtcttaccagcaggtggcatcagctatgtggtgtacgaagccatgaagaaaaccctgggcatataggctgtgagctggacgacacagcctaggcagaaatgggacaggaggacctgatgacccctggccccaaagagccctcgaggcctcaaggttcaggccctggggcagtttttggtggcaaaagcaggctgggggtgggggtggggctctgggtcagaagattcctgaagctggggttggtggtgggtggaggggggcagtgctgggtcagaaaactcctgggactccctccccagggtgcagcctgagacaag

SEQ ID NO: 198706 - DNA, 312 bp, Homo sapiens
tccctgttgaacatgctaagctcaattctcaagtattccctagttattaataaatagcagaaatagcaactttgactgtatggcacttccatgttaaaagtgcattctcatttcactgccagcaaactctgtcagtttattaaagagctaaaaatgaaccctgaactgatttgatctattgcctagaaaatatgaaacaggcctaaaaaacaaatcttgtattattttaccacattcgatgcaggtttaggtaatatcaaggctgacaggtcagactgcttttcctttctataaacaattgatgccaaattt

SEQ ID NO: 198707 - DNA, 341 bp, Homo sapiens
tcgcggctgcctagaggttccatctcagatgggttgtcacgcaggagtaactggaaattgataccactgcaataaagatgccaaaaacaacaaaatatttcagacactcatgacctctcttcacagcagcctcatctacattcaaagaaaatgtggttgttggagcctgcaggaaacaaaagcctgcccggggctgaaggctcatcagaccatctccaccagagagggcaccagtgcaggcacgcagccatactggctttacagcctataaaagctgagatctccaactttcagaattgtgaaagtttccccacaatgaattcggtttcactattgggctt

SEQ ID NO: 198708 - DNA, 1317 bp, Homo sapiens
cacctcagcctcccaaagtgcagggattacaggtgtgaaccactacacccagcagttagtgcaatttcattttaatacaagtgaggaaattaaggtatagagataagttacttgtaaagtagaaaagctagttagctgaagagcttgagttagtatcttaggcttttatattatttcttcccactattcctggcttccctggtcctcaattttaatttgtggccttaagaagcctggggtgccaaaaatgtttggggctatctgtatttcatgttactccttagccttttttttttccttttagttcttcaccactgcacacttggcaggatgtatcccattttaaaacttgacagtccatctccttcactcccatactgtagggctaggcaagcaaagcaaactgattctgcaatgcttctaatagttattcctgctcattattttagctagatgtattctaaagtctttatcccaaagagttgaatcaaaggttcttccactcctccaacctgattgtgctgacaagccactaagctgagccatctaatatacagggtggcagggatgaagtcaccgttactgtccaacagcttttattttaagctggtgtgggctgggcatatcaaagacaggcaaagaaaaataacttggagagttgccattgaggatatatccacagtgagccaacagcacccacacaagcagccctcgtctgtataatgccctctactgggtcttgagggagattaaaaagaaagatctcttccatcctggggaacctgagatatgacagcagcacacaaatacaggcagatttatagttctaagcagagttccagtagctaagctaagggaaggagagtcaggagataagctgttagctgaattttattaaagacagatgacttcactagtaaagataaagtgggacctcccgtggttgggctgcaatattttaagtcccaagtgactgctgaatactcgctttgcagttggaaaaataagctgtttttggccagataaacagtgtaagaggtcatctctgctctagaggaacatgtaacctaattgagacacttctacatataatgcaagatagcatatggttagtcaagtagtagaattctgagaagagaaaatctgactggactcattaggtaaacataagtggtggaaatggacatttaactgggccttgaaaggtgggtagtatttaaacagtgcagttacttaataagtgtccacaatatgcctggcattgtactaaaatacaaggtaaattgtatgtggctgcctctttcaaggagattacat

SEQ ID NO: 198709 - DNA, 1342 bp, Homo sapiens
cacctcagcctcccaaagtgcagggattacaggtgtgaaccactacacccagcagttagtgcaatttcattttaatacaagtgaggaaattaaggtatagagataagttacttgtaaagtagaaaagctagttagctgaagagcttgagttagtatcttaggcttttatattatttcttcccactattcctggcttccctggtcctcaattttaatttgtggccttaagaagcctggggtgccaaaaatgtttggggctatctgtatttcatgttactccttagccttttttttttccttttagttcttcaccactgcacacttggcaggatgtatcccattttaaaacttgacagtccatctccttcactcccatactgtagggctaggcaagcaaagcaaactgattctgcaatgcttctaatagttattcctgctcattattttagctagatgtattctaaagtctttatcccaaagagttgaatcaaaggttcttccactcctccaacctgattgtgctgacaagccactaagctgagccatctaatatacagggtggcagggatgaagtcaccgttactgtccaacagcttttattttaagctggtgtgggctgggcatatcaaagacaggcaaagaaaaataacttggagagttgccattgaggatatatccacagtgagccaacagcacccacacaagcagccctcgtctgtataatgccctctactgggtcttgagggagattaaaaagaaagatctcttccatcctggggaacctgagatatgacagcagcacacaaatacaggcagatttatagttctaagcagagttccagtagctaagctaagggaaggagagtcaggagataagctgttagctgaattttattaaagacagatgacttcactagtaaagataaagtgggacctcccgtggttgggctgcaatattttaagtcccaagtgactgctgaatactcgctttgcagttggaaaaataagctgtttttggccagataaacagtgtaagaggtcatctctgctctagaggaacatgtaacctaattgagacacttctacatataatgcaagatagcatatggttagtcaagtagttattcctgctcattattttagctagatgtattctaaagtctttatcccaaagagttgaatcaaaggttcttccactcctccaacctgattgtgctgacaagccactaagctgagccatctctgctaaagatacaaaaattggctgggcatggtggcatgcgtctgtggtcccagctactcgggaggctgaggcaggagaatggcatgaaccccgggaggt

SEQ ID NO: 198710 - DNA, 402 bp, Homo sapiens
tttgaagtaacctaacgatctatcacttggaaaatggataaatgaattgtggcatagttatatccaaaacacactgtgcacatagaaaagaagtgaacactactcagatttgcgtggatgaaactcaaatatattgttggacaacaaaagcgagtcacaaaagaatattatgtaagcctttcatataaagttaacatgctacatacaatattttgtttagggatatatatatatatatatgtacatgatatatattatatatcctataatatgattatattctatatattcactgtattatattttatgtatttttataatataagagcctaaagcaaaacatggtaatgttaaagattgatttcatgatagtagttacctctgagagggcatgagagggat

SEQ ID NO: 198711 - DNA, 104 bp, Homo sapiens
tttctcttcccctttcaattttcttgccctgccttcctccctctcttccttcttctcttccttcctttcaactttttgttcttcataggttgggttattccctg

SEQ ID NO: 198712 - DNA, 127 bp, Homo sapiens
aagctgaacttatttttccccctcatcactgttataatgaaatgaaaacaactttattcaaagacctgctactatacttccttttgcttaaaggcagtttctaagaacctaccaatgacattacatg

SEQ ID NO: 198713 - DNA, 1155 bp, Homo sapiens
tgtagttctctcccagagcacagttgagttgattgcttttttgagaaagcctctaagggatttgctgtctgtgtgcctattgggctgtctgtgcccctggctggagcagaaactgaggaaggaagatcctacggctcatcaagtaaaacggtcttttggggaagaagcattcttagaaatgctgcaccaagagttggaattgagaattcagaaaacatgatagagaaggaacaggaagaaaccatttggacatccaaaaataaaaggccagaatctcactttgttgcccaggctggtggtctctaactcctggacttaagcaatcctcccgcctcagcctcccaaagtgctgggatcacaggtctgattataaaaggagaattggaggcttaccaaacatctgaagagctttccagaagtttggtcacttctgaattagagaagttaaaacccaatcacctactaatgctgtgggaaagttctgcaggtgatacatcacaggggctcatgaatgtgtcttaagctgggtcattgaagtggaatgttttcacaagacctcctccacttgctactgtgtccggaattggtgggttcttggtctcactgacttcaagaatgaagccgcggaccctcgcgggagtggcaaatcaaaggcattgcagcctctttcatcactgccgattgctgatgccaaccatgtgccaagtgcttaatacgtcaccttaaatcttctcatccaccctcagagtagctgcagcatcaacccagtgccctgactttcaagacgactatgaaaacaccccaactgctgctaaattaccagcaacaaggatctgacattcttattcaaaagaaagaacaccgaaattgaccttaccctgacaatatgatggctgaaggatttatgatcacttataacatttgaaattgaggcggaacctgaagaataagactctggtgaaaggtcctatttatgcttttgatgtctttcacttggacatttaccacatgcctattggtaggtttgttacataggtcagttaaggtgatacaagaataaataaaacactatccctatcctttaatatcatttatttatggggtcaatcacagattttcatttttcaaaatctttgataaatgtcagaattatgt

SEQ ID NO: 198714 - DNA, 645 bp, Homo sapiens
tgtagttctctcccagagcacagttgagttgattgcttttttgagaaagcctctaagggatttgctgtctgtgtgcctattgggctgtctgtgcccctggctggagcagaaactgaggaaggaagatcctacggctcatcaagtaaaacggtcttttggggaagaagcattcttagaaatgctgcaccaagagttggaattgagaattcagaaaacatgatagagaaggaacaggaagaaaccatttggacatccaaaaataaaaggccaggtgaatacattcacaggggctcaatgacagtgtagtcttaaggcgtgggttcattttgacacgttggcaactgtctctgtcacaaagaaccttccctccacttgtgcattacctggttgatccgggaaattgggtggggattcctttgggtccttcaacctggactcttcaaacgacaatggtaaggcccggcggggacccccttctgcctggagtgagttggggcacacagttcacaaacggggcaattggcaaaggccttcgttttccattccctctgggcccggaatttgccgtggattggccacagaccccaattgtggcccacaagggggctttcaattagcggttcacacctctaaaatctttccatc

SEQ ID NO: 198715 - DNA, 593 bp, Homo sapiens
cagtccaggtaatggagcagagactggagcagagacaagttgttcccactgagctctcctcagattacagattgggagtggcaaatcaaaggcattgcagcctctttcatcactgccgattgctgatgccaaccatgtgccaagtgcttaatacgtcaccttaaatcttctcatccaccctcagagtagctgcagcatcaacccagtgccctgactttcaagacgactatgaaaacaccccaactgctgctaaattaccagcaacaaggatctgacattcttattcaaaagaaagaacaccgaaattgaccttaccctgacaatatgatggctgaaggatttatgatcacttataacatttgaaattgaggcggaacctgaagaataagactctggtgaaaggtcctatttatgcttttgatgtctttcacttggacatttaccacatgcctattggtaggtttgttacataggtcagttaaggtgatacaagaataaataaaacactatccctatcctttaatatcatttatttatggggtcaatcacagattttcatttttcaaaatctttgataaatgtcagaattatgt

SEQ ID NO: 198716 - DNA, 619 bp, Homo sapiens
aagctctctgtagctccggactaaagtcagttgtttgtgagcagaaaacggcagcagtcggctccaggtcatcactgagagcctgctgttattgcagcctgctcgaatctgatcccaagtatcccaccagctgctctttgactttgaagcttacaccaatctatgcacagaaatctatgcaccacagctacagcacaaccaagatactgccagggaagacgctagtggggcacaggtcgctgaatgtcgtagctgaatacagtagctaaggtgtctccatgaaaagtattatcgccagttgagtaaataaatgactcatggcctctcacttttatcccaactggaaaagcataagagctttttttataccaagatcaaacaaagccatgatttctgtttcactctgcattgggctaattgatgttttgacagttcaattctgataacagcagcgcacactctaattctctctgggaagtgaaggaaacactgccctgtattttcctgacttcaggcttatactctggtaatcttccaaaaacttcccatggctgcccatcttacttccaacaatccctgaactcaccgcagccccttaggctgtcccgcctcccacgtg

SEQ ID NO: 198717 - DNA, 612 bp, Homo sapiens
ggctttaaatcctgtggaagtggcattggtgacatggcagtctgtgaaggaaatggtatttgaagggggtcctcgtccatggatcttggagccctcccgattttttttggaattgaatgcggagaagacagagaagattggaatagcacaagtgtggctgccatctaagagaaaacagaaccagtacatctaccggatccaatgcctggatttaggggaacaagttctcacattccgaattggaaatcatccaggtgtcctgaaccctagtccagctgtagaggttttgcaggttcgcttcatttgtgcccaccctgccagtatgtcagtaactccagtatacaaggtgccagctggtgcccagccatgtcctctgccacagcacaacaaatggctgattcctgtatcaagactgagggacacagtcctggaactagcagtgtttgatcaacataggagaaagtttgataatttcagttcactaatgctagaatggaaatcctccaatgaaacactagcccatttcgaagattataaatcagtggaaatggtagcaaaagatgatggcagtgggcagacccggttacatggtattgtgaaaatatacaagtc

SEQ ID NO: 198718 - DNA, 226 bp, Homo sapiens
tgtagcatattgtggttaatgtaggtgtttcacagacctgcttatgtaccatcaagctttatcatattctaaagttcaaaagtgagttccaatatgcattattgagttgagttccaatatgcactattgtgttttcttactggaaatacaatttctgttcttaacaccatcaactaagctccctgtactgtgagaaaagaaagtgagtaaccgacctatgaaatcc

SEQ ID NO: 198719 - DNA, 327 bp, Homo sapiens
gtgaggtggagagaggaagaccaggaagccagactagcttaaagaggaacgagttaacagaagaataagcattatgacccaacacagaatacaaatttaataagaacccattttctttattaaaaattaaagacataatggccatttattaaaagccatgtgtttggcactttttgtagtggtttcacataattctaggggcatcccactgaagaagggtttacaatcctcattctacaaatggggaagcagaggctctgaaggatctccttgtgaattgctaattagaagctctggaaattacctatgttctgactcagccacttc

SEQ ID NO: 198720 - DNA, 371 bp, Homo sapiens
ctacaaaaattaattcaagatgggcttattcatttcactgagtgccattccacatgcatttgtggtgtgggtgaggcatggtagatgagattcacagcctaggctgcctgatagcggattccttacacctgagctgaaatgtctccaactagaccaaatgatgatcctcttttctcagaaaaacacaacacattagaccctcgttgatttttaaattgcctactgtatactgttttaaaaacttggatgcagtacatcccttttatctttattagaactgggaattggatgacagatgctgatccagggcaaaattgcatatatatatattttttaaatttactttaagttctgggatacatgtgcagaac

SEQ ID NO: 198721 - DNA, 385 bp, Homo sapiens
tagctgggattagaggcgccttccaccatgcctggctaattttttatttttagtacagacagggtttcaccaggttggccaggctggtcgcaaactcctgacctcaggtgatgcgcccgccccggcctcccaaaacgctgagattacaggtgtgagccaccacaccaagcccacagtatcaattctatgcattcttttctgatttcattaatctcattatcttcatttgatatttagtcaatagttactgtcagttatgtgttagttattatactagaaacagtcttttctccatctcctttaatccaatgatttgaacatttttattcctttccaatgtctgtcccacatttcttactgtatgtaggacatttcttactcaaat

SEQ ID NO: 198722 - DNA, 360 bp, Homo sapiens
gcctggttactatatctatttttaaagccttcgtttttttgctgttgtttgtttttgtttttttgtgtgtgatggagtgaggttgttgtatgtatcaactgtttgtgtcaataagctttgaaatgctaactccttaaatagtttaagacacttggctttaatttttggtgtggcaatcttctctttctgtgactagattttacttgttgatctctctgaaatctggagttggaagttactatttctttgcttacagataattgaagccgaccaaacttgttaaagtcaaaaccaacaacaccatgctttagtacacgcctctgggtttagtcacagactctggtaggttctgcaaatggc

SEQ ID NO: 198723 - DNA, 239 bp, Homo sapiens
aattagtatatcatcatccatacttctttcctctaagtacaaacaaaatattcagggcctactggtggcctcctcttttcattcccattctagctattatagggtttactcttgtgtttttttttttttttaacttcacaatgcataatggactttttctcagtaaatatagaactaagccagtttttaagtagctacaaaatataatttggatgtatcataatttactgtaatatttc

SEQ ID NO: 198724 - DNA, 646 bp, Homo sapiens
taattagcctttccgctatgttgtttattttgagcagagacacgtggttccttcgactgtgagaaacttgaggactgttcctttaaattagttacatttactgatgtaacttctcgttgaaccttgaaagaacacctgaggttgggcggggagttgaaattttgattctgcattttttttttttttggtaaagaatgaatgcccttttgagatgctctaccatgagtgagattgttcttcgcttctgtcttgttaatgtacagtctagagatagtaaactcccagtgttcaaattttgttttttatttttcaggtctagtttataatcaagttgtagagatttttctccttaagtgtttctaggtatctttgttgacatgtgtaggggcatttatgtcgccgtgtttttaaaaactggattaaatctttaaaaagaccacttaattattgaggcagttacgattatgttttcttgttaggtgaattaaaggtagtgttgccatggtgtttatgagttcatagtttgtctaatgcatacgcatatatatgtatttaatatgaaaagagcacctttatggagattctaaatggactaagacttagttttggccactagcatcatgttgtctgttaagagagagaagac

SEQ ID NO: 198725 - DNA, 962 bp, Homo sapiens
gggccttccgtgactttttctcagaagttatgtagtgtcaattctgccatattctattgtcagactagtcacaagcctacctagatttaaggagagagaacagaggcactgcctctctatgtgaggcataataaagaataggtgaccctgtttaaaaccatcacagtggacgggacatggtggcttacgtctgtaaacccagactcttgggaggccgaggtgggcggattacccaaggtcatgagtttgataccagcctggccaaaatgatgaggccctgtttctactaaaaatacaaaaattagctgggtgtggttgcatgcacccttaatctcagctactcgggaggctgaggcaggagaatcacttgaacctaggaggcggaggttgcagtaagccgagattgtgccactgcactccagcgtgggtgacagagcaagactctgtctcaaaaaaaaaaaagtcacagttgggaagctctgtcccatgaggttgcgttgggactcaggttagtttggttggggaggggcaatggcctctgccatttgcatcatgtgacttccatttctggcttcaaggtaactgagccctttgttgcatttcccagccagggaagagagggtggagggcaagcagttcctaataaaaaatgtggttcagaacttgcacaagttgccaggtgcagtgtctcacatctgtaaccccagcactttgggaggccaaagtgggcgcatcacttgaggccaggagtttgagaccagcctagtcaacatggtgaaaccccatctctactaaaaatacaaaaattagttggacatggtggtgcacgcctgtagtcccagctacttgggaggctgaggcacaagaattacttgaacccgggaggtggagcatacagtgacctgaggtggagcccctgcactctagcctgggtgatagagtgagaccctgtctccacaaaa

SEQ ID NO: 198726 - DNA, 353 bp, Homo sapiens
agaaggggatatataatacctatttaaaaattcctagcacttatcacagcatctgccatgtagtagctagggtgatcacctgtttctggtcgcccaacactttcttggtttaggcacagaagtcccacatttggagaactgcctcagtcctgagaaaattgggatggttggtcaccacaccacagagtgtttttgctgtaaggataaacaaaaggagaatcatgctcattaatttcatacactccttctttagatgccataggataagtgcattctgtcaatgaatttatcacataaaaagttacatttgaatcacaagcctcttttatgtgatcatttttactatgtgagca

SEQ ID NO: 198727 - DNA, 448 bp, Homo sapiens
tacaaagactttttgtattcaatttttcaaaacaataaatgaaaatttaaaacagaagttatagaacttgggcttaaattataataaatggaaaagttgatcaagttcattttcatagtccatctgcacaattagttcattaaaaatatatattgatatcaactattttctaagcactcaagagaaaaaaagatgaataataacattgttgctgcccaaacttataatctagatggtataaacaactaatacaaacacatatgaacagttgtaaactattaaatgtatgaaagtaaaagggacatgatgaaatcagaaatttatgggtcttgagaaatttgatagtcaaaatttttacatcaattatgcagaactgctgctaaaattatcagttattctatattagccaaatagatgacttcagttttctttttgggctctcttctca

SEQ ID NO: 198728 - DNA, 449 bp, Homo sapiens
aaacacatttacattagtttgccctttaaagattatttcctacttgtctcttatcaatgtgagtacataaaagagaccttattacaattaaaaacaatgatggtttagcagcagatttagataccttacattctctctttaagagagagaatgtaaggcctggtgcggtggctcacacctgtaatccagcactttggcaggccgaggagggtagatcacctgaggtcaggagttcgagaccagcctggccaacatggtgaaaccccgtctctactcagaatacaaaaattagccgggcgtggtggcgcatgcctgtaatcccagcaacttgggaggctgaggtaggagaactgcttgaacccaggaggcagaggttgcagtgagccgagatggtgccattgcactccagcccaagcaacaagagcaaaactcctatctcaaaaaaaaaa

SEQ ID NO: 198729 - DNA, 273 bp, Homo sapiens
ttctttctactaatatggaaagacttctaagatatattgttaaatgaaaatagcaaagtagagaacagagttatcagttatcagtgtgctgtccttgacataaggatcggggcacataacaatataaatgcataaatattagaagtatacacaatgaactaacaaaaggtgactagcaccagtgaattaggtgaactaagaacattagagagcaacttctttatggaaatctttttatagtatactgattgtgagattgtgaatacctgttca

SEQ ID NO: 198730 - DNA, 612 bp, Homo sapiens
ggtttattcatgtacattctctactgcagtcctagaattagctatttctccagggagtgctgggtgcctttaatgagaaatatgtgtgtacttctttacagaattttgctggaagtcccacccaacaactttcttttatgtatcatccatacccagctgcaaaagatgctagacaatataattttttagtgtggtagactttgtagagtactgttgttatggaagaaagataagctagatattatgaggtaatttacatttgttgataaggtgaataatgtgatagagaataacttcttaagaccaaaagcacaacttacattgatacagttgataacattaacaattaaatttactctagaatatatactattctcaaaatatagtcacagtgggagaagatttataactttcaaaagagaactggtgtcaaaatcaagagaagccacacctgatgaaccttatccacttctaggtttcatacagatgcagatatcatggattttgagctgatgccataatatgagtcttttgggatcatggaaaggaattagcgagtcttgaatatggaaagatgtgaattgttgccccaaaaggcaaactgaagtaggt

SEQ ID NO: 198731 - DNA, 227 bp, Homo sapiens
agcctggaaaacagagtgagaacctatttcaaaaatatatatatcacaacaagaatgaaccttaaaaacaggctaaatgaaaaaagccatattcaaaggtctacatattacatgattcctttagggattaagtcaccatttcccccaatcacaaaagaaggatgtatcaacaagatattattattattattattttttgagatggagtctcactctgtcacccaggc

SEQ ID NO: 198732 - DNA, 165 bp, Homo sapiens
gagcagcaaataatgacaaagatgatgagggaaagtactcctcctggaggtggggactcaaaggacagcagccagccccagcccacaggatgaggtaccagcactgccccctgcccgggcccctggggctccctgacccaggcctccagtgtgcctgcccccctt

SEQ ID NO: 198733 - DNA, 408 bp, Homo sapiens
gctgttggttcatttactcatttactgattccatatattattcctaagtcccaactacatgccaagcactgtggtgggtactggggaaataaaggaaatctaggcattgttcctgccatcgaggagctgagtacagttcagtagggagacaggtaagtgaccaggcacatccagaaagagtctcagatatatctagtgcccccagctgctgcctggcacagtgtggatactaaaatatttcttgaaggagtgctgaccatgtgacataaaagcatgcattaggaacatgtagtccaggctcagcagtggtggtgcagggtatttcaaatatatgccctatgtcattatgctaacataaacgtgctcatttgaaggaatagacacacttaaccatgatggcaccaaatg

SEQ ID NO: 198734 - DNA, 1250 bp, Homo sapiens
ttgctcccatccctgagatttcacttaatcaggacgcgtatttgtgaaagccaaagacagatctttagtctcgtcaccatacagcctttgcgttgtatcctgaggtctactggtgatcttttgctgtgtccttgtcattgtcctcaatgaaagctgccctgtgaggaggcctgagatgccggagctgccattcaggtgacagcagcattcccctagtcaaggagatgtgtcgcaaggccctcatggctgctggagttctgattccaggtgtacatagtgtgaatggaaccagcccagttctacagagcatcttgatagaatgctaatgattagttgctataggttgattatatttttatgactttttaatatatgaaccatctaagatgctttagactcaataatttaggacgattagagttaactataaattcttgaagagggatgctcaggaaggagggaagaaaatgcttccccacatggcaatcttagtcctagtctttgtcttttggttttaaaggaattgttttctgttcttaattgcggagtgaagatctagattgaatactggctgctgtagtcaaggatgagaacaaagttatttctgcctctaagtaatttctctccccagcctccaatttggatattttatctcctaaagaacggggcggcagtctttcaggagtaagttgttagattggtgcccctctgtcttatgacaggccagttctcatgactgagagtcgcttctgcaggcaaaaggcatcagggtggcagtggcaggcctgcaggccttccctggcatagattactgtgagttgtctgcctttgtgctaaatttttatttagaaataaattgaatctcacttgatttgtactttgagcctaacttgtttggtatttagaatgtactagttgaccgattagaatcattctgaattatacttctttatatgatagtagggtaacttgtagacactgctgcctctctgaattaggcatatcatttttatcaaaagtatttattgaggttctcttggggctgggcatggtggctcatgcctataatccgagcactttgggaggccgaggcaggcagatcacttgagctcaggagttcgagaccagcctaggcaacatggtgaaacccatctctaccaaaaatacaaaaattagctgggtgtggtggtgtgcacttgtagtgccatttacttgggaggctgaggtgggagaatcgcttgagcctggaa

SEQ ID NO: 198735 - DNA, 493 bp, Homo sapiens
aaaaaaaaagtgaaacatctaagccagaaggattaaatacatttatattctggccacttctgggggagttgcatcctgttctaggtttgggacactggagttctaatatttttaaggacacaaaagatgactcttctagcatgtgaagacagaagaaactggaactgaaccccttacataaaacctagagcctttcagatctgtcctattgttaataggagaatagaaaaaatgccacagaatgatctgagtaagcagcaatatagctcatcttgctcaagagctattttatgaaaagaaaataagagtcacaggagaaatcaaaattccaataaagatgtgagcccaggtctttcttatttcaaagctcttgatttttgctttggtctctgctggccttcctttctctgaattgtctttatgttatgtagagtaaagagagttttattcttgaacccagaaccaaagctatacacaaactattctcacaact

SEQ ID NO: 198736 - DNA, 456 bp, Homo sapiens
gcagactcagcattttcagggcgtctcccaagatctccaataaaggcaactaggcatcgactaggctaatcccgtgacggcctgttctgcggggacatcatcaccctggtgctgccctctcccccattctctagagaaaggagccccaaaagaacagataaactctgcctcctagaaagggaagtctctcaccgtcagcactgtggacatcgggactggatccatctctggggtgaggctgccctggcactgcagggtgctgagcagagtccctggcctccacccactccctgccaggagcaccccttagttacactgagctatgatcgcaccactgcactcgcacctgggcaacagagtgagactctgactctaaaataataataataacaagaatataagaataataattcagatccatgtccgataaaaataataaataagtaaagctgaggc

SEQ ID NO: 198737 - DNA, 566 bp, Homo sapiens
taaagggagattttcaaactgaaatgaaaatacactagacagtagctcagattcacgtgatgaaatacagagcctccagaaagataagtatacagtagtcttagttcattcagaatgctataataaaaataccacaaactgggtggcttaaacaacaagtatttgtttctcacagttctggagtctgggaattccaagatcaaggtgccaacaggttcagcatctggtagggtcccacttactagtttatagacagctatcttcttgctgtgtccttacatgacagaatggggtcagagagttgtctagggttcttttaaataaaggcattaataccattaatgtgggctccactctcataacctaatcacctcccaaaagccccacaccctaattctatcacattgggggtatttcaatatataaatgttaagaagacacaaacatttagtccagtgtaataggtaaatagaaaaagtttaactgtaattttatgtaactcttttcttctttcatatgatttaaaagacagttgcagcaattgttaaactgtgttgatgggttta

SEQ ID NO: 198738 - DNA, 492 bp, Homo sapiens
aattgctacattacttgaagagctcatagtttcgtgcgccaagtgcttaatgacatcacctgctttccatagtaacccagctgagttaaaaatatagaatgtcttggccccttgacctaagatcttcagggatcttggctacccaatgggttctcaaccattcacacatgttagttcctactctgtttacaacttcagctttcacatgcagtttctgctaagttggaaggagaaattatagcaaattaaagtgttaattagagaagtcacagggtaacactttttatttagatctctttgttcctctgtttgccatcgtacttgagaacaactccacagtcaccatctatagtgtacaaagtaaagtacttgtagggtacacgagtacctgtagaatattaagtacctatagggcacctgagtacctgtagggtctgtgtggcaacacagaccaccaagaaacccatcgtcaaaacggatacttatgcagct

SEQ ID NO: 198739 - DNA, 440 bp, Homo sapiens
cacaacatacctagcagacttgaccagagggaattgggaaaggccaaagtaaattattctaaaaaataagcaagcaaaccagaaaaggttaagatggagaggagcttagaggagcaagtgctcttcccatgctgggaaaaaggcagcgacagaaccgcctagtgggcaggtgagggcactgatcacgtgatagactggggcccactgcatctcttttctctttgggtcttgaggatggagaggcaggaacatgaaaacagtgagaaattttgaggttcacttcccttcttccacctctcacttcccccataacctcttccttttgatagtgctggaagaacaacccaaggccagccctcttgaagcaggcaaatagatgcttgtcctttacttcatgtataaagagattgttttctttctttactaagacagtcagagcc

SEQ ID NO: 198740 - DNA, 722 bp, Homo sapiens
tctttttgtaatttttatcggctgtcacggcatcattcttggtgatctcttctcttgtgctcaaaccagactttaaactcttcttcagctgtttgtggagcacacagtcccaagtacatgaagcaacataactttaggcaatgcaagataaataatagccctttcataaggacgctctggctttttattctataggcttgtatagaccatttcctttcacagtttttactctgtgggcttgtatggactgaccatttcctttcagtttttagtagatctagggcttttaaagaagggcttttcttatctgtctctttttttttctcttaatatgaagcataaaggtagagaagcttttaaattctatcctattggattttattaagatactgattttttttcttctgaggattcagtaagtggtatttttgaatacctaacatagccagaaattgttattaatattgatgcgacatagtcatagtttctgacatctttagagctaaaaagtttgtttaagtctgtatcatccaaccctttcgtttgactataaaagaaataggaagccattgagagtgtgatgctctgagattactgagtaattctgtgtccccaaaaagccagcgctggccatagatcttctgccttgtagctcgcagagattttgttttccattttactgctaggatttctgtgcccatttcaggaccggctcgattacg

SEQ ID NO: 198741 - DNA, 374 bp, Homo sapiens
gggtagcttgggcatagagaaggcctatgtggtgggttccagctgccttccaactttccaggctatgcccagatttattttctgtcaccttcattctctctccatagacactgtaaatgcagagcaagctgctacacacagccttcgtcttctactcatacacacaggagagtcttttggatgggaaatgtaggctagtagatcagttatgtttttctctaaatgctagggagacttcatgcttatgaaagctgttgtaggggtaatgactgccacaggacacttctaccatcctgtcatgacacctttcttagctctttctgggctggtaattaggaaaagagcccaagcatagtcaggcttcttgactatga

SEQ ID NO: 198742 - DNA, 676 bp, Homo sapiens
ggcaccccccatcctactttctgtctctgtgaatctggcgactctatggacctcctaggagtggaatcacacaggatttgtccttctgtgtctggcttattttactgagtgtgacatcctcaagatgcatccacattgtggcccatgttgggattccctcccttttttaggcaacaaatcacttttgagtgcttactgtataccaggccctgtcctcatgcttttcatgcactaattggatcctatgcagccctattaggtgggcaggattattatcatccccatttgatgggggaggaaactgaggcccacagctgcaatgtcacttgtcaaacatcacgcagttccagagcagaggggtgtgatcctgggcctcccggctgcacaacatgcccctcattctccctgacactctgttcagctccctggccagtcctggtgggctcttgtctgctgtgggagctggacccccacctgcccgtccctctttaccactgacgtatgccccgcggactcctgccgttgctataaatacaccatcagctggcgtctgcgactcacgcccggcagccaccttctctgcacagacagacggctggcacacctggctgcccagccctgggggataacaggctgctgctgccaggaacccctcacccctctgctgtccagacac

SEQ ID NO: 198743 - DNA, 379 bp, Homo sapiens
tgcagtacatcatcaaagccacattactctgatgatacggaatttatgagggatgtcccatatcatattatgcattaagttgaagtcaacaggggaggacaataggggacagaaattagaatgtgcaagacatttggagtcaattgaatctactcaattgcatgctggtaaaaacataaattgcaaagtgatatctattttttttcttcccacgagatattgctggagacaggaaagtattcaaagactcttgaggatactagagatttatctgaagtccaaggaagcaagtaagtttataattcaagatttttgggttgcatttatacaagaggtagactgtagtcttgtgatgattgtggtcttgtgatgatttgtg

SEQ ID NO: 198744 - DNA, 1148 bp, Homo sapiens
gggggttttgtagaaggtgctggggtttgaggggtcagtcggacacgattggcagggagagcactagagacaaggtgtcactatgttgtcttaacattgtctaggctggtcttgaactcctaagctcaagcaattatttcgccccagtctcccaaagtgctggattacagctgtgagccactgtacctggcctctcttcttctggacataaaaatgaatacatgaagctggatgcagtgagtctcaccctgttgcccaggctggagtacagtggcgcgatctcggttcactgcaacatctgcctcccaggttcaagcgattctccttccccagcctcccgagtagctgggattacagaaacacgccaccacgcccggctaatttttgtatttttagtagcgatggggtttcaccatgttgaccaggctggtctcgaattcctgacctcttgatccacccgcctcagcctcccaaagtggtgggattacaggcatgagccaccacacccagccaggaaaatattttctattttagctaaaaacaaaagtgtatatttaggaaagagatggaatagaccccatctcagaattcatatcaattctgaggataaacaaagaagcaaatccatggctgtgtctacacaattacaaacattcatttaagcatttaattacatgaattcaactaacaaagtaaattgtactaaaataaataaaagtcctttatttttcttttcagtcatataagtgatataaacagttgattagttgaggatattaaaaaattcttaatatcacattttgaattaataatatttgttatactctaattacaaaataacacctgcttgttatggaaaatttggaaaatatgagaaaatctcaacaaaattatccgtaaatccacctttcaggtataattgttgcttttttagtgtatgtctttggacttttctatgcataaattatgtgtttaaacaaaattggactaaagttgtatatattgtttgcaatttgttttttcctgctcaatattatgcatgatcagttttcctttattctactacatctaatctcttatgattgatatatacattgatgccaatgttttgtttttataaataaagctgaaataaatgtctttgtact

SEQ ID NO: 198745 - DNA, 1299 bp, Homo sapiens
gtctgtgaagctttgcagcagtacagcctagttgctggactgtgtcataagattgcagcatgcagccatgttcatagcaccacgccgaatcctttctggtgagggtatctcatattgtggcattggcattgtcgctgctgacattttgagtctgccccctctgtatctggtgcggagttgatcatgatgaggtgacagaggcagaactgccaaagtagagacaaggtgtcactatgttgtcttaacattgtctaggctggtcttgaactcctaagctcaagcaattatttcgccccagtctcccaaagtgctggattacagctgtgagccactgtacctggcctctcttcttctggacataaaaatgaatacatgaagctggatgcagtgagtctcaccctgttgcccaggctggagtacagtggcgcgatctcggttcactgcaacatctgcctcccaggttcaagcgattctccttccccagcctcccgagtagctgggattacagaaacacgccaccacgcccggctaatttttgtatttttagtagcgatggggtttcaccatgttgaccaggctggtctcgaattcctgacctcttgatccacccgcctcagcctcccaaagtggtgggattacaggcatgagccaccacacccagccaggaaaatattttctattttagctaaaaacaaaagtgtatatttaggaaagagatggaatagaccccatctcagaattcatatcaattctgaggataaacaaagaagcaaatccatggctgtgtctacacaattacaaacattcatttaagcatttaattacatgaattcaactaacaaagtaaattgtactaaaataaataaaagtcctttatttttcttttcagtcatataagtgatataaacagttgattagttgaggatattaaaaaattcttaatatcacattttgaattaataatatttgttatactctaattacaaaataacacctgcttgttatggaaaatttggaaaatatgagaaaatctcaacaaaattatccgtaaatccacctttcaggtataattgttgcttttttagtgtatgtctttggacttttctatgcataaattatgtgtttaaacaaaattggactaaagttgtatatattgtttgcaatttgttttttcctgctcaatattatgcatgatcagttttcctttattctactacatctaatctcttatgattgatatatacattgatgccaatgttttgtttttataaataaagctgaaataaatgtctttgtact

SEQ ID NO: 198746 - DNA, 483 bp, Homo sapiens
tcaaaatttcttcagtcttaatgtagtattgatatgtttattttgtgcttaattataaatttggttcattgacctccccaatcaaatatatagtcctacttattagctttataacctgagacaagtgactaaatctctctaggcctgtttgtttatctgtatgatcatactacctaccctacaaggttattgtgagtattgaatgagttgatcagaggtgtttggccccatagtgagttcttaataatattaactcaatgatgatgattgctactgatgttagctactagtagtaaaaacactggtagaggcttttgctccaaattaaagctgggaaagcataggtgatggctcatccctgtaattccagttctttgggagcccaagacaagaggatcagttgaggccaggagtttaaggttgcagtgagctatggtcacaccactgttcttcagcctgggtggcagagtgaaaccctctctt

SEQ ID NO: 198747 - DNA, 401 bp, Homo sapiens
gggggatctctctatgccaacttctgtgccaagtagagagataaagagaatgcatggaaagactatgattgccttagtgaagtactttcatatgaatgttagggtgtatgagagtgactgattttattgttgtacttactagtccctgttgtttccacaaagaaagatgccagcattgacattaacatcagggaggccataattcgttcactcctactgctttctttccttccttgatttcttccaatgcttcagcattcactcaacattaactgtttgcctactctctgccaagctccactcctggcagtgggatacagaaataaagacagagagacaaaaatccatgtctgtgttcccatagaagaaaaacaattttaatatgtaccatgggggaaacg

SEQ ID NO: 198748 - DNA, 200 bp, Homo sapiens
agctgaatagaatttagattaatggttgttcaggcagggagcagtggataggaaggaatggggtaatgttctagttctaggtcatatcataggtgaacaggtgtacattctattattaaaacaaaaggaaaacattttcagatcatcatagcaaaagttgatttatatgtatatataaatatatatttttttttgccaaa

SEQ ID NO: 198749 - DNA, 513 bp, Homo sapiens
ggagctcggtacccaagcttttaccgcgcccagcctggaatttttaagtagctaaagaattagatttgtttttatgtgaaagatatgattttgtcatagagttaggcacttgtgttactttggaccaaacgtagtctgctagaattttgagatagagctagatatgatctaccatggaacataattcagctatgtaatttcttaagtactagtatattatgaactgggaagcatttgaagagaaacagtgaaagcaaagctcctggtatttttcatgaaatgacaagtggtaaatagtatctattaaaattcactgtagttgctcagtgaaacacatcaatagctacatggtagctatttaagaaaaataacttaccacagactcaggaaactttacagtgtttgacttccaacagtttacagtatttatcatctgtgtttgtttgctgttcagatatggtagattcgtcatattaaacacaagcttcatgcggtaaatgtgactctaaaaca

SEQ ID NO: 198750 - DNA, 960 bp, Homo sapiens
agggtttattttcctctgatgtagaagggaaagaatgtgaattcaagtgaagagagcaactattacaaagaaacagctgagcatggaagttaactgccgggctatggaatagacagatttcaccttacaccttcttcatcttacgtccttgagcaagtttcttcacttcccagtctcagtttcttcttctataaaatagacataacaatgccccccttttttttgtgaggagtaaatgagaaaattttatgaaatacctaaaactggcatataataagtgccaataaatggtagctattgttaccaacctgccagcacaacttatgtttgtcccatttcttgagagtttataaagactttcttaagtgttactttaagatgtctgcaagcattctgcaggactacagaaaatataaaaatgagtaagaaaatgtcattgtgtcctcaaggatctcataaatcaaaaggtaaaaaaatttttacaaggataaaaattatgatacaaaacttaagatcactttagccctgttgtgagtcaggggtagaatgaagattggaaaactaatataaaggctgctgctcttgaagcttgaagaggatggtaacagttggcagagaatggcagagatggtaacagttggcagaggtggtaatggcagatagtgggaggcaaattaggcagcaaaagaaaacagaagacattcttcctgggaaaattggggtaaatatggaaggtcaggtttcaggaaatgtgattgtggttctgggtacgtaggatatgagatgttagagggaggaagaggtaagataactaataagcagatgttgatttatccattcattttatctaaacattagcaataattattgagtatctgagtagtaaacactgtgtcactagagacacaaaataatacttggcctgtaatcgcaaagagtttactgtctagtgaagaaaga

SEQ ID NO: 198751 - DNA, 413 bp, Homo sapiens
aagtagtttattcaaactaagggtagatatcttaatttaacagatatatgggggatgagtcagtgaactctgtgggaacactgagatcctaaatggtttttgatcctaggagtactgaggaacccctcattaacactgctggtgttggaagactatggtatgagccagagtgggggtacttggctgtagcagagtgggccatgacaggaattgagtggatttgttaaggaggtgggagatgtagagttataataacagatagacagatggccagacacactcccagacagatggccagacatcttccacttcctccatggacctttgttgtactgtgacttgttttaatctcaaggctcttgagaaacatagtgatatttctcatgcttatgttttaaaataaatattttgaa

SEQ ID NO: 198752 - DNA, 104 bp, Homo sapiens
acaaagctggggagggaggagacatgcttagctgtgtgtctggcacaaacttgggaaaacaagaagcatgaatgaatgaatgactgtataagatccactgaagg

SEQ ID NO: 198753 - DNA, 263 bp, Homo sapiens
cagtgtgctgagtatcctttggtcttttttctgtacctctacatgaatttgtgtggttttttatttttggggtgtaaatgagctcaaactcggtccatggctgtggggcctgctttcatccggccatgtatcatgcagagggaccccaccactgccatgggagttctgagcacatgccctgagctggggcttggcgaggctttgggagagatgggaagaagtcttcctggaggtggttaatttagagcaggttctggagaaga

SEQ ID NO: 198754 - DNA, 631 bp, Homo sapiens
gtacatgccaccacgcccagctaatttttgtatttatggtagagacggggtttcaccatgttggtcaggctggtcttgaactcctgacctcgtgatccgcctgcctcagcctcccaaagtgctgggattacaggtgtgagccaccgcacccggcttcaagtgaatcttgatgaaatatttgaagagaatgtaacattatttttattttgtattggttcagatgcatatagtcgactcagaatgatctttggtaaagtatgtgaagcacatctgatatgtcaggtctctcatttttgcactgatactaacaccacaatagattacagtttcataagatgtatatgattatatatgaaattcatcactgcaataattagatttagttaacattcttcatttcccacatttgctttaactcctctttcagattcatagtcttctatgtttacttttatgtttatgttttatgctatttctaggagtaggacagctatattaaaaatgacactgcattatttttatcatacagcagaatgtctgatctgttggcagaaatacatagatgtatatggcagaatgtatgtataatgtagtaatgactctatccgaggacattttatagccataactt

SEQ ID NO: 198755 - DNA, 488 bp, Homo sapiens
ttcttttcttttggtagagacggggcctccctgtgttgctcagggctttcttgaactcctaggctcaaccatttctcctgcctcaggctcccaaagtgctaggattacaggcgtgagccaccattcctgtaatggtcaacataagaatattgacagggcacaatttactccataacagatcccatgtttgtcatcagattggcaaaattttaaagtctgacaatgccaagtattggccaggtgtgacccagatgaaattcgtgctctagccaggtgtgtggtgactcacacctgtaatcccagcactttgggaggccaaggcaggaggatcctttgaggcctggaatttgagggagacccagcctgggcaacatactgagaccgcatttctaccaaaaacggaaagaaagaaacggatgctctgcaggggaggcagcatttgttcatatagaaataaaataaataaataaaaagaaattcaccctctg

SEQ ID NO: 198756 - DNA, 528 bp, Homo sapiens
atttctttatttttgagacagagtctcactttttgcccttgatgaaatggactggcccaatcatggctcactgcagcctcaaaatcctggcctcaagaaatcctccagactcagcctcctaaagtgctgggattacaggcatgagccacagcacctgacctagactgttttaaactagatttccctgagaaaactttcactggaaaaatcaaaattatcctgctgtcattaagagaaaactatctgttgtagaaaattacattcttttttttttcagacatgtcatataaatatttggacccctctctgagaacaaactacttaaaagtcatttcaatcattaacgaatatcataattgagggcctgtgctgggtgccagaaatctaccagtgagcaaaacagcacggatctttgtccacagtaaatttacagatcagaggaaacagaaaaacaatcagttaaataaaacaggtctgaaaattgcgtatgagaacccaaagcagaggtacctaatcaggtcaaaaaaa

SEQ ID NO: 198757 - DNA, 389 bp, Homo sapiens
actgggaatttgtgctgatggtaaatagatatggtttgaatcctggccactgcccaccagccatgtgaccaagacttaaccatattttttcggggtgttatgcagagataatgagatcaaaattgtaaggcatctagtactgacataataagctctcaacaaatggtagctatttaagtgttaataacaaatccttttcagatggtttctataacagtgaatttgcaaatagttggaacctctgaagtgcttcctctcctggactggaaaccccttgaggtcagtggccttgtctgcctattcacaatgtccgtctagcacatggtaggctcttaatatatatatatatatatatatatatatttatttatttattttttgatgaatga

SEQ ID NO: 198758 - DNA, 624 bp, Homo sapiens
tcctgatgttgttgtttgtttgttggtttgagactgagtctcactctgcgcccagtgtggaatgcagtggtgtgatctcagctcactgcaacctccacctcccggattccagtgatccactcgcctcggcctcccaaagtgctgggattacaggcgtgagccactgcacccggccctatatattttttttaattagaaaactcattctagaatggggacaaatgaggacagagacgtgaagagttaattctgtcagaacttaattaaacttttcattaaggttaacgtaaaacgaattttgctcagagtctagtaggtttcattaaactttcgaaacaccagtacttagacttcaaaagaacgcctcagggctctggtctccttcctgtgcacttagcacattgcgtgagcgtgcacgcatgcatgtacacaccaggaatgtgcgtgcaagctcagctcgtaggtagcagtgttaccagcgttcatcttcatgataaatggggcaaagctgtgagacggagtcagacaacctagggtccatcttgagaggcgtcatctgctgtgcaacctaaggcaacgcctcttcacttctctgggtccctgtctcctgctatgtaaagtgaa

SEQ ID NO: 198759 - DNA, 420 bp, Homo sapiens
agagtcagatttactcagaagctaatgatgcttaagctttagggcccctcatttgcatgggccccttctgaggccctggcactagttttgtactcctttcttaaacaagagccccccaaattgtatgggctttaggggtcacaaaacctggatctgtcccttctgataaaattctaattataaatgagtggatcaggcataaattttaaaattctgtaaaatgatggccggcatttcttcactccctagaaactttggaactgtttaaatttataataaatgcttaggtgtatatctatatctaaattatctattttttttaacttctgggaatcaagataaacatcgtaccaactaattatatgtttttgtaagtatagagattactttattccctctataatgttagtcatgttaaaa

SEQ ID NO: 198760 - DNA, 873 bp, Homo sapiens
  misc_feature (534)..(534): n is a, c, g, or t
  misc_feature (787)..(787): n is a, c, g, or t
  misc_feature (826)..(827): n is a, c, g, or t
  misc_feature (842)..(842): n is a, c, g, or t
cggcgggctggcctggcgcgctgcggcgctcgctcacccgctcccgaggaagggcagtgggccccgccgccgcctcccaatggcgaggctgcgggattgcctgccccgcctgatgctcacgctccggtccctgctcttctggtccctggtctactgctactgcgggctctgcgcctccatccacctgctcaaacttttgtggagcctcggcaaggggccggcgcagaccttccggcggcccgcccgggagcaccctcccgcgtgcctgagcgacccctccttgggcacccactgctacgtgcggatcaaggattcagggttaagatttcactatgttgctgctggagaaagaggcaaaccacttatgctgctgcttcatggatttccagaattctggtattcttggcgttaccaactgagagaatttaaaagtgaatatcgagttgtagcactggatttgagaggttatggagaaacagatgctcccattcatcgacagaattataaattggattgtctaattacagatataanggatattttagattctttagggtatagcaaatgtgttcttattggcatgactgggggggcatgattgcttggtaattgccatctgttatcctgaaatggtgatgaagcttatgttattaacttccctcatccaaatgtatttacagaatatattttacgacaccctgctcagctgttgaaatccagttattattacttcttccaaataccatggttcccagaatttatgttctcaataaatgatttcaaggtnttgaaacatctgttaacagtcacagcaactgggcattgnnagaaaaggatgccantaacaacagaggatcctggaagttaaaatta

SEQ ID NO: 198761 - DNA, 268 bp, Homo sapiens
aaacagaagaaaatgggaggttatggggcagtttaaggagcattagacaaacaagcagatacctagaatctggtttcagctctgcatttatttaattgtcatcaattgtccagtgaaccaagtttgcttgcctgtacagcgagaagattatactacataatctccacgttcttttgatagctggaatgtatgaaatgactctacttctgtgtaaaagaaaacaaacatgtttctagaaaattacttttaagtcgtcttccagagtgat

SEQ ID NO: 198762 - DNA, 428 bp, Homo sapiens
gtgattacaaacaaaaagagaagcaaaaactactagattttttgtgctatgatcttgtgggaccagactaaagtattaccaaaacaatcctaataatggcttatcttccattttgagatgggccttcactacagaacctttgggtttaattttatcaagcgacctttagtaatataacatataagtagcttttattatggctgcttgattctcaaaatctttttatctgcttcaaaaattaactgtattatgtacagaaaacaattcatggacattttataacaaaatattccatgtgtaggagtaggcatccaggaatagatctaaacagattattattattatataagaaataattcttcttcaaggtacatgtagagtacaaagtaaataatactttaaattcccctgaaatatagaaaacacct

SEQ ID NO: 198763 - DNA, 250 bp, Homo sapiens
aacaaaacaaacatgagagagaatcatacctgaatgagtcgtacgtgaatcctgggaggtgtgatccactggagtcattattgtaataatctaccactgcctgcactgagaccccagttattcatatccctcccaagactctgagtctcattccaccacagcatcaggctcaaaggccaggatctacatcaggtctggatagaaatggggctttctagctgggtatggtggctcatgcctgtaatcccag

SEQ ID NO: 198764 - DNA, 376 bp, Homo sapiens
ggcaccagcttctcaacgaatccatctctggaacacccaagttgggtgacctgccctttgtctgtcccctgtggcatcctgggcgtgtttctaacctaccatgtttacatgtcctgagaccccgctaacaccatcagctcctccaagccatgaaatacatacatcttaatcacttttgtatctgtggtgcatagcatggcacttagcctaaagtaggtgttcaagaaatgtttcttgaccaaagctgaactgaagtttgatgtgttataagtcatggctaggtacagtggctcatgcctgtaatccctgaacgttgagaagcttaagcttctcaacgccaagtcatcctcccacctctgcctcctgagtagtctat

SEQ ID NO: 198765 - DNA, 253 bp, Homo sapiens
ggcaccagcttctcaacgaatccatctctggaacacccaagttgggtgacctgccctttgtctgtcccctgtggcatcctgggcgtgtttctaacctaccatgtttacatgtcctgagacctgtgtaaaaggagggccaggacatcgcgacggggcttgcacgcgaagaaggaacgtcagcaggaggcaaccagtgccgcgatgggacgaatacaccggaacgcctggcacgactattggagcgagctctgac

SEQ ID NO: 198766 - DNA, 192 bp, Homo sapiens
gtggtaaaactgagaaacttttttgtgtttttcaaaacacattttcagttttttcactttctaaaagtaaataggctgggcctggtggctcaggactataatcccagcactttaggaggccaaagcaggaggatcacctgaggtcaggagtttgagaccagcctcgtcaacacggtgaaaccccgtctctac

SEQ ID NO: 198767 - DNA, 641 bp, Homo sapiens
gacaccggcattggagtgtgcctcatcagagctcccatgccacccccagtcacggagagttgcagacgagaaggggctgtggcttatgtcacagtcagacatctggtgtggactctgttctacccatgcctcctctgcaaggtacccagtaccatgaagctaggctatgcttcaagctgccagaatggatgcagaatttgcttgggagccatgtgaaagtgagctttaaccccactttcctactttccagttgtatggcatagagtaaaatctttattcctgatgagcttcaagctcctcatctgtgaagtgggtaaaataatatctgcttctgagacttattttgaagatcacacaaaacggacctaattggcctgcgataaacggtagctcttgacttttacacttcactgtttcccttggtactcaagttaatctcattttacctgaaggagacacagacccatagcctctgctgggagtgttctggttaaaggtaagccaaccaacccgggagagctatgggtccagaagccatttcaaaaacacttgatgcttcctgcggccctgcctgggggtcatgaaaacaagtccagttacatactctggccaggcagtcccactttgggaatgctatccgc

SEQ ID NO: 198768 - DNA, 976 bp, Homo sapiens
aatatattaatggatcaactttaaaattgttagttgccagtgatcttttttggaaaacaaaaatggggcatttgttgatttatttattttctgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatga

SEQ ID NO: 198769 - DNA, 783 bp, Homo sapiens
  misc_feature (53)..(53): n is a, c, g, or t
tttttctaaaaatgaaaaaactttatttacaaaaccacaacgtcagtctgctntgggtatgacaaaatccttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatga

SEQ ID NO: 198770 - DNA, 1064 bp, Homo sapiens
aatatattaatggatcaactttaaaattgttagttgccagtgatcttttttggaaaacaaaaatggggcatttgttgatttatttattttctgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaccattcttcctttaattttttgttatgcccacatattgtatgtaaaaatataaataaatggtacttaaagtatagaatataaggctaa

SEQ ID NO: 198771 - DNA, 1285 bp, Homo sapiens
aatatattaatggatcaactttaaaattgttagttgccagtgatcttttttggaaaacaaaaatggggcatttgttgatttatttattttctgtctctaattagttacctcagtttgattgaagccagtggagttgtgcttttcctctacttctacttcctctcccccacctttttctgcccagtgtaggtgtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagctaaacctaaataagttatcctgttccctaggaccttctctgtaaatagtgaattttagacgagtagtctgtcctaaatcttaaatagaaaaaaaactaaagcgatttgcttaagccattgtacattataaagagctgttttgttttgctttgctttgctttgttttgtttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaaaaaaaaaaaaaaaaaaaaaaaaaaaaaaaaaaaaaaaaaaaaaaagaaaagaaagaacgagcgacgagaaaaaggataaaaagaacgacaggaacaaaacaaaacccagcgaaagaagagaagccaaaacagaccaacaaccgtagaagaaagaagggaacaacgcaaatcacaaaaacacgcgaagcgacagaacaaccagagggaagcaccaaggagacgaaaatggagaagaacaacaaagagaaagcaaagaagacaccagcacgacaaaccggcggtcaacgataggccagaaaacaacacga

SEQ ID NO: 198772 - DNA, 825 bp, Homo sapiens
atgcaaagctgtcaactctcccgtgacctcaggctttccttacccaagtctggcaaccactggagaaggaggcagattgtccttttccttttggtgttcaggatcagatttcagaggtaagggatttggtttggactaaaatggcccaaaacaggaagacaccagatcaggagcaggctctggatggagacaaagagcagccagccctgcgctgctcttttcacccccattttgtaaaggaggcaacaggaagacacagccctgccttacgaggaagctggaagaggagagaaggaagcaggacagaaggaaggggctcagagccgtcccaacacaacccatctcagtctccagccatgaggaccttggggcggccagcctccctctgacctgggtgtaagaaggagggcagaagggagtgtccccatcacaggaatcctcagctccttcagttgccctggctgctatggtcaccaccaccgaggctcagcaaatggactggcagctgggtggatttctcagccaccgccctttgtcctgggctccctcactgtcatgctcccactgaccctggaggcgcatccttggtcttacagctgggcaggtctcacctttgcttccaggccctgtatgcctgtgcttccaggagccagagagatgtccaggtaaacttcctggccacctccaggccctggctgcccgggagaggcaaagcagtggcagagcacagtcatcagagcaccacgtcatcctcacctacaactcaggacacccagagccacagtcatcagagcaccacgtcatcctcacctacaactcaggaca

SEQ ID NO: 198773 - DNA, 367 bp, Homo sapiens
atctgtgactgtccagtttactgctgtcaccgggcctggcatttagtaagttccaagttgtcacatgaacaaatgagaaggaggagaaccaatattttttgagttcctcctacaagctatggtctcatttcttcctccttaccttcagggaggtagagctttcagatgagaaaacagactcacagagacaagaaaatagtctaaggtctcccagccaagaagagagggagtcaggagtcaactccaacatgacacaaaacctctccatgacctttgcagttccatcctctgggattccaagtgatcccttgtagtctgtgaagtcactctgataggggcctccacattctggatattaagtgggtat

SEQ ID NO: 198774 - DNA, 463 bp, Homo sapiens
catccttgaggcttcatcagtttggccccaatccatgccttcccaatctcaaacatatctctttgaagggccttgtgcctcaatttcttcattagcaaacagtgaaatttggcatagaccagatgtccaatagaacactccatgagtttctattgtccactattctattctatttctgcattgtccactagagcagccactagacacatgcggatactgagtacttgaaattggctagttagactgggggactgaatttttaagtttaattaatttttatttaaataatcccaaatgactaatggctcccattttggccagcccaaagttagaagaatttttatcattctttgacttgtgatcttttacataccctagttttaaattatgtgtgcaacccattgccagatcctgaaatcaatgtattggggtgcaaataacattttttaatgaaatggcataa

SEQ ID NO: 198775 - DNA, 418 bp, Homo sapiens
ttaaaagttgcactattgtataaagaatgtcaaatattaggaatgccatttatatttaaggcttataaatcagattgaacacatggaaatgtttaaaaatgaaattgtatgatatccaggatttgctacaaaataattcggtggcaggaaaataaaccagaatggtgatacagatgaaataagattggctaaaagttgaccactgttgaagctacatgatgggcatctgggcatctaagttcattgcaccattcttttgacttatgtggaaaaaatccagatcatgttacatataaaaacaaaataagcaagaaatagagactaaactctttttctcactctcctaccccgtttcaggctgcctggttgtttggggggctctttcaaatacaatggttcaatagaacaactacgaccg

SEQ ID NO: 198776 - DNA, 913 bp, Homo sapiens
cggcttcagccattgtggagtctctaataaatcaggagcttttctttccctctggagcctttcctgtgcactcttgggatctacttgtcctttgcaaagtctagtacagccacctctcccatggggaaggagacacttagcatcctgggaccaccagtcacagctttaggactttagctttcctggaccagccctgatggcaccatgcattgcctggatggtatgcacggacccaggctcccttctgagactaagaacagacatttgcattcaggtattttgcatatgccattgatagcactgaaaagtaaaacaatagaacaagatactaaaatctgggaagattttcttgggactttcagtacatctagcttcctctctggtcacaagggtagacagctggggacttttctattactggggtagctcccttgtaattttccactttgaatcttacatctttttgtattaagttaaatggtgttttgctctttaaaatagccttgtaatatggctggtctgcactgctcgctttgtcttaaaagggaataaaattcttaaattgaaagcaaatcggagagggttctatggcgctctctgcgaggggccgagcgtggattcgggtctgatgattactttgactgcagaaacagtgggggctgtaatctccgaagcagcggacactcacagcgacggttggcccagtcctttgatttagacagcccttggctgtcttgcctggcctagaatccctattccattgaagtctggcctcaggctgtcttcttgggcagtgccatttgcatccaggcatggggagggcctctgtgtcctcagggtgccgtgtgtttgtggtgagagaggatgaacaggcagcagacaggggctcccgggcagttgctgggctgctgct

SEQ ID NO: 198777 - DNA, 1703 bp, Homo sapiens
ggcgaggttactcatcctgggctcaggtaagagggcccgagctcggaggcggcacacccaggggggacgccaagggagcaggacggagccatggaccccgccaggaaagcaggtgcccaggccatgatctggactgcaggctggctgctgctgctgctgcttcgcggaggagcgcaggccctggagtgctacagctgcgtgcagaaagcagatgacggatgctccccgaacaagatgaagacagtgaagtgcgcgccgggcgtggacgtctgcaccgaggccgtgggggcggtggagaccatccacggacaattctcgctggcagtgcggggttgcggttcgggactccccggcaagaatgaccgcggcctggatcttcacgggcttctggcgttcatccagctgcagcaatgcgctcaggatcgctgcaacgccaagctcaacctcacctcgcgggcgctcgacccggcaggtaatgagagtgcatacccgcccaacggcgtggagtgctacagctgtgtgggcctgagccgggaggcgtgccagggtacatcgccgccggtcgtgagctgctacaacgccagcgatcatgtctacaagggctgcttcgacggcaacgtcaccttgacggcagctaatgtgactgtgtccttgcctgtccggggctgtgtccaggatgaattctgcactcgggatggagtaacaggcccagggttcacgctcagtggctcctgttgccaggggtcccgctgtaactctgacctccgcaacaagacctacttctcccctcgaatcccaccccttgtccggctgccccctccagagcccacgactgtggcctcaaccacatctgtcaccacttctacctcggccccagtgagacccacatccaccaccaaacccatgccagcgccaaccagtcagactccgagacagggagtagaacacgaggcctcccgggatgaggagcccaggttgactggaggcgccgctggccaccaggaccgcagcaattcagggcagtatcctgcaaaaggggggccccagcagccccataataaaggctgtgtggctcccacagctggattggcagcccttctgttggccgtggctgctggtgtcctactgtgagcttctccacctggaaatttccctctcacctacttctctggccctgggtacccctcttctcatcacttcctgttcccaccactggactgggctggcccagcccctgtttttccaacattccccagtatccccagcttctgctgcgctggtttgcggctttgggaaataaaataccgttgtatatattctggcaggggtgttctagctttttgaggacagctcctgtatccttctcatccttgtctctccgcttgtcctcttgtgatgttaggacagagtgagagaagtcagctgtcacggggaaggtgagagagaggatgctaagcttcctactcactttctcctagccagcctggactttggagcgtggggtgggtgggacaatggctccccactctaagcactgcctcccctactccccgcatctttggggaatcggttccccatatgtcttccttactagactgtgagctcctcgagggcagggaccgtgccttatgtctgtgtgtgatcagtttctggcacataaatgcctcaataaagatttaattactttgtatagtgaaaaaaaa

SEQ ID NO: 198778 - DNA, 444 bp, Homo sapiens
gctggtgtgaatgagttgatgcaggtgctgtgtccctgtcttgcctcccaggtgtggtacagagaggacgtcagccactccaaccccgaagggtcctcctggtccctgctggacacccccggggaggtggttcagatcagctgtgggccccacgacctcctgtgggccacactctgggagggacaggccctggtccgggaaggaatcaacaggagcaatcccaaaggaagttcctggtccatcgtggagcctcctggatctgaaaacggggtcatgcacatctcggtgggagtcagcgtggtctgggctgtcaccaaggactggaaggtaagatggggatgaggctgggggatcacttgagcccaggagttggagactgcagtgagctgtgatcacaccactggactccagcctgggtgacagagcgagaccctgtctcaaatt

SEQ ID NO: 198779 - DNA, 5319 bp, Homo sapiens
cgcagtgctgctggggcattgcctgtgacaaccaggtctacgtgtatgtgtgtgccagcgatgtccccatccgccgccgagaggaggcctatgagaatcagcgctggaatcccatgggcggcttctgtgagaagctcctgctgagtgaccgctgggggtggagtgacgtgagtgggctccagcaccggccgctggacagggtggcactgccctcgccgcactgggagtgggagtctgactggtacgtggatgagaattttggaggtgaacccactgagaaaggggggtggacgtacgccatcgactttcccgccacctacacgaaagacaagaagtggaattcttgtgtgcggcgccggaagtggatccggtacaggagatacaagtcccgggacatctgggccaagatcccctcgaaggatgaccccaaggagctgcccgaccccttcaacgacctctctgtagggggctgggagatcacggaggagcctgtgggccgcctgtcagtgtgggctgtgtctctgcagggcaaggtgtggtacagagaggacgtcagccactccaaccccgaagggtcctcctggtccctgctggacacccccggggaggtggttcagatcagctgtgggccccacgacctcctgtgggccacactctgggagggacaggccctggtccgggaaggaatcaacaggagcaatcccaaaggaagttcctggtccatcgtggagcctcctggatctgaaaacggggtcatgcacatctcggtgggagtcagcgtggtctgggctgtcaccaaggactggaaggtgtggttccgaagaggcgtcaactctcacaatccctgcggcaccagttggattgagatggttggtgagatgacgatggtgaacgtgggaatgaacgaccaggtgtggggcattggctgtgaggaccgagccgtgtacttccggcagggtgtcacccccagcgagctcagtgggaagacctggaaagccatcatcgcggcccgagagtgtgaccggtcacactctggcagctcgtctagtctcctcagtgccggctgcttcttcggtgatgaggtgaggggtagtggcgagtctgcccccagcgacaccgatgcctcctcggaagtcgagagaccagggcctggccagattctccctgcagaacctctagacgattccaagaatgccacagggaactcagcctcaggcctgggggctggcaggaccgcagaagataccgtggaagatgcctgcccagccgagggcagcagggaggccagacccaacacgcaccccggcccggcccccaccccggccgagctgccctggaccaatattgacctcaaggaggccaagaaagtgcccagccactcggccgctggcttccccgagaccaccagcctctcctctctggggctcctcccactgggcttggaggagccgtatggggtggatgaccacccgctgtgggcctgggtgtcgggaggcggctgcgtggtggaggcatgtgccatgcccagatggttcactgtccaggcgggcctgtcctcctcggtacacatgctgtccctgtccatcacgccggcccagaccgctgcctggaggaagcagatcttccagcagctcacggaaaggaccaagcgggagctggagaacttcagacactacgagcaggccgtggagcagtcggtgtgggtgaagaccggggcgctgcagtggtggtgcgactggaagccccacaagtgggtggacgtgcgcttggccctggagcagttcacggggcacgacggcgtccgggacagcatcctcttcatctactatgtggtccacgaggagaagaagtacatccacatattcctgaatgaggtggtggcgctggtcccagtgctgaacgagaccaagcactcctttgccctgtacacccctgagcggacacggcagaggtggccggtgcgtctggctgctgccaccgagcaggacatgaatgactggctcgccctgctcagcctgtcttgctgcgagagccggaaggtgcagggccgcccgtccccgcaggccatctggtccatcacctgcaagggggacatcttcgtgagcgagcccagcccagacctggaggcccacgagcaccccctgccctgcgaccagatgttttggcggcagatgggaggccacctgcggatggtggaggccaacagccggggcgtggtgtggggcatcggctatgaccacacggcctgggtatacacaggcggctatggaggcggctgcttccaaggcctggccagcagcaccagtaacatctacacgcagtcagacgtgaagtgtgttcacatctatgagaaccagcgctggaaccccgtcacaggctacaccagcaggggtctgcccacggaccggtacatgtggagcgatgcctcggggctgcaggagtgcacgaaggctggcacgaagcccccgtccctgcagtgggcctgggtttccgactggttcgtggatttcagcgttccggggggcacggaccaggaggggtggcagtatgccagcgacttccctgcctcataccatgggtccaaaacgatgaaggattttgtgaggaggaggtgctgggccagaaaatgcaagctggtgaccagtgggccctggctggaggtgccccccatcgccctcagggacgtgtccatcatcccggagagcccgggtgccgaggggagtgggcacagcatcgccctctgggccgtcagcgacaagggggatgtgctgtgccgcctgggcgtgtcggagctcaaccctgcgggctcctcctggctgcacgttggcaccgaccagcccttcgcctccatctccatcggggcctgctaccaggtgtgggccgtggcaagggacggctccgccttctaccggggatccgtgtacccctcgcagccagccggtgactgctggtaccacatcccgtccccaccgagacagaggctgaagcaggtgtccgcggggcagacgtcggtgtatgccctggatgagaatggaaacctgtggtatcgccaagggatcacgcccagctacccgcagggctccagctgggagcacgtgtccaacaacgtgtgccgagtgtccgtggggcccctggaccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcccctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggtgggcagatcacctaggtcaagagtttcaaaccagacgggccaacatggtgaaaccccatctctactaaaaatacaaaaaaaaaaattagctgggcatggtggtgggtgcctgtaatcccagctactcgggaggctgaggcaggagaatcgtttgaacccgggaggcggaggctgcagtgagccgagatcatgccactgcactccagcctgggcgacagagactccatctcaaaaaaaaaaaaaaaaaaaagtgaaggaaggagacagcagattggaaataacactggagtggatgggatgtcctcttccctgagggggccggggtaccagacgggaggctgggagaggatgagaggctgccccatggctggaggcagcgtccgtgtgtgcagtcaccatcatcaacccccattcggccccttccccagatgcgctggtgacaggggcttcttggatgtcaaatcatgttgtaggagggtgcagactgcgggcttctgtggggagcagtactactgtgtctgtcggcagtggccatgggaccctcagcccgtcctgtacatggagcagggtgcacagtcaccctccatcctgtggcgagaggctggcccggcccggccaggcgaggcagaaggtgtcggccaagtggccccgaccccatcccgcaatctctcagctgctttttattacctttgtgccccatttgggagtttgcttcctccacctggacactttgcccgggaggtcatcagagcccaaccccaggctctgctcggttggagaggggatgacttcaccaccacctgaccttcctagggtcctggtctcactgtcagctgggggtccgttgtgtgtatttgtacagttttgctgtatggggtttgtcacccaaaagctgatgctgagaaaggcctccctggggcccctcccgcgggcatctgagagacctggtgttccagtgtttctggaaatgggtcccagtgccgccggctgtgaagctctcagatcaatcacgggaagggcctggcggtggtggccacctggaaccaccctgtcctgtctgtttacatttcactatcaggttttctctgggcattacgatttgttcccctacaacagtgacctgtgcattctgctgtggcctgctgtgtctgcaggtggctctcagcgaggtacggggagggcgtcaccctgcagaacggcagagtgacgcgtcctctcgctgctgagcaccagctgtttacctgccctgcatcacttcctcggatactttactcaataagcatttcccctggagtgtccgtgccctggtgttttttatcgatacgttgattaaaacgcgtggttccccgtgtgcctgaagcagaca

SEQ ID NO: 198780 - DNA, 5606 bp, Homo sapiens
cgcagtgctgctggggcattgcctgtgacaaccaggtctacgtgtatgtgtgtgccagcgatgtccccatccgccgccgagaggaggcctatgagaatcagcgctggaatcccatgggcggcttctgtgagaagctcctgctgagtgaccgctgggggtggagtgacgtgagtgggctccagcaccggccgctggacagggtggcactgccctcgccgcactgggagtgggagtctgactggtacgtggatgagaattttggaggtgaacccactgagaaaggggggtggacgtacgccatcgactttcccgccacctacacgaaagacaagaagtggaattcttgtgtgcggcgccggaagtggatccggtacaggagatacaagtcccgggacatctgggccaagatcccctcgaaggatgaccccaaggagctgcccgaccccttcaacgacctctctgtagggggctgggagatcacggaggagcctgtgggccgcctgtcagtgtgggctgtgtctctgcagggcaaggtgtggtacagagaggacgtcagccactccaaccccgaagggtcctcctggtccctgctggacacccccggggaggtggttcagatcagctgtgggccccacgacctcctgtgggccacactctgggagggacaggccctggtccgggaaggaatcaacaggagcaatcccaaaggaagttcctggtccatcgtggagcctcctggatctgaaaacggggtcatgcacatctcggtgggagtcagcgtggtctgggctgtcaccaaggactggaaggtgtggttccgaagaggcgtcaactctcacaatccctgcggcaccagttggattgagatggttggtgagatgacgatggtgaacgtgggaatgaacgaccaggtgtggggcattggctgtgaggaccgagccgtgtacttccggcagggtgtcacccccagcgagctcagtgggaagacctggaaagccatcatcgcggcccgagagtgtgaccggtcacactctggcagctcgtctagtctcctcagtgccggctgcttcttcggtgatgaggtgaggggtagtggcgagtctgcccccagcgacaccgatgcctcctcggaagtcgagagaccagggcctggccagattctccctgcagaacctctagacgattccaagaatgccacagggaactcagcctcaggcctgggggctggcaggaccgcagaagataccgtggaagatgcctgcccagccgagggcagcagggaggccagacccaacacgcaccccggcccggcccccaccccggccgagctgccctggaccaatattgacctcaaggaggccaagaaagtgcccagccactcggccgctggcttccccgagaccaccagcctctcctctctggggctcctcccactgggcttggaggagccgtatggggtggatgaccacccgctgtgggcctgggtgtcgggaggcggctgcgtggtggaggcatgtgccatgcccagatggttcactgtccaggcgggcctgtcctcctcggtacacatgctgtccctgtccatcacgccggcccagaccgctgcctggaggaagcagatcttccagcagctcacggaaaggaccaagcgggagctggagaacttcagacactacgagcaggccgtggagcagtcggtgtgggtgaagaccggggcgctgcagtggtggtgcgactggaagccccacaagtgggtggacgtgcgcttggccctggagcagttcacggggcacgacggcgtccgggacagcatcctcttcatctactatgtggtccacgaggagaagaagtacatccacatattcctgaatgaggtggtggcgctggtcccagtgctgaacgagaccaagcactcctttgccctgtacacccctgagcggacacggcagaggtggccggtgcgtctggctgctgccaccgagcaggacatgaatgactggctcgccctgctcagcctgtcttgctgcgagagccggaaggtgcagggccgcccgtccccgcaggccatctggtccatcacctgcaagggggacatcttcgtgagcgagcccagcccagacctggaggcccacgagcaccccctgccctgcgaccagatgttttggcggcagatgggaggccacctgcggatggtggaggccaacagccggggcgtggtgtggggcatcggctatgaccacacggcctgggtatacacaggcggctatggaggcggctgcttccaaggcctggccagcagcaccagtaacatctacacgcagtcagacgtgaagtgtgttcacatctatgagaaccagcgctggaaccccgtcacaggctacaccagcaggggtctgcccacggaccggtacatgtggagcgatgcctcggggctgcaggagtgcacgaaggctggcacgaagcccccgtccctgcagtgggcctgggtttccgactggttcgtggatttcagcgttccggggggcacggaccaggaggggtggcagtatgccagcgacttccctgcctcataccatgggtccaaaacgatgaaggattttgtgaggaggaggtgctgggccagaaaatgcaagctggtgaccagtgggccctggctggaggtgccccccatcgccctcagggacgtgtccatcatcccggagagcccgggtgccgaggggagtgggcacagcatcgccctctgggccgtcagcgacaagggggatgtgctgtgccgcctgggcgtgtcggagctcaaccctgcgggctcctcctggctgcacgttggcaccgaccagcccttcgcctccatctccatcggggcctgctaccaggtgtgggccgtggcaagggacggctccgccttctaccggggatccgtgtacccctcgcagccagccggtgactgctggtaccacatcccgtccccaccgagacagaggctgaagcaggtgtccgcggggcagacgtcggtgtatgccctggatgagaatggaaacctgtggtatcgccaagggatcacgcccagctacccgcagggctccagctgggagcacgtgtccaacaacgtgtgccgagtgtccgtggggcccctggaccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcccctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggtgggcagatcacctaggtcaagagtttcaaaccagacgggccaacatggtgaaaccccatctctactaaaaatacaaaaaaaaaaattagctgggcatggtggtgggtgcctgtaatcccagctactcgggaggctgaggcaggagaatcgtttgaacccgggaggcggaggctgcagtgagccgagatcatgccactgcactccagcctgggcgacagagactccatctcaaaaaaaaaaaaaaaaaaaagtgaaggaaggagacagcagattggaaataacactggagtggatgggatgtcctcttccctgagggggccggggtaccagacgggaggctgggagaggatgagaggctgccccatggctggaggcagcgtccgtgtgtgcagtcaccatcatcaacccccattcggccccttccccagatgcgctggtgacaggggcttcttggatgtcaaatcatgttgtaggagggtgcagactgcgggcttctgtggggagcagtactactgtgtctgtcggcagtggccatgggaccctcagcccgtcctgtacatggagcagggtgcacagtcaccctccatcctgtggcgagaggctggcccggcccggccaggcgaggcagaaggtgtcggccaagtggccccgaccccatcccgcaatctctcagctgctttttattacctttgtgccccatttgggagtttgcttcctccacctggacactttgcccgggaggtcatcagagcccaaccccaggctctgctcggttggagaggggatgacttcaccaccacctgaccttcctagggtcctggtctcactgtcagctgggggtccgttgtgtgtatttgtacagttttgctgtatggggtttgtcacccaaaagctgatgctgagaaaggcctccctggggcccctcccgcgggcatctgagagacctggtgttccagtgtttctggaaatgggtcccagtgccgccggctgtgaagctctcagatcaatcacgggaagggcctggcggtggtggccacctggaaccaccctgtcctgtctgtttacatttcactatcaggttttctctgggcattacgatttgttcccctacaacagtgacctgtgcattctgctgtggcctgctgtgtctgcaggtggctctcagcgaggtacggggagggcgtcaccctgcagaacggcagagtgacgcgtcctctcgctgctgagcaccagctgtttacctgccctgcatcacttcctcggatactttactcaataagcatttcccctggagtgtccgtgccctggtgttttttatcgatacgttgattaaaacgcgtggttccccgtgtgcctgaagcagacaaaaaaaaaaaaaaaaacaaaacaaaaaaaaaaaccggggggaataaagtgggggggcgaggaaaacaaggggaaacaaaaggggcccaggggaaacagaaggacaccgagaccgagatttgttggacaacagagggggaaaaaatcaggccggggaacccacataaagaggaggcgcgcaaaaataaattgcgaaagcgcacgggtcaccgcggggataatagaggctgcacaaaaaggaaagagaacaagagggacgaagagaacaaaaaagacacgggggagaaa

SEQ ID NO: 198781 - DNA, 4936 bp, Homo sapiens
gctgtaccgggcgaagtgtatgatatcccctcgaaggatgaccccaaggagctgcccgaccccttcaacgacctctctgtagggggctgggagatcacggaggagcctgtgggccgcctgtcagtgtgggctgtgtctctgcagggcaaggtgtggtacagagaggacgtcagccactccaaccccgaagggtcctcctggtccctgctggacacccccggggaggtggttcagatcagctgtgggccccacgacctcctgtgggccacactctgggagggacaggccctggtccgggaaggaatcaacaggagcaatcccaaaggaagttcctggtccatcgtggagcctcctggatctgaaaacggggtcatgcacatctcggtgggagtcagcgtggtctgggctgtcaccaaggactggaaggtgtggttccgaagaggcgtcaactctcacaatccctgcggcaccagttggattgagatggttggtgagatgacgatggtgaacgtgggaatgaacgaccaggtgtggggcattggctgtgaggaccgagccgtgtacttccggcagggtgtcacccccagcgagctcagtgggaagacctggaaagccatcatcgcggcccgagagtgtgaccggtcacactctggcagctcgtctagtctcctcagtgccggctgcttcttcggtgatgaggtgaggggtagtggcgagtctgcccccagcgacaccgatgcctcctcggaagtcgagagaccagggcctggccagattctccctgcagaacctctagacgattccaagaatgccacagggaactcagcctcaggcctgggggctggcaggaccgcagaagataccgtggaagatgcctgcccagccgagggcagcagggaggccagacccaacacgcaccccggcccggcccccaccccggccgagctgccctggaccaatattgacctcaaggaggccaagaaagtgcccagccactcggccgctggcttccccgagaccaccagcctctcctctctggggctcctcccactgggcttggaggagccgtatggggtggatgaccacccgctgtgggcctgggtgtcgggaggcggctgcgtggtggaggcatgtgccatgcccagatggttcactgtccaggcgggcctgtcctcctcggtacacatgctgtccctgtccatcacgccggcccagaccgctgcctggaggaagcagatcttccagcagctcacggaaaggaccaagcgggagctggagaacttcagacactacgagcaggccgtggagcagtcggtgtgggtgaagaccggggcgctgcagtggtggtgcgactggaagccccacaagtgggtggacgtgcgcttggccctggagcagttcacggggcacgacggcgtccgggacagcatcctcttcatctactatgtggtccacgaggagaagaagtacatccacatattcctgaatgaggtggtggcgctggtcccagtgctgaacgagaccaagcactcctttgccctgtacacccctgagcggacacggcagaggtggccggtgcgtctggctgctgccaccgagcaggacatgaatgactggctcgccctgctcagcctgtcttgctgcgagagccggaaggtgcagggccgcccgtccccgcaggccatctggtccatcacctgcaagggggacatcttcgtgagcgagcccagcccagacctggaggcccacgagcaccccctgccctgcgaccagatgttttggcggcagatgggaggccacctgcggatggtggaggccaacagccggggcgtggtgtggggcatcggctatgaccacacggcctgggtatacacaggcggctatggaggcggctgcttccaaggcctggccagcagcaccagtaacatctacacgcagtcagacgtgaagtgtgttcacatctatgagaaccagcgctggaaccccgtcacaggctacaccagcaggggtctgcccacggaccggtacatgtggagcgatgcctcggggctgcaggagtgcacgaaggctggcacgaagcccccgtccctgcagtgggcctgggtttccgactggttcgtggatttcagcgttccggggggcacggaccaggaggggtggcagtatgccagcgacttccctgcctcataccatgggtccaaaacgatgaaggattttgtgaggaggaggtgctgggccagaaaatgcaagctggtgaccagtgggccctggctggaggtgccccccatcgccctcagggacgtgtccatcatcccggagagcccgggtgccgaggggagtgggcacagcatcgccctctgggccgtcagcgacaagggggatgtgctgtgccgcctgggcgtgtcggagctcaaccctgcgggctcctcctggctgcacgttggcaccgaccagcccttcgcctccatctccatcggggcctgctaccaggtgtgggccgtggcaagggacggctccgccttctaccggggatccgtgtacccctcgcagccagccggtgactgctggtaccacatcccgtccccaccgagacagaggctgaagcaggtgtccgcggggcagacgtcggtgtatgccctggatgagaatggaaacctgtggtatcgccaagggatcacgcccagctacccgcagggctccagctgggagcacgtgtccaacaacgtgtgccgagtgtccgtggggcccctggaccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcccctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggtgggcagatcacctaggtcaagagtttcaaaccagacgggccaacatggtgaaaccccatctctactaaaaatacaaaaaaaaaaattagctgggcatggtggtgggtgcctgtaatcccagctactcgggaggctgaggcaggagaatcgtttgaacccgggaggcggaggctgcagtgagccgagatcatgccactgcactccagcctgggcgacagagactccatctcaaaaaaaaaaaaaaaaaaaagtgaaggaaggagacagcagattggaaataacactggagtggatgggatgtcctcttccctgagggggccggggtaccagacgggaggctgggagaggatgagaggctgccccatggctggaggcagcgtccgtgtgtgcagtcaccatcatcaacccccattcggccccttccccagatgcgctggtgacaggggcttcttggatgtcaaatcatgttgtaggagggtgcagactgcgggcttctgtggggagcagtactactgtgtctgtcggcagtggccatgggaccctcagcccgtcctgtacatggagcagggtgcacagtcaccctccatcctgtggcgagaggctggcccggcccggccaggcgaggcagaaggtgtcggccaagtggccccgaccccatcccgcaatctctcagctgctttttattacctttgtgccccatttgggagtttgcttcctccacctggacactttgcccgggaggtcatcagagcccaaccccaggctctgctcggttggagaggggatgacttcaccaccacctgaccttcctagggtcctggtctcactgtcagctgggggtccgttgtgtgtatttgtacagttttgctgtatggggtttgtcacccaaaagctgatgctgagaaaggcctccctggggcccctcccgcgggcatctgagagacctggtgttccagtgtttctggaaatgggtcccagtgccgccggctgtgaagctctcagatcaatcacgggaagggcctggcggtggtggccacctggaaccaccctgtcctgtctgtttacatttcactatcaggttttctctgggcattacgatttgttcccctacaacagtgacctgtgcattctgctgtggcctgctgtgtctgcaggtggctctcagcgaggtacggggagggcgtcaccctgcagaacggcagagtgacgcgtcctctcgctgctgagcaccagctgtttacctgccctgcatcacttcctcggatactttactcaataagcatttcccctggagtgtccgtgccctggtgttttttatcgatacgttgattaaaacgcgtggttccccgtgtgcctgaagcagaca

SEQ ID NO: 198782 - DNA, 5384 bp, Homo sapiens
  misc_feature (1469)..(1469): n is a, c, g, or t
gctgtaccgggcgaagtgtatgatatcccctcgaaggatgaccccaaggagctgcccgaccccttcaacgacctctctgtagggggctgggagatcacggaggagcctgtgggccgcctgtcagtgtgggctgtgtctctgcagggcaaggtgtggtacagagaggacgtcagccactccaaccccgaagggtcctcctggtccctgctggacacccccggggaggtggttcagatcagctgtgggccccacgacctcctgtgggccacactctgggagggacaggccctggtccgggaaggaatcaacaggagcaatcccaaaggaagttcctggtccatcgtggagcctcctggatctgaaaacggggtcatgcacatctcggtgggagtcagcgtggtctgggctgtcaccaaggactggaaggtgtggttccgaagaggcgtcaactctcacaatccctgcggcaccagttggattgagatggttggtgagatgacgatggtgaacgtgggaatgaacgaccaggtgtggggcattggctgtgaggaccgagccgtgtacttccggcagggtgtcacccccagcgagctcagtgggaagacctggaaagccatcatcgcggcccgagagtgtgaccggtcacactctggcagctcgtctagtctcctcagtgccggctgcttcttcggtgatgaggtgaggggtagtggcgagtctgcccccagcgacaccgatgcctcctcggaagtcgagagaccagggcctggccagattctccctgcagaacctctagacgattccaagaatgccacagggaactcagcctcaggcctgggggctggcaggaccgcagaagataccgtggaagatgcctgcccagccgagggcagcagggaggccagacccaacacgcaccccggcccggcccccaccccggccgagctgccctggaccaatattgacctcaaggaggccaagaaagtgcccagccactcggccgctggcttccccgagaccaccagcctctcctctctggggctcctcccactgggcttggaggagccgtatggggtggatgaccacccgctgtgggcctgggtgtcgggaggcggctgcgtggtggaggcatgtgccatgcccagatggttcactgtccaggcgggtaagggctcctgcagggcctgggggcatccacatggccaggtgccctgggggtgtggggtgtgggaggaggccggggtcagggggctcgggcaggcctgctgtcctccctggacgcctcactgtgctcagcagctctgagccaggcattgcgctcctctgtggcctccagagaccagcccgaggctgtcaggacctggaagcacggtggccagtgccccttcccctgtctgcagcccctcccctgtgctagcggtggtggctgctttccaggctgaattactgggggagagcaactcatccancagggcaaagggtggaaggaggcttaacagagagcgtagcttttgagctagaaagggctgatttggtggaggggagcgccgtggcttcctgcccagctgcgggcaggacagtgccccggccctgaggctctctctgccccacaggcctgtcctcctcggtacacatgctgtccctgtccatcacgccggcccagaccgctgcctggaggaagcagatcttccagcagctcacggaaaggaccaagcgggagctggagaacttcagacactacgagcaggccgtggagcagtcggtgtgggtgaagaccggggcgctgcagtggtggtgcgactggaagccccacaagtgggtggacgtgcgcttggccctggagcagttcacggggcacgacggcgtccgggacagcatcctcttcatctactatgtggtccacgaggagaagaagtacatccacatattcctgaatgaggtggtggcgctggtcccagtgctgaacgagaccaagcactcctttgccctgtacacccctgagcggacacggcagaggtggccggtgcgtctggctgctgccaccgagcaggacatgaatgactggctcgccctgctcagcctgtcttgctgcgagagccggaaggtgcagggccgcccgtccccgcaggccatctggtccatcacctgcaagggggacatcttcgtgagcgagcccagcccagacctggaggcccacgagcaccccctgccctgcgaccagatgttttggcggcagatgggaggccacctgcggatggtggaggccaacagccggggcgtggtgtggggcatcggctatgaccacacggcctgggtatacacaggcggctatggaggcggctgcttccaaggcctggccagcagcaccagtaacatctacacgcagtcagacgtgaagtgtgttcacatctatgagaaccagcgctggaaccccgtcacaggctacaccagcaggggtctgcccacggaccggtacatgtggagcgatgcctcggggctgcaggagtgcacgaaggctggcacgaagcccccgtccctgcagtgggcctgggtttccgactggttcgtggatttcagcgttccggggggcacggaccaggaggggtggcagtatgccagcgacttccctgcctcataccatgggtccaaaacgatgaaggattttgtgaggaggaggtgctgggccagaaaatgcaagctggtgaccagtgggccctggctggaggtgccccccatcgccctcagggacgtgtccatcatcccggagagcccgggtgccgaggggagtgggcacagcatcgccctctgggccgtcagcgacaagggggatgtgctgtgccgcctgggcgtgtcggagctcaaccctgcgggctcctcctggctgcacgttggcaccgaccagcccttcgcctccatctccatcggggcctgctaccaggtgtgggccgtggcaagggacggctccgccttctaccggggatccgtgtacccctcgcagccagccggtgactgctggtaccacatcccgtccccaccgagacagaggctgaagcaggtgtccgcggggcagacgtcggtgtatgccctggatgagaatggaaacctgtggtatcgccaagggatcacgcccagctacccgcagggctccagctgggagcacgtgtccaacaacgtgtgccgagtgtccgtggggcccctggaccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcccctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggtgggcagatcacctaggtcaagagtttcaaaccagacgggccaacatggtgaaaccccatctctactaaaaatacaaaaaaaaaaattagctgggcatggtggtgggtgcctgtaatcccagctactcgggaggctgaggcaggagaatcgtttgaacccgggaggcggaggctgcagtgagccgagatcatgccactgcactccagcctgggcgacagagactccatctcaaaaaaaaaaaaaaaaaaaagtgaaggaaggagacagcagattggaaataacactggagtggatgggatgtcctcttccctgagggggccggggtaccagacgggaggctgggagaggatgagaggctgccccatggctggaggcagcgtccgtgtgtgcagtcaccatcatcaacccccattcggccccttccccagatgcgctggtgacaggggcttcttggatgtcaaatcatgttgtaggagggtgcagactgcgggcttctgtggggagcagtactactgtgtctgtcggcagtggccatgggaccctcagcccgtcctgtacatggagcagggtgcacagtcaccctccatcctgtggcgagaggctggcccggcccggccaggcgaggcagaaggtgtcggccaagtggccccgaccccatcccgcaatctctcagctgctttttattacctttgtgccccatttgggagtttgcttcctccacctggacactttgcccgggaggtcatcagagcccaaccccaggctctgctcggttggagaggggatgacttcaccaccacctgaccttcctagggtcctggtctcactgtcagctgggggtccgttgtgtgtatttgtacagttttgctgtatggggtttgtcacccaaaagctgatgctgagaaaggcctccctggggcccctcccgcgggcatctgagagacctggtgttccagtgtttctggaaatgggtcccagtgccgccggctgtgaagctctcagatcaatcacgggaagggcctggcggtggtggccacctggaaccaccctgtcctgtctgtttacatttcactatcaggttttctctgggcattacgatttgttcccctacaacagtgacctgtgcattctgctgtggcctgctgtgtctgcaggtggctctcagcgaggtacggggagggcgtcaccctgcagaacggcagagtgacgcgtcctctcgctgctgagcaccagctgtttacctgccctgcatcacttcctcggatactttactcaataagcatttcccctggagtgtccgtgccctggtgttttttatcgatacgttgattaaaacgcgtggttccccgtgtgcctgaagcagaca

SEQ ID NO: 198783 - DNA, 4304 bp, Homo sapiens
  misc_feature (1469)..(1469): n is a, c, g, or t
gctgtaccgggcgaagtgtatgatatcccctcgaaggatgaccccaaggagctgcccgaccccttcaacgacctctctgtagggggctgggagatcacggaggagcctgtgggccgcctgtcagtgtgggctgtgtctctgcagggcaaggtgtggtacagagaggacgtcagccactccaaccccgaagggtcctcctggtccctgctggacacccccggggaggtggttcagatcagctgtgggccccacgacctcctgtgggccacactctgggagggacaggccctggtccgggaaggaatcaacaggagcaatcccaaaggaagttcctggtccatcgtggagcctcctggatctgaaaacggggtcatgcacatctcggtgggagtcagcgtggtctgggctgtcaccaaggactggaaggtgtggttccgaagaggcgtcaactctcacaatccctgcggcaccagttggattgagatggttggtgagatgacgatggtgaacgtgggaatgaacgaccaggtgtggggcattggctgtgaggaccgagccgtgtacttccggcagggtgtcacccccagcgagctcagtgggaagacctggaaagccatcatcgcggcccgagagtgtgaccggtcacactctggcagctcgtctagtctcctcagtgccggctgcttcttcggtgatgaggtgaggggtagtggcgagtctgcccccagcgacaccgatgcctcctcggaagtcgagagaccagggcctggccagattctccctgcagaacctctagacgattccaagaatgccacagggaactcagcctcaggcctgggggctggcaggaccgcagaagataccgtggaagatgcctgcccagccgagggcagcagggaggccagacccaacacgcaccccggcccggcccccaccccggccgagctgccctggaccaatattgacctcaaggaggccaagaaagtgcccagccactcggccgctggcttccccgagaccaccagcctctcctctctggggctcctcccactgggcttggaggagccgtatggggtggatgaccacccgctgtgggcctgggtgtcgggaggcggctgcgtggtggaggcatgtgccatgcccagatggttcactgtccaggcgggtaagggctcctgcagggcctgggggcatccacatggccaggtgccctgggggtgtggggtgtgggaggaggccggggtcagggggctcgggcaggcctgctgtcctccctggacgcctcactgtgctcagcagctctgagccaggcattgcgctcctctgtggcctccagagaccagcccgaggctgtcaggacctggaagcacggtggccagtgccccttcccctgtctgcagcccctcccctgtgctagcggtggtggctgctttccaggctgaattactgggggagagcaactcatccancagggcaaagggtggaaggaggcttaacagagagcgtagcttttgagctagaaagggctgatttggtggaggggagcgccgtggcttcctgcccagctgcgggcaggacagtgccccggccctgaggctctctctgccccacaggcctgtcctcctcggtacacatgctgtccctgtccatcacgccggcccagaccgctgcctggaggaagcagatcttccagcagctcacggaaaggaccaagcgggagctggagaacttcagacactacgagcaggccgtggagcagtcggtgtgggtgaagaccggggcgctgcagtggtggtgcgactggaagccccacaagtgggtggacgtgcgcttggccctggagcagttcacggggcacgacggcgtccgggacagcatcctcttcatctactatgtggtccacgaggagaagaagtacatccacatattcctgaatgaggtggtggcgctggtcccagtgctgaacgagaccaagcactcctttgccctgtacacccctgagcggacacggcagaggtggccggtgcgtctggctgctgccaccgagcaggacatgaatgactggctcgccctgctcagcctgtcttgctgcgagagccggaaggtgcagggccgcccgtccccgcaggccatctggtccatcacctgcaagggggacatcttcgtgagcgagcccagcccagacctggaggcccacgagcaccccctgccctgcgaccagatgttttggcggcagatgggaggccacctgcggatggtggaggccaacagccggggcgtggtgtggggcatcggctatgaccacacggcctgggtatacacaggcggctatggaggcggctgcttccaaggcctggccagcagcaccagtaacatctacacgcagtcagacgtgaagtgtgttcacatctatgagaaccagcgctggaaccccgtcacaggctacaccagcaggggtctgcccacggaccggtacatgtggagcgatgcctcggggctgcaggagtgcacgaaggctggcacgaagcccccgtccctgcagtgggcctgggtttccgactggttcgtggatttcagcgttccggggggcacggaccaggaggggtggcagtatgccagcgacttccctgcctcataccatgggtccaaaacgatgaaggattttgtgaggaggaggtgctgggccagaaaatgcaagctggtgaccagtgggccctggctggaggtgccccccatcgccctcagggacgtgtccatcatcccggagagcccgggtgccgaggggagtgggcacagcatcgccctctgggccgtcagcgacaagggggatgtgctgtgccgcctgggcgtgtcggagctcaaccctgcgggctcctcctggctgcacgttggcaccgaccagcccttcgcctccatctccatcggggcctgctaccaggtgtgggccgtggcaagggacggctccgccttctaccggggatccgtgtacccctcgcagccagccggtgactgctggtaccacatcccgtccccaccgagacagaggctgaagcaggtgtccgcggggcagacgtcggtgtatgccctggatgagaatggaaacctgtggtatcgccaagggatcacgcccagctacccgcagggctccagctgggagcacgtgtccaacaacgtgtgccgagtgtccgtggggcccctggaccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcccctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggttttctctgggcattacgatttgttcccctacaacagtgacctgtgcattctgctgtggcctgctgtgtctgcaggtggctctcagcgaggtacggggagggcgtcaccctgcagaacggcagagtgacgcgtcctctcgctgctgagcaccagctgtttacctgccctgcatcacttcctcggatactttactcaataagcatttcccctggagtgtccgtgccctggtgttttttatcgatacgttgattaaaacgcgtggttccccgtgtgcctgaagcagaca

SEQ ID NO: 198784 - DNA, 2207 bp, Homo sapiens
tgagggcttcatggggtctgtgctccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcccctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggtgggcagatcacctaggtcaagagtttcaaaccagacgggccaacatggtgaaaccccatctctactaaaaatacaaaaaaaaaaattagctgggcatggtggtgggtgcctgtaatcccagctactcgggaggctgaggcaggagaatcgtttgaacccgggaggcggaggctgcagtgagccgagatcatgccactgcactccagcctgggcgacagagactccatctcaaaaaaaaaaaaaaaaaaaagtgaaggaaggagacagcagattggaaataacactggagtggatgggatgtcctcttccctgagggggccggggtaccagacgggaggctgggagaggatgagaggctgccccatggctggaggcagcgtccgtgtgtgcagtcaccatcatcaacccccattcggccccttccccagatgcgctggtgacaggggcttcttggatgtcaaatcatgttgtaggagggtgcagactgcgggcttctgtggggagcagtactactgtgtctgtcggcagtggccatgggaccctcagcccgtcctgtacatggagcagggtgcacagtcaccctccatcctgtggcgagaggctggcccggcccggccaggcgaggcagaaggtgtcggccaagtggccccgaccccatcccgcaatctctcagctgctttttattacctttgtgccccatttgggagtttgcttcctccacctggacactttgcccgggaggtcatcagagcccaaccccaggctctgctcggttggagaggggatgacttcaccaccacctgaccttcctagggtcctggtctcactgtcagctgggggtccgttgtgtgtatttgtacagttttgctgtatggggtttgtcacccaaaagctgatgctgagaaaggcctccctggggcccctcccgcgggcatctgagagacctggtgttccagtgtttctggaaatgggtcccagtgccgccggctgtgaagctctcagatcaatcacgggaagggcctggcggtggtggccacctggaaccaccctgtcctgtctgtttacatttcactatcaggttttctctgggcattacgatttgttcccctacaacagtgacctgtgcattctgctgtggcctgctgtgtctgcaggtggctctcagcgaggtacggggagggcgtcaccctgcagaacggcagagtgacgcgtcctctcgctgctgagcaccagctgtttacctgccctgcatcacttcctcggatactttactcaataagcatttcccctggagtgtccgtgccctggtgttttttatcgatacgttgattaaaacgcgtggttccccgtgtgcctgaagcagaca

SEQ ID NO: 198785 - DNA, 531 bp, Homo sapiens
ttaagttgtatttaagcagtttgggtgccaaagacatttatatctggcatgagtgaatgaggaggtcaaaaaattctctctccccaaattttcaaaaacagcaaaggcttaaaacaaattgagaagcatttattcatgaaaaccactgtacttggggtaagaacagcaggagttttgtcgtgttgcctgggcctgttcctatttctcccagccctgacagtgcagtagttcaaccagggtggggctggcggtgaaaaccagtagctttatgactgctgcaggagggagctttcttgatttggaatgttgtcagttaaatttgatgatctttgtggcaagtgaaacagggccagcaaatctgctactctgaggttgcagttctgtttaggataaacagtgggccagtagactagccagggctttaacaaggaggtctggtaggtgagacagtttcaaggggcttgataagctctccgaatatcctgggttggagtatttatgcacatcagacacctgtgtgagcccagacta

SEQ ID NO: 198786 - DNA, 343 bp, Homo sapiens
gcaggggaaaggccgttccctgagctgctggttggctctaagaagacagctgctgcatgtttcaatcagagactagcttatacataaaattacagattgacttcaccatactgcacttttatgaataagctcatttctgactggctacaggacttttaagaactatattattcaacaggtagtcgtcacctgttcagccaaagctgagtttttaaaaatctcagactcacaagacagcgtgcaccagtccctcccatactcacccactactttacaccggttttgttttgatggggggagggtgctgacgttctatacagcacagcattgacagcacatccca

SEQ ID NO: 198787 - DNA, 100 bp, Homo sapiens
cacactgtactgttttaataccttgactatggctttattccctctccatgtggccaaggtcaatatttataattgtttgctgcctcccatttgagctgct

SEQ ID NO: 198788 - DNA, 721 bp, Homo sapiens
gatttctctattctggatatttcatacaagttgactcatactataggtgacctcttgtgtctggcttttttcatttcacgtaaggtttgcaaggttcgtccactttatagcatggatcagtatttcattccttctcatgggtgaataatgttgtacagcatggatataccaccatttgtttatccattcatctgcagatgggcatttaggctgtctgttcccactttttggctattgtgaatagtcagttgctgcctgttcctcctccctaaaaccctgtgaatgaggacagttgttcatccccattccccagaagacaacattgaggttcatttgtgatacagatggtgacttgaactgaagcccctgccgcccaaatgaaagtgcccttcttacatccttgtctcccaccagccattcacccatcccaagtgtcatgccttccctgggcatctgttaccacattctgggctctgtgccaactgctggccacctggtgtggacagctcaggccaagtcccagactctactatagtctgaagctgcagaggcctggaggctgcagtctcaccctctgggatgggctcctgtccagccaaggagtcccaggatccagggccaggggccaggcataccacatccaagatgcgtatagacaggagtgccctgctcctgccctccctggatcccagtattcctcaatgcacagaggaagatggcc

SEQ ID NO: 198789 - DNA, 328 bp, Homo sapiens
aagaaaaattagaaacttagaagtgtgcctctgagggcaaggaggggctgggaaccttaatatcagctggacatctgttgagggtcaggctacaatgggattagcaagccttgggaagctctgatggcattggagaatgggagcagagtcaatctctgctcccaaacatctcatttacattgctaataatgagccaatcactcttgatcagatttttaaaaataaatgacagctacagaatatataaaagtacacaggaaaatttacaccatgcaatccagtaacatctaagcaagtggttaatgttactccactccaaaagtgttgc

SEQ ID NO: 198790 - DNA, 1333 bp, Homo sapiens
catagctgactcttgaggatcaactgtcgctactgtatcctaggctctgtaaccatgtcaagaacaagctagtactcctgacttggattctgacagtctctctgccttattcatcttctgacagctcagtggtttggaagaagcagtctctgatttttaggtttgaagggaaggttgttttcagattctctgcctcagttgtcagcatttctgcccaaagattcttatcatttcttgagagtcacacacaagagcaagagcacaatctgtgaggtcacgtagtctttccttgcatgttttgtctttgggcaagttgcttaagccattggaacctcagcctctgcatcagtaagaatgagagtaataccacccactttggatcatgattatacaagattccaatgtgatgactagcacagtaaaaataataaaacttcttcctaattgtgcattctgcagccatctcttaggatgtaggttattggcttagtatgggataaatagtcacacggaagggagaatttgggctattgctttgtgaggatctagttaagggggtcaagaaatcctcatttatggttactctctgcttcgagtggctctctggccagggaaactgaattcttaatattgtgattagctttgatctgccatgtttacatattttgacttttgcctttttttttagacagagtctctctctgtcacccatgctggagtgcagtggcacgatctcagctcactgaaacctccacctcccaagttcaagtgattctcttgcctcagcctccagagtagctaggactacaggcacacaccaccatgcccaactactttttttgggatttttagtagagacgggatttcgctgtgttggctaggctggttgcgaactcctgacctcaaatgattcacctgactcggcctccaaaagtgctgggattacaggcatgaaccactgcgcctggcctcttttgcctgtgttttggtgaccacttggtagagaatgcttccggattctgagggtgggcagctttgcttgtgatgttaggataatagtgaagaagattcctttaaactagtcatgaaatcacgttatttggattccattcacattgggacatcgaatctgcttccttccccctgctacttaatttcacatacatgactttatttaatcctttcaggtagagaatattaggtccattcaacaggtgaggagatggagccttatagagtttatgtaactcatctcaccgtgtcctctgagtcaagtcaaaggttttttctagagcagttagctttccagcaaaaacaaaacaaaacaaaacaa

SEQ ID NO: 198791 - DNA, 759 bp, Homo sapiens
ggatgaagaaaaaggagaggtggaaagcagaaagtagggaagaggaataagagaccaaagagactaagaagtcagactttgaaagagtgaaagctggaggaataaggatccccccaaccccaccaaaattatgatttgtagcaagagcaaggatatgcattaaaaacaaagaaaaaatcagaatgacagttttttgtacccatggacctatatgctactggcaacctgagtttgagcaattcctcattgattgattgattcattcattcattcagaaccaggtggaattcacctgcagtatcctaggctctgtaaccatgtcaagaacaagctagtactcctgacttggattctgacagtctctctgccttattcatcttctgacagctcagtggtttggaagaagcagtctctgatttttaggtttgaagggaaggttgttttcagattctctgcctcagttgtcagcatttctgcccaaagattcttatcatttcttgagagtcacacacaagagcaagagcacaatctgtgaggtcacgtagtctttccttgcatgttttgtctttgggcaagttgcttaagccattggaacctcagcctctgcatcagtaagaatgagagtaataccacccactttggatcatgattatacaagattccaatgtgatgactagcacagtaaaaataataaaacttcttcctaattgtgcattctgcagccatctcttaggatgtaggttattggcttagtatggg

SEQ ID NO: 198792 - DNA, 421 bp, Homo sapiens
gtgacactcctgggatttgggggatgggaggagcatgctgttatgcccaaatcctgctccgtttgtttacttttttcctaattgtctctgaaagaaagagcaggcccaatcttttgggacactatgtagtgagaactggtatgacacatcgtaagtgcacagagagttcaattcagtaactgagacaaagtctagagccgaaccacttgggtctgaacgttagcttcactattaacaagatttgtagccttgcaaaagttcatccttgtatacctcagtttccttacctgtaaaaggagataacagtacctattttatcaaaatgtcaggagaaattaagtattatgtgtaaagcctataaaacaacatcttgcatgtagttagaacctaataaatattagtatattccatgaatggtagc

SEQ ID NO: 198793 - DNA, 438 bp, Homo sapiens
acattcttatactaaaaaactctctgctgttcatctgaaattcaggcagaactggatgcgctgcgttttatctggcaacaccatgggagagccaggggggctgggctgagttctctaaccccgtgaggaccagcacgccgggaggctccgcagagagaatgaaagcaaagccgaagacgcaatctgaaatcctggcttccccaggaaaagccagtgccaggagtagctactaacgaggagaaaagaaaatcatcacagtcaaagcaagttcaacaaaaacagcattttgctgctaacttgctccaagaaaacctaaaatcttcaactggctcattcgtcctccagtacctctgatgaaaaggtagacagacttttccactaattatttcagccactgtgaaaatatgaaagctgacctgggagagaagatacataata

SEQ ID NO: 198794 - DNA, 418 bp, Homo sapiens
tgatagagttttttgttgtgttgtgccagtcagctccaaaaagtaggtcaaggtgccagtttctccctgcaggggactgaaattggtggcctgaattgcctcccagtgctgtatatcccgtgagtaattctactgcaaacttctgcttttctccagttgcctttggaagttccagaggcaaaactgtgtccctttagcacaggtacctgggttgctaagggggcagtgggctcagagtatgggtttgctttggggttataattttccccattataaaaggaagatatgtgtagaaaatttagaccagagaatagctctgaagttgagggtcaagaatcagagaccttgtctccgtgcctgtgtgttgggctttgacttggcaccacactgcttgttccctgcctaactcactgagtgc

SEQ ID NO: 198795 - DNA, 353 bp, Homo sapiens
agactttctggagcttgtgtgcaccattgtacacataaatgctgctgtggcaattagacacgctccactgtgagctggaatgtataaggttggattagcaagttactggcaaaccattcagtgtcataaccccgaattaaacatgctatcccatcaggtagaaagtagacacacgtccacgcccttatgctaaccaagatggttctgaacactttcaggtcatgatgaagtcacactcattccaaacgaaatcaactccagtccctaaccagagatgggttttctgcttaattaacgaagcaccattgtgggaggagagagagccacatgtgaagaaatcaaccacagggcta

SEQ ID NO: 198796 - DNA, 374 bp, Homo sapiens
actattggtgtcttaagatgtaaaatacaaaatgtttgcaagataaggtgcactgagtttgcatcaggaacaaggcattgagcttccttacaacacagtaaacactcaaaatttcaaagtcccctttcaagtgataaaaacttctcgtgagtacttaagttgtcagtaaatacaaaaacaaaaaaaagaaaaagaaaaaacccagagttctaaagacgagaatagctccaaagaaaaacatgaaagaaaaggtaaaaagcttttgaaaagactgcaaaataggaatctgcagagcatgctcaggcctttatgttctcaagctgttcttggcatctcctaccctagaggagttgctgacccaaactgtgatgctg

SEQ ID NO: 198797 - DNA, 111 bp, Homo sapiens
ccctttccaatcagcactaagtcccactcatttgacttccccggggttttctggctttgtcttctgctctccttctgttccatccctaccttagcccaggccctcatctct

SEQ ID NO: 198798 - DNA, 525 bp, Homo sapiens
atgtgattaggtggttagtgatacagctctgtgcaattcttgggtacattatacatcaggaataaatgtggatgccttagtggcgtagggtatagagttgtgtggtagtgatggcagaaggttgttaatatccttgtgggaaaagacttttgggtcctcctgttctcattttccccacaatggcgattgtgaaataggtaggtccatgtgtaaggatgaaggatgagtctttttcttgggttgtagacaaaatttggtttaccaatttgtgccgacagtctctgtttcttggagttcttgatgctttgtgtgcctgtagttcagtggtcccatctctctctggtttctaattccaggcttgctctccctttgtctgatcctgcatcttaaaccattaaactacattctgcagtttggatgtccttccagtttcttttctgtttcattacatgctacatacatgcatacatacatgaaaatatatacatcaatgtgcatatctattatacttacctatttttttct

SEQ ID NO: 198799 - DNA, 184 bp, Homo sapiens
ttacttaaagaggtttattcagggccaatgagtgaccacagccccaggaaaatacaaacccaaaaagccttaagtgttcccgaggcagtcagattatagtttggttttatacatttcagggagccaggggttacaggcaaagacataaatcaatgtgtggaaggtatacactggtttggctcca

SEQ ID NO: 198800 - DNA, 543 bp, Homo sapiens
tcttacgtggtggaagcaggccaagaaagctctccgggcttcctttataagggcactaatcccattcgtaagggctctaccctcatgaccttatcacctcccgaagaccccacctcctaataccattacattgggagttagcatttcaatatataaattttgggaggacacaaacattcagtccataacaggtgtcatgttcataatcccatgggaagtttttgaatgggtgggcataggtggatttcctagagcaaaattctgggagcaggaacttggaaaaggaaagtagaaagcaaaaagttattttcataacaaatataatagtgtcctggcttctctgaagggcctagttgaatgtttcacagaggcaaatattaaaaacattcctttctgggggtttggaaatattttgatgtaggatttgatttcctgtcatagtcctgtaaattgtatttgttttcctgtgcttaatttagtgcttagcttagtttccttttgaaaaaatgttggattttagtgtaaatagagtatatatttaaa

SEQ ID NO: 198801 - DNA, 428 bp, Homo sapiens
taattgagagaaagagaaggtgttctcccaggtgagagtcgggggtcagagggcagtaggaaaaaaaaatgcatagaaaacaaggagttctgggttccaagatgcaacccccatgaccaggagatgctcttcagatctgcctttgctgggaaagaggcgggaggtggcctggggtccaggtggcatcttttcaaacccttctcattatttaagggcaaactcacatcaagaaccaagaggagagtggctccaagtgacaaaagaattacacttagaggaacatagcaagcggcttctcacaccaggctgcaggctggggagggggaaaatgggagcagaatgacagaatccagggctggccagaatgaaagactgaatggaataggctaatttacacaggaagtaagcacttaccagacccttcatct

SEQ ID NO: 198802 - DNA, 479 bp, Homo sapiens
tctctacagaaatcttccctgcttctccgctttctcttccattcctaatgtcaaaataatcatcatcatcttcttcatcattatcatcattatcaccaatactatttattgagtacttattatgggccaagcatggaattaagtactttacctgcattatctcctttcacaagaaactcaagagttagttgagaaagaaagggagacattctactccagccgcctcagctgacatgagaaacccacatggctgcagagagtgcaggctgggttggggagcggaaccaggccttgaaggaaacactgcgtctactttctttcttctttagcagctttaattaccaagctcttatggaagctgagggaattggcattaactctgtttcaatttgtacttttgcaaatgagatgtagttacatgacaatgattcacttctgtgaggtgtcaaaaataaactgctaggatggaaaagtgccca

SEQ ID NO: 198803 - DNA, 409 bp, Homo sapiens
ttataggcttgcgccaccacgcctggctaattttgtatttttagtagtggtagggtttcactgcgttggtcaggctggtctcaaactcctgacctcaggtgatccacctgccttggcctcccaaagtgctggtgagccaccacgcctggccgcctttggattttctgttgatctttctatgtgtcaaattaatactgcctcggttggtgttgactcacacctggaattccagcactccgggaggctgaggcagaaggattgctgagcccaagagtttgagaccagcctgggcaacatagctacaatcctatctctataaaataataatactgcctcatttggtagaacacagagagagaaaatactgacattgctttctcttgctattacttatgattacttttttttt

SEQ ID NO: 198804 - DNA, 416 bp, Homo sapiens
aagcttgattgccagggactcagaataatcggaatagggagtgactgctgaaatatgtggggtttcttttttcgggtgatgaaactattctgaaattagaggatgatggtgtacaattctgtggatatacggaaaatactaaatgatgcactttaaagggttaagtttatggtatttcaatttcatctccaaaaaaattaaatgtactgggtgcagtggctcatgcctataatccccaaactttgggaggtcaagggggaagaatcacttgagcccaagagtttgagaccagcctgggcaacatagctacaatcctatctctataaaataataatactgcctcatttggtagaacacagagagagaaaatactgacattgctttctcttgctattacttatgattacttttttttt

SEQ ID NO: 198805 - DNA, 173 bp, Homo sapiens
tgtgtgtgtgtgtgtgtgtgtggtgtgtccaggtacctaaaggaataacctaccttgatttgaattaatattccatgtctttatttaaagcaatcacctatttcttacaacacaggaccatgaattcctagcctataggattgaacaaaagcttacttaaaacccaactagta

SEQ ID NO: 198806 - DNA, 587 bp, Homo sapiens
gttaatgcagtgcatacatttagtttttatttttcaagtcctgaatagagaactcttcatagaaagggcaggtagtaggtagggaattgccatgacgtcttctggagggttgtcaggaaatgggctctgtcaccaacagtggcccgcagcctcacttgcctgtttcttagagaacagactttgactttggtgcacttcttctttttcctctcatctgtcttctcctgcttcccctcacctcagtgtgattcagctctaattgaggttgttaagaaaccgctttgttcagagggttagtaggggagaggagagatctgcctctgtattcctgacatcaaataactttccaaggtgctcctgcagcacattgtatccctttgatacacacattaaaacaacacaataataaagcgctttatcataaagaccaaataagcgataaatcattaatcgcaggagtagtattccctactttagaatatatatgtgtatatattctatatatacatatacatgtgtgtatgtattctatatatacatatacgtgtgtatgtattctatatatacatatacatgtgtatgtattc

SEQ ID NO: 198807 - DNA, 117 bp, Homo sapiens
acaaatatattcctgaaatagggatagaagccagaataatcattttaaagcctaaatcagatcatgttcctcctctgctttaaaacattacagtggtttcccacctcacacagggta

SEQ ID NO: 198808 - DNA, 962 bp, Homo sapiens
tcttgatgtagagaggttatcctgggtgacctgggatatccaatcacaagtatccttataagagacaggcaggagatcatcttcacagagcacatgtaagacagaggcacagattggagtgatgtggccacaagccaaggaatgccagagaatgccagcagccaccacaagctagaagaggcaaggaacagattccacaaacagattctacccctgagccttcaaggggaacgtggccctgcagagagcatgagggagtaagtttatgttgttttaagccacagagtttgtgataatttgtcctagcagccctaagaaattaatacaggctgtaaattttctgagaggtggggtgatgtgttccctgttcctgtcttctgcacagtatgcatgtttctgcacagaacaggcactcaaatacccgagtgcttgaactgacttgacttcttcactggttcagaaattcagagcctaaagatttggatataaaattttattggaagaacagtgagaccagtaagatctgagcattcatttgcaaaagaagaaattaatgcccctgaggttagtcccttagagtttattgcctcttgaagctgagatttataccacgttttaatgtagcaatttttttttttgccttgctggaatattaataataccatgaagaaaacttcatctaggccgggcgtggtggctcacacctgtaatcccagcactttgggaggccgaggcgggcagatcacgaggtcaggagatcgagaccatcctggctaacacggtgaaaccccgtctctactaaaaatacaaaaaattagccaggcgtggtggcgggcgcctgtagtcccagctacttgggaggctgaggcaggagaatggcgtgaacccgggaagcggagcttgcagtgagccgagatagcaccactgcactccaacctgggcgacagagcgagactccgtct

SEQ ID NO: 198809 - DNA, 450 bp, Homo sapiens
ctaaattatcagcttgagaaatatcctaaaaattaaacacatctcttttttttcctcttgctttctgacccatttttgttttgcagtgattccaaaatgctacccaaattagagggcttctcacgagtcaaactcatttttaaatatggtttacatctaacaggtacacctttcatgagacttcaggcttatcattttaaaagtagagaggtggccagcatgaactgccaagtttttaagagcaggatggcccaagaattctcagacccttcatttgccagacagggtctggaacctcactgctcactgagcctcaggacccagcagaatctgagctaccaggggctgactctggggatctccagcctgatgctggccttgcgttgtgctgtagctcagcttactgtgggcacacgccacctagtcaaccaatccaaagacataataagc

SEQ ID NO: 198810 - DNA, 352 bp, Homo sapiens
actttctatttctccctcccctcagcccctaggtaaccaccaatttcctttaggtctctatagatttacttgttgatgacatttcatataaatggagtcatacaatgtgtggtcttttatgacttgcttctttcacttagttttttttgttttgttttgtttgtttgttttttgagatggagtttcactcttgttgcccaggctggagtgcagtggtgcgatttcggctcactgaacctccgcctcccaggttcaagcgattctcctgcctcagcctcccaagtagctgggattacaggcatgtgccatcatgcccggctaattttgtgtttttagtagagagggttttgcc

SEQ ID NO: 198811 - DNA, 436 bp, Homo sapiens
caggtaaggtaaggaataagtatctgaagaattgcaaaaagtatggtacacagaaagaaagacgtgtttaggaagataaaactaacactacccagaaccatctggccatgatgatataggagaagggagttaagaatggcactgattgagatttctaatctgagtaatgatgacaagtaaaattttatgtcaactaagaactagattattctcgaagcttgcttatacacatgtacacacacaaatatatgcaaattgccctatgtttctgtttaataacaccattgtctcatacatccctctctaagtagctgactgtgcacaccatttacacaatgagagaattagatgttaacaaatggcagggatgacactgtgagctaacactgtaattctaaaatgcccaacacaaacaaactagaccaccatttcagta

SEQ ID NO: 198812 - DNA, 663 bp, Homo sapiens
aatttatttcatacattattttacaataatggatgcacttgtcaaaatccactagcggaatgagaaaaagatgcataatctttaaggaaataggtagacatggtaattcagcattttggaggagcaaacctttattattatgcatagatacagatattactttaaggttactttaagggagaacattctagaatgtttttctttaaaataatatgttcaccaattgcgtacgtgaaaatgcagaggaaaatttaagcataataagccttagtattgcgtgatgtctgagtggcccatgttttttcacacttaagttctcttaggctttggtttgattttttgagtgtggtagaagtcagtgatggcagcgtgtctgtataacaagaagagaagctttctcttctgatgttagtgatactaccctaacaaacagtatggattaataggatacatctgcagacttttgaaaatatttggcatatactcactcattctgaaacgcaggaagtaaagaaatattacgttgcctgtatctcaaagaacaaacagagctaattaaataattggcaaatagggaacacatagcctgacacatgtttgagattacacacgattctgtagaaaatgactgtaagcaatactaatgccttaagaatggggttc

SEQ ID NO: 198813 - DNA, 776 bp, Homo sapiens
gcacagaatggggaggggcaggctgtaggtagcactggaaaaggtaacctttggttggttaaaaagcattattcagaaagaaccagtgggaaagagtgggcaaacaggaatagaagttctcactccaggctgcaggtttcaggctgtttttggcttgaaggtggggtttcaccagggacccacccctgtctatctgggcatttgactgcttcctgttgctttcataaggaactacccaagatggtaatttataaagaaaagaggtttaagtggctcacagttccacaggctataaggaagcatggctggggaggcctcaggaaacttacagtcatgacagaaggggaggcaggcatgtcccacatggtggagcaggaggaagagctcacctacagcaaattatttaagaccgagcatttgtctctgttctgttccctctctggacgcaccctcctgcctccaccctgacttgccgtctcctgagcactgaagatatttttggcttgtccgatgtgactccacagacagcagaaacgcttgcttgatcagggcagcatcagggcaccacacatgcctgggcttgcacaacacagcgggagcactgccactcagcagcagctgctgctttcattaaacagttaccttgagaagaaaagataggtgtcgagggctgagagctgtgctagagtttcagggtccgagttggcaggaactgaagtcccgatgctcctcagcccttggctgtcctcagggctgccctctgcgtggggacacca

SEQ ID NO: 198814 - DNA, 357 bp, Homo sapiens
  misc_feature (101)..(101): n is a, c, g, or t
gccttcccagtttctctctgctcctttgggaggctctaatacttagaatgggaagcatccgtgtggctgactggtctctctgaattcctcccagaacttcnttgcctcctctgaccacttcccacccttatgcttctcccagaagccatgcagagctcctgactttgggctctgggcatctgtagctggcctgtgatggcctggccctcatctccccatcgggctaagatgcatccctcttggaaccaagaggaaagtgtggaagccattttactgtgtgttttaccacccttgcaagtggaaatttattagaggctggtcgacgcggccgcgaatttagtagtagtaggcggccgc

SEQ ID NO: 198815 - DNA, 358 bp, Homo sapiens
tgaagtgtttccagtcactgttcttataggctttgttctccaaattgtgtttttagtgtataatgggatttgaattattttttctcatgtgtgaatttactatgttcaggtcattaacttttcagtggaagatttcctagtcatcatattcataaagtttctctccagcatgaattttctgatatgtaatgaggtatgacttgtaaagaaaaccctacccacattcagtacaaacagaaaattactcttcctcatgaattatctgatgcatacgtaaatgtttgagtgtatgttttcgtatattttctgaatacacagtatgattcactttttaaaaattaatttaaaatgcattctt

SEQ ID NO: 198816 - DNA, 139 bp, Homo sapiens
ctttgcttctgctccctcaaccccgatagatgtcttccctaccccatttgaactccaacaccccatgccaggctgcctatctacggaaatgccctctttagtcagtcttctactttcccaccgtaggcaacccttctac

SEQ ID NO: 198817 - DNA, 544 bp, Homo sapiens
ctctatgtgctatcttacttaattctcacaaaccaccacgaggggtaggatgtatactatcatctctacttttgaaatgagaaaactgaggcttcagtggtgaagacaaatgtgtctcttctagggaaccacactaccttattctcccaccccggcccgggggtgtgtaatgagggactcctatcgaagtcagctgtaagtctatcttgcctattcattatacaggctgtcgtcttcgcgcagtaaggataatatgtgttttgattcaaagaccatccagcttgcacactgtgatgaacagagatcaggagctcatgaaggcaagggcaagtcttatttacctttatctccccgaacctagaagcgaggtcaaacagaagcgctcggggtagcaagaaggctttgtagatattgaaatgtgaatgcatgcccagcccttaccaggtgcgtgaccttaggaaatgcacttgtcctttctgtgccttaattttttcaccaacctgctaatgtatgttcctcagtgaaaatttaaaaaaaaaagtta

SEQ ID NO: 198818 - DNA, 270 bp, Homo sapiens
acacatggttctacgatcaccatggtaagatataagttagaatcacatataggccacgaaactcctgtgcccatgatgcacataacacattttacatttttaatgggtcacttttacttccaaagaaactagaagcccatgattaagacttaaaatatgaacaaacatcctccacaatgcctattttaaaaataattaagtaggataaggggattgggaaagtgtgccagaggtaaaagctacagccaaggaaaacaaggaaaaagtgag

SEQ ID NO: 198819 - DNA, 130 bp, Homo sapiens
cgtgcccatgtgcctggattaccagcttcgcacagagccagacgctgcagcagtaacggggcgccgggcccacctgctgcccctctcctgtgcatagggcgctctctccctgccccgagcttcggcttct

SEQ ID NO: 198820 - DNA, 400 bp, Homo sapiens
aacaacttagggaggtaacaggtggggaggaatgtgcttttgacttcatttcaaagagaaaaaaatcttcgggtaaactctccacaaagcattagtgtcactttctgtttctgatcattggttctaaatgcttattaaaaatgcgttgatttccgattattattatggacacatgtggcttaaactttggtaaaaggctgagctaaggtggatggtgtaagaaagtccatctttgtggggacgcagacgttttcatacagtcagttacgatgcctcttctccccatcctccttgtgcatgtgaaggctgcttttgccatgctaagggtcgaacgtgctctcaggcatgacatgatcctggaaggctcagtcccacacgtcaaaagataaagagctttgta

SEQ ID NO: 198821 - DNA, 226 bp, Homo sapiens
gacatgccttgggcagcagggtagacagtagttatattaaaagttaaataatataataagcataacaactaacagctattcagctatttgccgttgtgctaggaactgtgttaagcacttcatatgcatgataaaatttaatcctcacaccaactctagaaggtaagtactatttttttctcttttacagatgaggaaactgagatttagaagggttatataatat

SEQ ID NO: 198822 - DNA, 408 bp, Homo sapiens
gtaatcacatgtctttatagagtcagagggacatctgactacagatgagaaggcattttacagacaaaggctgactgaagtcatcacgtgctttgaaaatggaaggggccatgataacctgaaataagcaagaaaacagattctcccttcacagcctccagaaggtaccagtcccgccaccaccttgattttagccatatgactaattgcagactcctgatttccagaacgctaagataataaatgtgtggtttatgctactacatttgtgataatttgttacattcagaaacaggaaaccaatacatgggggatatgttatttaccacgaggttgaaaagattccttgaatgagatgtcattagaaggaaggtaagagaagagggtggtgtggcgccacaggaacca

SEQ ID NO: 198823 - DNA, 351 bp, Homo sapiens
agggtcgcgtatctgtaggggtccttctttcccctttttctggccctgcagctcccgcctgcccccaccctagccctcctgtgcaatcctcagaaggcgcctgtctccctgattggagtgagtgagtgagagtgagtgtgtgtgtgtgtgttcaggtattctggtgttcaggggatggggctgggggcgaagttcagtttatgatttgagatgggacagggaagaggtgaggaggacactgggggcacagaggagatacccccagcgagaatgacccctgcttcccagtcagcgtggaggtcctcaccccactagagattcacaaaacagaaggtccatggacttctcccc

SEQ ID NO: 198824 - DNA, 467 bp, Homo sapiens
tgaattatgattattttaatgtgttccaaagggcctaactacattctgagtgatgaatcacaagacactggctgagttattttggttgaattagaggctttggtattgagtaatgtagactaagtggattattggcttggttctatatagcttgtattgtaatgcattttgaccttgtttttgaggtcattttcttcagtgtgtccaaatgtgttagtatataaagagctgtctagaggagcacatgaagaagcttgattgtttattgacatgagcatgacattagacttgtgactatagaactagatagaatcatgagaggtatgtagaatacaattggatgtcattttgatagttattagagttagggccctgccacacaagataataatacaaaaaaagaacacagaacaattaatgcaggttaaaaaacatatgaaggacttgaggcattaaatatcatgatt

SEQ ID NO: 198825 - DNA, 260 bp, Homo sapiens
caatgaaatgaaatatcacataggttgtgaaagtgctcttggcacagtcatatattgtctttgtcttttaaaaaaatgttacatagaagatatcttactatctgtaacttactttctgttttactcaacaatatattttcagagcttatctgtgttgctaaatgtagatcttgttttcaaattttagctggtgtatagtgtttcattgtatgaatatgatacaacttatttatccagtccctattaatgtatatttattt

SEQ ID NO: 198826 - DNA, 922 bp, Homo sapiens
actggaaactttttatctattcaaggaagaattaatttttgatgtttactggctatatattttgcactctccaccttgccaccaccacatatttatactgtgaccaacctagctgaaatgaacttatattttaaatgagtcattttgcagagcaagtaataaatcagctatcaggagtaaggagctctcagcaggccatactgctccattgccaggagggattattttagtagtatcacactaggatttctgaatttatgcccttaatttatgagacattcattgcaggggctttcccaagtgttattttcataaacagcagattaatataggggctttttcttgcatttctttggaaaaatcttgcccccatgtagaatattcaagctctgctacctataaataagctaatgtctttcctctgggctgttgtcccttagccttcaacatcttctagtctgaagcaaaaatcatgcttcattttgttttgctatctttctaatacagtaagagcttcaggtcaaagaactgaagagaatgtgagagcttgaccctctgttatgtttttcgttatttgtagattttccttatgcacttgcccttctgtggaatctttcctcttcattcccttatccctattaggattctaccaatttattgttctaaccttgaagaaacagctttttatttaccttcagctgtaggtggcccaccaggtgtcaacaactgtagagttccatcaagagtcatcattttacagttacaagtcggaggggccttcacagatccgtcaggctcaacactgcctccttagtgagcctgtgaaccacccaagacggctggtcatcagtgtcatcctcttccttttccggacaactatctttaaaagaaaaaaaaagagtgtctttgaatgtatccattt

SEQ ID NO: 198827 - DNA, 1040 bp, Homo sapiens
ctctccaggcaaggcacactgacctggaactccagaacagccatgaaacacccatttgacctcttcaactggcagcagctctgcatttctctgggatgaagctcccagatgcaatagacatatctgctgtttttgctgctattgcagctccagccactacccaactgccttcaaggtcaggagggagtgaagagtgttatgactgttgtgggcctccagcacagggcaagctgccttctggaaaagcagtcatatagtttttaatgttggtcatggccccttctactcctcactggtcagggcctcctggcttgagcctccagcacagccacctacctcagcctgacaacttgggccagaagcagcattgcatttccctgggacagagctctcataggtataagacaggcctgccgtttttgcctgctatagcccctgcccataatgccctcagatcaagagatagcaaagaggcttaaggattatagcaggtcttcagctcagcacatctgccttatggaggtgttgtcagacttttttccatgtctgtctttgctcctgctacttctcactgggtagggcctcccgacctcggccccagcacagctaccctgctcccacttgaacacttcagacagtggcacctgtgcatttctctgggatagaattcccagtgacaacccacagcccctctgccattacatacagtggtaccacccttgctgcctgatatggtttggctctgtgtccccattcaaatctcatcctgtagatcccacaattcccatgttttgtgggaggtacctggtgggaaatgactgaataatggagatgggtatttcccatgctgttctcgtcatagtggatgggtctcatgagatctaatgattttaaaaacaggagtttcctgacacaagctctctcttagcctgctgccatccatgtaagatgtgacttgctcctacttacctttcaccatgattgtgaggccttcccagccacgtggaactgtaagttgattaaacctccttcttttgtaa

SEQ ID NO: 198828 - DNA, 1023 bp, Homo sapiens
aaattagccaggcatggtggctgatgcctgtaatcccagctacttgggaggctgaggcaggagaatcgcttgaacctggggggcggaggttgcagtgagccgagatcatgccattgcattccagcgacaaaagcaaaattccgtctcaaaaaaaaaatgtttctttcagtatctcctgttttgtaaacttgactttggaatgatgtaaatattttacataattatgaaaccaaagtaaaagatttgaggatgaagctggtgcatctaaatgagtatccagggggtagcataaccataccaataatagctttttatcaaaacagtaatttgtgcatcactagtggaatatacctcaaagaaaataagatagtaaaaatatgtattttcagtcatattattagtggtgatgttggtattagtattctgagaccgttgcatgtgtactgtgggttaaagcaaatgagcaataatctaatctgtcattagtagtgtagttcagaactgagattctctgcataggagaaaggagatgtaaaatagaagagaagtaaaaccctgtggtcctgagtttgcattgcaattatctgtatgaatgcactctgtattttactgtaaaagaaaacaaaacatatctcctttttatttatactgaagaggcctaaaaataatcaccaatcctatggcagcgagcatcctagcccttggacagtaattttgaattgacctttcccactaaaggagccacttcataaacattctctttactcatctttttaaaaaaaaaaaaaaaaacaaagacacacccacaccaacaaacaaagaaacagaagaaaaaaaaagaaaaacacaaaacagagacacgcaaacaaagcagcagctgaacagaaagcgcggagacgagcaaaacaaaaagaagacaagcacaacgcgggggagcgggccacaacaagagaacaacaaacagacgacagagagagcaaacgaagaccacgcaaacaaacacgcgggggctaaccaaaacag

SEQ ID NO: 198829 - DNA, 425 bp, Homo sapiens
cacgagggcccaggttagaacagcaagggcaggtagagaagtcaccaaaggacactgaccagatctgtcccatgcatgaatctgggttgtccctgtgtgagccccttgaaccaacagattgtggcagagtgacattgcaccagtctgagacctacaccttaaggatgcctggcagctcctgcttttgtgttcctcggagtcatgagccacgaagtcaagctaccctgctggagagaccagctgaagaagcctcttgaagaggacctgagacttaaggctcagccatcccagactgtgagttaaacctccagatgagtccaaccccacctgctatctgactacagctacatagacgacaaaccacctaagtgattccagtcaacccacacaactgtaaaagataataaaagttgtttaagtcacta

SEQ ID NO: 198830 - DNA, 343 bp, Homo sapiens
tcaatttttttataatttttcctcctcttaaaatattgtaagtcctcatttttaacaaactgaatatctgttattgactttgcattccatatatttgtcataatcattttttagatttttaatccaggttgacttcgtaactagcatttgggaccatatatattttcattcctgctcaaataactggcttaccacctaacccactactctattcagtcttcccttgaattttgtcattatggcaaaagaactgtgtgaagttattagcaattttggctacagtctctcttagaatgtttgttgtccttagggactcacagcaggcaaaaaaaaaaaaaatcac

SEQ ID NO: 198831 - DNA, 1171 bp, Homo sapiens
ctgccacataaatcctctgagggagatgatgacaattcactgctgattaatgccattctgcctttactgtaattagaaggaaataaccccagaatacaaggaatttagcaagataaggaacccctgctgctacctaaacatccatctaaacaaagatgtttggcttttgaagcaaagagtttggttcttaagactgtgttctttgacagttaattttcaagaagactgaagactgaattatcattgttgagaattctctaggtctcagtaaccctctgaaccagcagtttgggtggtcgatgcctagcaaataggagtgggtggccttttctctggtgtataagattcatctaatttttaggaatttttgtaccattttccccctctagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaagaatcagagataaaaaccaacccaaatcattcctctggcacattatttctaaataagtgttgtttgtggaaatcgtcctatttttatgcctcggttgagggggcaagtaaagtcctggtgaggaatatacagttagaaacttttggaaaaactgaagttcctggaggaaagccaaaccgtgctaacacactagaggctggttttggtcctgggaaaggtttggggtgaatgggttggaagtagggtatgaatacagttttgggatttaact

SEQ ID NO: 198832 - DNA, 1899 bp, Homo sapiens
gagtgctcgcagcagtctttcagttgagcttggggactgcagctgtggggagatttcagtgcattgcctcccctgggtgctcttcatcttggatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaagaatcagagataaaaaccaacccaaatcattcctctggcacattatttctaaataagtgttgtttgtggaaatcgtcctatttttatgcctcggttgagggggcaagtaaagtcctggtgaggaatatacagttagaaacttttggaaaaactgaagttcctggaggaaagccaaaccgtgctaacacactagaggctggttttggtcctgggaaaggtttggggtgaatgggttggaagtagggtatgaatacagttttgggatttaact

SEQ ID NO: 198833 - DNA, 1836 bp, Homo sapiens
gagtgctcgcagcagtctttcagttgagcttggggactgcagctgtggggagatttcagtgcattgcctcccctgggtgctcttcatcttggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaagaatcagagataaaaaccaacccaaatcattcctctggcacattatttctaaataagtgttgtttgtggaaatcgtcctatttttatgcctcggttgagggggcaagtaaagtcctggtgaggaatatacagttagaaacttttggaaaaactgaagttcctggaggaaagccaaaccgtgctaacacactagaggctggttttggtcctgggaaaggtttggggtgaatgggttggaagtagggtatgaatacagttttgggatttaact

SEQ ID NO: 198834 - DNA, 1567 bp, Homo sapiens
gaaatgtcatcaagaataaaagtatacttttgctttttttttattggaaaggtgcacaaaatgaaagtcctccttttcttatccctccattcagatggaaaaactgttcatggttttgtgatgtccttcacaagtacacacgcatgcacatgtgtgtgtacatgactttgtgttatttaatgctttctgataatacccttactgccttcacctagcagggccttggagtcctgagatcttccctcccccattttctctgctccccgctccactccagtcctcacaatatcatactttttgtctttcacttctaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaagaatcagagataaaaaccaacccaaatcattcctctggcacattatttctaaataagtgttgtttgtggaaatcgtcctatttttatgcctcggttgagggggcaagtaaagtcctggtgaggaatatacagttagaaacttttggaaaaactgaagttcctggaggaaagccaaaccgtgctaacacactagaggctggttttggtcctgggaaaggtttggggtgaatgggttggaagtagggtatgaatacagttttgggatttaact

SEQ ID NO: 198835 - DNA, 1929 bp, Homo sapiens
gagtgctcgcagcagtctttcagttgagcttggggactgcagctgtggggagatttcagtgcattgcctcccctgggtgctcttcatcttggatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggaggtgaacacacgcttcagcctaaaacactaaaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaagaatcagagataaaaaccaacccaaatcattcctctggcacattatttctaaataagtgttgtttgtggaaatcgtcctatttttatgcctcggttgagggggcaagtaaagtcctggtgaggaatatacagttagaaacttttggaaaaactgaagttcctggaggaaagccaaaccgtgctaacacactagaggctggttttggtcctgggaaaggtttggggtgaatgggttggaagtagggtatgaatacagttttgggatttaact

SEQ ID NO: 198836 - DNA, 869 bp, Homo sapiens
gagtgctcgcagcagtctttcagttgagcttggggactgcagctgtggggagatttcagtgcattgcctcccctgggtgctcttcatcttggatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggtaacaaggaggaaacatcactgtgttagagaaggctctggctgatggtatcaggacaaaggtagaatcaggcacatgaggaggtgttgcaagagcctgggctttggtgcttatcagaactggaccttctcctagcaatttcagctttctggtgggaaagataactccaatgaagaacaagaacaagaagatgatgatgatgcttaactttttggatgccgat

SEQ ID NO: 198837 - DNA, 179 bp, Homo sapiens
gctgctattggaaccacaggaccgatgcttacaggagacacatctgttagtatgacgcacaggataatgcttaggataaatcattcaatttgcataagagtgtgccaacttatttaatgtttgtaaattcacagtagccataacaattctgagtggtgagaaaaccacttatggaggag

SEQ ID NO: 198838 - DNA, 385 bp, Homo sapiens
ctaaaatcaccctaacttattcaacatcactgcgcggctgttcacttatcttcacattttaaaagataagcactccaagcaggtagaaaattccaatgatatttttgcaggaattaccaaacacaacctactcacccttatgcaaatgtgaaatcatgttagcccaagcgaatggaagttacaaactcattcattccataagcatttctggagaacctagtgtcccagattctgtacagaggctcccactgacctcatttccaccagccacttaactgttctcttctcaagatctcttctttcagtcacaaggaatcaaatagaacagccctgagctggctctactgaagggctcactaacaagtcaaatataggaaaggaaaga

SEQ ID NO: 198839 - DNA, 290 bp, Homo sapiens
ctcaagagtttggggtggagactgaaggaacagacaggagagaaagaagaaggatttgggacaagttcgcactgggagtagagactagggagggactgatgtgtagtaaagaatgcctggacgtcaggcacctcagacccatttgcccattttttcgacaaaaatcatccagataaaatggagaaatcaaaagtgttgttttctggctatttagaacaattattgagtttgtattggggccaagcggtgttgcagaagaaaataagacgcttaggttttaggtcaggcaa

SEQ ID NO: 198840 - DNA, 388 bp, Homo sapiens
tttgtccacacaaaaacttgcacatgaatatctatagagaagctttattcacaactgccaaaatctggaagcaaccaagatgtctttcagtaggtaaatggataaactgtggcaaaagcagcttcctgaaaaggaaaagtcgaattctgaaaaagagaaggaaaacaggcagcccatgtggcctggggccaaaaatggggaatgaatcccccatatggaagagtgtaagtgagtgtccttctggggtccactttccctgggaaactgtacaatccaggccattggagagcaccttgactctcctaatctcagaatcacatttaaggagcagccaggaaaccatgagaagaaactgctccagggtgtgtcctatgtgctctctcagacc

SEQ ID NO: 198841 - DNA, 284 bp, Homo sapiens
gggagtttgtctgctgggaacctgtaggaggatgtgggaacacacctcagggcacagctggcaggcagagcctgagaccccaggagtgacaatagctcccacaaataatgagaatatacagtttgtctttttgtgcctgacttatttcattgaacataatgacctatagttttgttcatgtgctgcaaatgactgtacctccttctcttttatggccaaatattactcccttgtgtatatgtactgtagtgaacagtgctgccataaacatgggaatgcggata

SEQ ID NO: 198842 - DNA, 781 bp, Homo sapiens
tgaaatgaaatgatgaaataatgaaacaaaattaaatatgaaatgaaataccaaagtgctgggattacaggcgtgaaccaccaggccgggccaagccagattctttaaagtggctctatcttctctgtaatttgctcccttgccactttgatgactccagattctactcctattcccattgtcttttaactcccacttcagggcctttattcttgctgttaccatttcctagaacaatccttccagatacctacctcaaatgctgcatcatctgtccatctttgttcagataccaccttttctttgaggccttctcttaaacactgtcgtacatacagttttgcacatacattttagttgcaggataaattgctaaaaattaagttatttgagaaaattatctgcatgcttaaaacgtgaatgactactgcccaatgacccttctagtacttgctaacgtttgccagtgtgagcatctaccatcactttttttttttttttgagacagagtttcactctcgttggccagactggagtacaatggcatgatcttggctcacagcaacctctgcctcctgagttcaagcgattctcctgcctcagcctccccagtagctggaattacaggcatgcaccacgatgcccggctaattttgtgtatttttagtagagacggggtttctccatgttggtcaggctgatctcgaactcccgacctcaggttgcagtgagcagagatcgcgccactgaattccagcctgggcgatagagcgagtctgtc

SEQ ID NO: 198843 - DNA, 692 bp, Homo sapiens
ccaggcgcgcggggacgcggaggccgcgcatcctttcccagctccccaccctccttgcctttgggtgcgcgacaaacaatcgctccgggctcagggctgcgcggctcttcccttcattccatgggcctttttttgggcacaataaagcgtttaaacctttaaaaaaagaaagcaacataatatgaacatctttgttaaaaaacgaaccttttctttgaggccttctcttaaacactgtcgtacatacagttttgcacatacattttagttgcaggataaattgctaaaaattaagttatttgagaaaattatctgcatgcttaaaacgtgaatgactactgcccaatgacccttctagtacttgctaacgtttgccagtgtgagcatctaccatcactttttttttttttttgagacagagtttcactctcgttggccagactggagtacaatggcatgatcttggctcacagcaacctctgcctcctgagttcaagcgattctcctgcctcagcctccccagtagctggaattacaggcatgcaccacgatgcccggctaattttgtgtatttttagtagagacggggtttctccatgttggtcaggctgatctcgaactcccgacctcaggttgcagtgagcagagatcgcgccactgaattccagcctgggcgatagagcgagtctgtc

SEQ ID NO: 198844 - DNA, 539 bp, Homo sapiens
ttcatctaattttcaattcaatgattttagtatgattcagtgattttagtaaacttgcttagtctgcaaccatcaccataatccagttttagaacatttccatctttccagtaagttccctcaggccagtcagcagtgaatccccattccctctctcagccctgggtaaatgaaactgacccagtggtctcatagatattttctgataaatataggaattgacccttctaatcttaaagcttgaaacttatatttgtttaatctgagttcctccctcagaaaatgaccatcaggtctctcaaaaaaaagtatcaaacaactgaaactcaccagatcatcacatccagacaatgagatgccagacccctcattcaccgtgatggcttccttgcgtctccctagttcctgttttcttacacacagttgcattttttttccctgttatataaactcctggttttagcaggtcagggaggtggatttgagagtgagtttccatctcctcagctgcagcacctgattaaagattcttccttggc

SEQ ID NO: 198845 - DNA, 151 bp, Homo sapiens
aacatctggctctccaccacttggcatgtccagatgcagaaacacaaagtgataatgtgcttatctgttaactaccagatgttgttccttcacattctcattcagtctgtttgagactcatgatacgttttttcttattacattagtctaa

SEQ ID NO: 198846 - DNA, 476 bp, Homo sapiens
aaaaaaaaatatatttctagagaagtcatttttgtgcctcagctttcttaactgtaaaatgaaaattttatactttttcttctactttgtaaggttattgtgagtatcaaatgaaatcaggatgtgaatatgctttgtttactgtaaggcattgctaccagcataattcacaaaggatattttttcttataattaaccaaaacataaacctcattgctcagagattctgaagtccacaagtgctcagaaggttgaaatgcttctttgccatggctctggcaatacagtaacagaatgaagcttttaatacacaaaacaaactaaccaacaaaacagataactgactgagtcttggggaaattactgagaatacttctagttgagtgttgtgtaaatgactaaatacttcaaggcaggagcatttaggaagaccaataaaaaccagagtatggtcattcggcgagtgcagggtagag

SEQ ID NO: 198847 - DNA, 291 bp, Homo sapiens
tacaagcagaccaagacaagaataagagcaacaaaacacatgttgcagaaaaggcacttccctgaagccctgccttggcctccaaacctccactatgagatgccgcagctggtatcttctcttccaagttgctgtcccctcaaatacatacacatgagcacttcagctacatctgctctgtggggaggggaagatagctctatgtgagatgtaaacacaaaggcaggcagcactattctattctcagtcctcttcctcttcaccaaccatttttgttcctagtggagtcat

SEQ ID NO: 198848 - DNA, 531 bp, Homo sapiens
ggtgtgctgtgtgccttgtgaccagtccagaaagaaaagcagaggtctctgaggagcaaggggcccctgccagcctgctcttttcaaagctcatctttcaattcctgacccttggctccagcccctcgagtgggtgcccactgctcttaggatgaaaaccagtgtcctgttcctgactgctggtgcctatgtggtctggccttgccagcctgtctgacctcatactcaccgctgactgtctgctcaccaagctttggccacgagggccttcttaaattcctcaaatgcccagcccctacccaccccagagccacctgtctagaactttctttcctccctttggtctggcagtgtctcctcatccctctgctctcagcttattattttattttaaaatatttctttttaaaaggccaggtgcagtggctcgcgcctgtaatcccagcactttgggaggctgaggtgggcagattgcttgagcccaggagtttgagaccagtctgggcaacgtggtgaaactccgtctctaca

SEQ ID NO: 198849 - DNA, 478 bp, Homo sapiens
cgtttacgagttgacatctctgaaggctctatgaagaggaatagcatgagtgtgctgtcagaatcagatgttactgctaaaatttacatgtagtgatgtaaattgtgtagaaaaccattaaatcattcaaaataataaactatttttattagcagaatgtatactatttagcaaagctgtctccttatttaaataaaatagtgttcgtctgtagttcagtgtaggggcaatcttgggggggattcttctctaatctttccagaaactttgtctgcgaacactctttaatggaccagatcaggatttgagcggaagaacgaatgtaactttaaggcatgaaggcactcgacatgattcatgtgcatgtgccatcatccccggcctgtctgaaactctttttgtgatgttagtgttgacctaaaatgaagaagctgagtgaagagtttatttgggccaagcatgatgattgcaacccagg

SEQ ID NO: 198850 - DNA, 572 bp, Homo sapiens
tactattatctccatctacaagtgaggaaactgagacatggcacagttaagtcatccgcccgatgtcatactatcaatgaatgagaaagctgagatacagacccaggcagtggctctaaagcctggaccctggcatgctaacccagaagagatgcctcatatcatggataagggaggctggaaaaagcgccccagaacataggaggtggtgactaaggtgggtcttagagggagaacaggaccctgcgtgccaggggtgggagtggggttacgaagtggatattctaggcagaaggaagaacaagagagagatgtgaaactgcgtgacacattcaaggaactgcaaatagctcgacacagctgctggaaaacagctctgaagtggctggagcctcatcctgcagggcctcatctaccacagtagggaactggacccatcacagtaagttaaaggcttcacaacatgactgtattctggcaacagtgaggggagtggatatttttggggcagtgggcaagacaaaagacagggagatcagctgaagatgatgaaggcaggagcagaaggaatg

SEQ ID NO: 198851 - DNA, 314 bp, Homo sapiens
taacgttattgtttgacccaagtctgttgttatttttttcttgttttctgaattatctgcatttaatatataaccttggtttgagttctccttactgaaggcatagctttgttttttgttttttcaattgattttaagaagaaattcctattattgtcatgaacactggacatactagaaactttcttttcatggtaacaaaggtatttggaattcttttattttcctttcttcctttttttctctttcaacacactattaaagcagaagaattcatgctgtaggtatgctcttgctcagtcaaacaataaata

SEQ ID NO: 198852 - DNA, 557 bp, Homo sapiens
tgaccgcggaaaacattcatgcttttattatagatctgcaccatctttcttaacattggattagaacaccatgaagtaatttctcttttaaaatggatacataatagttgtacatattttgagggtacacgtgatattttaatatatgcatacaatgtgtaatgatcaaatcagggtaactgggatattaatcacctccaacatttatctttttatgggaagactccagttcttctcttccagctattttaaaatatacaataaattattgttaactacagtcacccaactgtactatcaaacactaactcttattccttctatctaactgtatttttgttcccattaactaaccactctctatccccccatactccctacctttcccagactctggtaaccaccaatatatcctctacctccatgagatccacttttttagttcccacaatgagtgagaacatgtgatatttgtctttctgtgcctggcttatttcacttaacataatgaccttcagttccatccatattgctgcaaatgacagaatttccttctt

SEQ ID NO: 198853 - DNA, 483 bp, Homo sapiens
ggccctggatgaggaattcctgggtcgccccccttagaacatgtctggttttggaaacaggttaaaaatacttgaggagggcatggcacgctcagtctgcttccctgatgtttgaaataggccaggaatgtgggccgggaagcccagaggagcctgcgtgtcccgcagggttttgtagttggagcctggggtttctcctctccatcatcaccccctttaactgccagtgaccacatgccagattcatgaagggcacactgaaattgacgaagacctgtgccatgggtagcgggaaaaactgggctccctttagtaagcaggatggtgttgaggtctcggaggcaggcaaggggtgggctcggaatctctcctggaagagaaaagagaagggaatttggattctgtatacaaatatagaaattccctaagagtttaaatttgaacatggcattcaggggagaagattatgggttccaagccttt

SEQ ID NO: 198854 - DNA, 536 bp, Homo sapiens
  misc_feature (6)..(6): n is a, c, g, or t
cacccnttcgtctgcatagtttgcccttttcaaaaatgtcatatagttggaatcctccagtatgcagatttttcaaattggcttctttcacttggcaatatgcatttaaggttcctcaatgtcttttcacagcctgattactcactcatttagggtttaagaagtaatgaaaacgttctaaaatttagttgtgatgatggctgctgagctctacgaacatactaaaaaaaaaaaaatttttttttaaatcgctgaattatacacgttaaaagggtgacttctagttgggtgcagtggctcacgcctgtagtcccaacacatcatgaagctaaggcttgagcccaggagttcaagaccagcctggacaacacagcaaaaccccatctctacaaaaataaaaaattaaactttacaaagtattttctcctaccataacaaaagtaaactaaaaatttgtaacaaaaaggtatctggaaagtaactaaatatttagaaactaaacacatatctaaataatccacaggtcaaatgggaag

SEQ ID NO: 198855 - DNA, 141 bp, Homo sapiens
ggcaattttttttcatgatttcaccaacaaatagcaagccctctctctaagaaatgtcaatgatgctggaaaaaaaataaagttccattttcatgtgatataacatgtgatattaattagggtaatactagccatgaaaag

SEQ ID NO: 198856 - DNA, 608 bp, Homo sapiens
tattacaagatgctagccctgaaattcaggactaatgctgtaattaataaggatatgatgaaatagtcaatattatgcaggttcattcaagaaacatttattgagttcctcctatgagtcagatccaaaccttgctttcaagttgctcaccacccagcgctggccactcacccataagcaacacaggacaactgccacgtcatgtataaggtgctaggagagcatgaggaaagggaagacccaggttctaaatagagaggaccagcagaattaggaaaaatcccttcacatcttgctgactagccctaattctactcaccttacttccaagcagggggcatgcacatacacattcaattaataaactattatctgctggccaaaaccctccagtcatttcagtgaaggtcaagccctcttttgtttctgtagtggtggaggactctaggtagccaggaagaaggatgcagatattcctaggatttaaggtagtaccaataacgctatgcaaagttactaaaaatttgaaatctgttccttccactgtaacgtgcccttaaaagtcaactgaatcaaaccttgagttgtgtggtcctaaaagatgaagt

SEQ ID NO: 198857 - DNA, 522 bp, Homo sapiens
cattgcaggcttaaaatgttaacagcctctataaatgtgtcttttggctgtttgcaagattagtctatgcattgttatatttaaagatagttatttagagataatactgatgaaacattccttatggataaatttgaatagaaaggataacatttctgttggtatcaggatagagttttgtgtaagttaacgatttttaaatattttaagtcattttagtttagttgacataggcggtatggtgaatcacataccatttgaaaacatttactgttatgaccgcttaagaaaagcattatgtttgtaattaagtggggaaggatattgttttttaaaaaggggagtgctatataaatagtatatggcttgttatgacctgttgttaaatttacttccttggtatttttttaataccttatactaagcatcggtccttaaatgctaataaaatgatatgctatagaaatttacaatcagtgcttcacaatcccatctacattaaacttaaggaccattcaaaaa

SEQ ID NO: 198858 - DNA, 306 bp, Homo sapiens
acccagacatcctttctattgataataactttttcaatcaaccaattgccaatcaggacatgtttaaatcttcctgtgatctggaaacacccaccccccgcccagcttcaagttgtcctgcccgtctagatcgaaccaatgtaaaaatcttacatgtattgattgctgtatcatgtctccctaaaatgtataaaagcaagctgtatcctgaccaccttgggcacatgtcaagacctcctgaggctgtgtcactggcccatccttaaccttggcaaaataaacttcctaaattgattgagacctgtc

SEQ ID NO: 198859 - DNA, 460 bp, Homo sapiens
aagaaggcaacaaaaagaaataaaaggcatccatattggaaaattcaaaataaaactggcactatttatgaacaataggattatcatgtagaaaatcctaaggaatccactaaaatgctgctagaactaacaagcacaaagaatgcaaagtcaatatgaaaaaaaccgtatcttatatatagtaacaatgaacaattgcaaattcaaataaaactgtatcatttacattaattagacataaatccaactaaatatggactatatgctgaaaattacaaaaccaatggtaggaaaaattaaagaatacctttagatgtccgcctttgtaacctacttaaaaagattatgttcttatacaccttgaagcataaagcagagcaagaaatggaaattttaccctgtgagtgttctacttgggagagaagcagaaagaaaacttaaaaactggattcaagaaagc

SEQ ID NO: 198860 - DNA, 346 bp, Homo sapiens
cgagggttcagacatgatccaggattgcagccctggagggccgcagggctcacggttgaagccctcgcggaaagccccggaggaagtcaaacctcccggctctttatgaggggactctgagcctctgctctgaggatctgaaacacacacaccctgacagtgtaaaatccaaaaggagccgcctgaatcatgttgcctcatgtggaaatccttagtccgccgccacgtgaagatggatgtgactagaacggagggcgcgggaggctcacatcagaggagctgctcacgtcaggccaacatcctcctctcctgatcccattcaggaatcgtcagacaaaaccatcct

SEQ ID NO: 198861 - DNA, 505 bp, Homo sapiens
ggccgacccttccttaggcctcagctttcccatctgcaccctgcagcatctctaagggcccctccagcataggtggtttgtgaaactcacaggtggtccccaggccaagatgggcaggtgtcacaaagaagagggccctaagggctcacaaccaaagtgatccgccaagcagggcagtatctgggttacagccacagcaggaagaaccactggagagacactcagaaggacttccctgacatctgcaccaaggagagtctggacaaagctactgaaactcctccacctgcttctaaaatgcccagaagacaactggaccagtttggtattagaagtaggaggctggacgacttcacccccaaagggtcctgaagccccagaactggcatgtggaaggggctgaggcctaattgaggttggtggattcacacatgggggtcctccaggacctcagctgcacccattttctggaggttttgctgcccacaacaccagtatttcacaa

SEQ ID NO: 198862 - DNA, 900 bp, Homo sapiens
tttgtaatatattgttttataattattcactatagacattcactggtgggttgaagtgtgaggcagtgagctgtgggtattaataactgactcgtgtcagaagcttagcagtgaacaaagcactttctcggatacggttcttagagcttctcctgcttcttttcccggggaagaaacttgagctgctaacattttgtaaacctcctaatttcctgtaaatcacatgtccctgctgagtggggctgaaaatgtttcgggcaatggttttcacccttaggtctgttcacactgcccagcagccagttagcttctctctgtagtttatggtgtagtttgtcctttttctgccggggtgggaggcatggggctttcatgctctggggtttttgaggtctgccagcctctggggagggaggtgttgggcaagcctcgtgctctggtggaaactgaccccctagatgtgacctcggcatttcctaaagctgggggcgggactggggtaggcggtagtcaaggccctttggtgaagcaagcgattgtctccagcgttgtcagcttcgctcctccataagacagttgctaatttccacctctgttttcacctacataagacactttatgacaggtttaacttttatgttattattagctctagccactggtatttcatactcagttcgtctgagctacttataaagtgacaagtccagccagggcaacatggtgaaactccgtctctacaaaaattagctgggcctggtggcatgcacctgtagtcttagctacttgggaggctgaggtgggaggattgcttaagcccagaaggcagaggttggagtgagccatgatcacgccactgcactccagcttgggtgacagagcaagaccctgtctcaaaaa

SEQ ID NO: 198863 - DNA, 422 bp, Homo sapiens
aagaaataacaacaaaaaaacccagtgttaaccctgatctttcatggttgactccctgagtcaaaggtcaggctttatatgtgaccagcacagaagggccaattggtggtattcttagaacaatgacccgggcccacagcagtcactggcaatagtaacagctgcatagggtctgcttaggtctggatgttggggatggatctggcatggctttttgtggaagacatgttggaactcaggtctgtgggagaggaaggtgtcccctcccctcggcaggtttgtctccttgccttggatatggggaaggccagaggcacaaggggaaacagggtgtcaggaggttgagaagaggcctgtgttgctagaactcagagagtgaggggagcagggccttgtaggtccctggaaaggtttgatcttta

SEQ ID NO: 198864 - DNA, 180 bp, Homo sapiens
ccctttagacataccaaatcttgagccatttgagatagtggatatctttctaaagtggaaaccctcccccacgaccatctttttaaacacagtaaagcactggcataccaacgcaggagcagtaggagtggtctgtctggggtgcaaacaataagagggtagtgtgtagagaatttaaag

SEQ ID NO: 198865 - DNA, 434 bp, Homo sapiens
cagtgtacccgccctccttccaagggggtggtgaggaccaagggtggggcagcctggctgggcagcctttcctcctctagccgatcccattgccatgggctctatttagagctcttgtttcttgtgagctctgcctgggccaccaggaaggtgcaggaagggcacacgttggctgggtatgagcgtctcaggaactagtggcttttcaatgataaattgaatgcacagagccacttgcttccacaactctgactcttgacttttttttttttttcctaaaggcaagttttaaaatttggaacaaggtatcatctagccagaggacacagtacagtcctcagagagaaaaggggcctggctgacccttttagctccgctggctccaggagaatctgaggttgcaccagaggtggaatgcgtaggcttcagggtcc

SEQ ID NO: 198866 - DNA, 97 bp, Homo sapiens
caatgcatgaaaatgccatttggggcaagattcaaagaaatggtgtgtagaagtaaaagatgagtaacatccctcagcatatattcttttcagtggc

SEQ ID NO: 198867 - DNA, 444 bp, Homo sapiens
acctagacttatttctgaagaacttcaaacactgtagatttaggaggagcttatactcttcctccactactaacctcaatcctgtggccaagaattcaaattttatcctcattcctctgtctagcacatcttttggtacaggtgctcaaaagcacagaatgactctaggatgaccaagctcagtccctgagccacccaggacccctgtatgtggtgtgaatgttgagccctagtgaagggaactcggggattaaatggagataattctttggaggcaaacttaacctgtggctgggtcacttctcaaaggttattatcactctctgaagtcagaaggccacacttgggaccctctgacccatgtcacaggaagtagaggggcaattctagtgcagttcacacacgtgggtatttaaacaaattatctcctctttgcactccctt

SEQ ID NO: 198868 - DNA, 257 bp, Homo sapiens
gaaaagaaatctcttttaaattcaggaactcataggcagaagggacagtagccttgtctcagatgagactttgaactttttacacttggaatgagttaaggctgttggaacttttgaaaaggcatgattgtattttgctctgagttaaggacatgagattctggaatatcagggtcagaataatatggtttggctgtgtgtccctataaaaattcaggtggaattgtaattccaaatgttgaaggtggggcctgggg

SEQ ID NO: 198869 - DNA, 438 bp, Homo sapiens
gattgtttctactttttggctgctatgaataatgctgctgtaaatatttgtatacaagttttggaatggacatgggtttttaaaaatttctcttgcatagatatctatgagtggaatttctgggttatatggtgactttatggttgatattttgagaaactgccaaactgtttttcagaatgagtgcaccattttacaatccaaccagcaatgtatgagagccccaatttattcacagctcaccaacacttgttactgtcttttcttcttatgttagccattttagtggatgtgacatggtctcctaatacatgaaagattttggttttgatttgcattttcctaatgactgatgttgttgaacatcttatgttacgatcagagaatgtaaacctgtcaattcccaacattaaaacatttatcagattttttggtggc

SEQ ID NO: 198870 - DNA, 386 bp, Homo sapiens
gtttgtgtttatgagctcagttggcctataattttcttttattgtattattcttggcttatttttatataaaagttatgcagtcctataaaagaagtgagtgttccctctttttctgttcactagcagagtttggcagttggaagaatttactggtgaaacccatctgaacctgaagttttattttgagattctttattttgtgtgtgtgtgtgtgtgtgtgtgtgtgtgtgtgtgtgtgtgtgtgtgtgttttgagacagggtctggctttgtcactgaggctggagtgcagtggtgcaatctcggttcactacaacctctgcctcccaggcttaagccatcctctcacctcagcctccaagtagctgagaccagagatgcatgc

SEQ ID NO: 198871 - DNA, 475 bp, Homo sapiens
gtgagccaagatcacatcactgcactccagcccgggtgacaaagtgagaccctgtcttttaaaaaaagaatcatttattgagctctgggactggcgtggtggctcacgcctataatctcagcattttgggaggctgaggcaggagaattgcttgaacctgggaggcggaggttgcagtgagccaagattgcactattgtaccccagcctgggtgacagaacaagactccatctcaaaaaaaaaaaaaaaattatgctagtattaaatgattctatcctcatatgaaaacaaaacacaacatattgctcctttatatatcctcctcttcccactcttctccccagatatggcttgatacacatccttctaaacacttgtctatgaatatacataaataaaagtacataaaaatactgtatatacaaatgtgatctgtgcatacttttctgcaattttttctcaggtattcagaagc

SEQ ID NO: 198872 - DNA, 560 bp, Homo sapiens
atgattttcccaaccccagaggtttggtatagggtggagggtcccactgtctacagagacaaagcaggtaaggcatgagtgaagcagggcgtgtgtgagtgaacaaaagaggtgccacggtcaatggttaccatggcctgggagacgacagggagtggtgaggtctgcggaaaagcagagcaaaaagcccatctcacagggactgctactcgcactctgcattctgcagtgtcaggtcctctgctttttcgagcaatgccagaaacagatttctttttttgatatattaagttaactcaatttaaaaacaaaaatcactcctctgtgttagcaggttgtaatcattagtctagcacctagttaggtgctcaaggaatcataataaaaggttcaattccttcttgctctgcacttaaagcttgtctacctcaaagctaacaaggcctctggcactgtcccctcctgctccagcccacgaccatcacctcctgctctaagcctattaccccaagagccctttgctactaatcataggtagtcaccctggccctggactcaca

SEQ ID NO: 198873 - DNA, 2040 bp, Homo sapiens
tttgaaaggttaccctgagacctgtaccagcacggtgataacgcactttattttgttttgttttttacagactttaatgtttttcagaacctaaatatgcacagatacattcttcttgtaaaaatcaatcaacgtagaagtgtacaaagtaaaaagtcctttctgtccctcccttcctccctctctccttcctcccctcctttgcttctttttgtccatccatcactactgttgttagtttgatgtttcttttccaggtatttttttcatttgcatatgcacttgtggacttaagagaaatatagagccaggtttcttttttaaaaagtttttacataagtgatggtatcctggatacattattctgcaattttcttttttttttcccatccaacggtatatcttggagacgttttcatgccagaacatgtacagtacagatctgtgccattatttttatctgctgtgtagtattccatagtatggattaccagaattttctaactagctccttattgatgcagatttttccagtagcttcgcttttgccacagtgaatgttttatttccatgtgcaaatgtttatcgaggacagatgtgatgaaatgaaagagatggatctgaaggtattaaatttgaatgagaaaagtgctagaccccatgggctggtccccctgtctctatggggcagccaagtgaggggaaggggccagaatactgtgctctgtggcaggctcgtgggttggttttagggtccacagttgcctgggtttggatgaggggtgtgaggctgccatcagtcagcccttgacctcactgggctatgctcagcttcctggcagcactacagagcctgctgctttcagcaggctgggaacggctgcttcttgctggtggagctggtgtttgggaggctgccggggtgttagctcacagtggcgtgggagcgtggggtggcagctcccccactcccctgagctcacagcagcctctgagtcaacctcccccacctgcctggggaatgtgagttgtttccagagaaaggcaggctaggaactcactgagtttcatcctctggtcccatattgcctttagactagtgtccttgcccttggacctgcctgagccccatgctcactgctctcactgccatcaccctctgccccaggcgacgccagctccaccaagatcctcccatattccctgcgttatcttacctccacacctttgtatatgcaattccctctgtctgggacactcttcctgtgactaactcctgtaaccctcagctttgagtccggcgtgatctctggggagccatctgtgagccttttcccggccctggttaaagtagcaactcaatacgtagctgatgtttactgagagacagtgtagtgtcatggctaggagcacagaccctgcagtttgtcctccaggattcaaatcctagctctaccgtttactagctgtgcatccttgggaaagttactttacttctcagtgcctccatctccccatcggtaaaaatgaggatgatgatgtacccgcttcataacgttgttggggggttaaattaagttgataaatgttgaagtggtatggtcagagctacgtaagtggtataaattgttgttattctacactattctacatttacgtaatctattattacagcatattctgattgtcatcattgttattatttatcaggtgctttgtaccaggcagcttgccttacatatgttatctcggttaatcttcacagcaactctctgaggttagagagtcaaaccccatttttaaaaaatagcttggggttcagtttacatattataaaatttgcccactttaagtgtactattcaatgattttcagtaaatttacagaattgtgcatccatcagccacaatccagttgtaaaacattgccatcgctgagtggtgtggctaacacttgttatcccagcactttgggaggccaaggtagaggatcgcttaagcccaggagttctagaccagcctggagagcctgtctgtactg

SEQ ID NO: 198874 - DNA, 708 bp, Homo sapiens
cacaataatgtccacacataggaaatgagatctcaggtaaatgtgcaggtgacagaaggtggagcagagactcagacacatctactgattgcagaaacagattgtaacctgatagcccggcccacctggcccgtcgtgtgccagtttctttgcagatcagaaatataaccctaaacgtggtgatgagtctttggttccaggttatctctaaccccttatggggatgtgaacaccttccccagacagctcagctgagtaattttggttttgaattgagaaaccagtttagtctaggcctatttgttctaagtaatatgtctactcttccgtgagtaacaggctaaaaaaaaatgtctgtatacacatgaaggtaatcaaacttgttaattgttcaatcttgacttttaagggtactgatagagtttacattagaggaatcagagaagttctgccccagaatgtcttggaaaaggcaagttctaatgatgaatataggcagattctattaagtttagaaaactggcagaaatttttgtcccagtgatgtttacttaaagctgatttagtaaacaaacttcaaaaagtctcttaaaaatgtatggtatctatacacactcacataaatatactcatattcaatgacaaacctctgacaagtttcatgatattcatttcctcacccattaatccactcgtttattaatttag

SEQ ID NO: 198875 - DNA, 458 bp, Homo sapiens
tattgggatgatttctcattcatcctgatcacggttgctgcttcctcctaaggaacattcttctgtaagctttgcttgtccttctgtaggctgataggacagtggaacagccaacacacacaactttgggcatgacgaaagagcatggtgacttgatagcatcctggtcatttcacatccatgaagaaggaattggttcgtcaccaggagcttctcatgttttctggagaggcatgaaggagatccttctctagagacatctcgctggaaagcttattcctttttctgtgtctacatctcctgttagatggcccctctgctgtggctctgtagattctactaacatgactccttttttttattctttagtctgcaagtggagatggaattctgttgctattttctgagtttgtctccttacctctagggacctagctaggtaacaggtaaaaatcaac

SEQ ID NO: 198876 - DNA, 405 bp, Homo sapiens
tttccttttttctcccttcctcccgccctccttttcttccttcctccctcccttcctttcctctttttccttccttccttcgcctctttattttctttgtttctttgccttcctcccttttaccattctctcttcctccttttcttcctcccttcctcctttctttctttctctctttctctcttcctttctgtttctttctttcttttctttccttccctctttctttcttgtgttcatgttttcttttctttctctttactacaattcatattatttttaaaaaattaagagagggagacagaaaaataaagaacgctttaatctgcaggtaaatagattatgtctgctgcaggcaaaagaatggcctcccaaaaattttcatgtcctaattcccagagtcta

SEQ ID NO: 198877 - DNA, 561 bp, Homo sapiens
ttgccaaaaagtgtgcttgcagtccctggggattgtggcaatatgtatccacgatgtgctatgggaatgtagtggcaagtgcagtgtcctacccattcaggtgtgtttacatgtatctactgaaaattgctagatgtgagcataattgtgtctacatatcacagtttcaacggataagaccgtgtgtcattccatgtatataagtaacggagcttgtcaatattttagaaggagagcagtgtgttgaggtatttgtgtgccaacactgcagctcactctgaggctgagtaagagacggtgagtcagtatgagtttgtatgtctttttagctgtgaaagtgtctctgggtaacagcaacagacattcatcttttcatattcttcctgtgaaaacataactgtcccattagggatgataagctttaattcataataatggtcaacactgcagagaaaaaaggattggggagggacatttaaggggcttcaacaacaatgtcttattctttcgtttttttttttttttgagacagagtctcgctttgtcgccaggctggagtgc

SEQ ID NO: 198878 - DNA, 412 bp, Homo sapiens
ttttggctagggagaagatgagggactccttcagagctgaaatggagacctctgggtttttcgaacatgttctcagttgtctatttagaactttaaattgccccttttccttaagtccgtcttccagggtagtctgaagaaggtagaggactgcacagtctttacaattactattttttgccatagcaaacaagtcattttgttttcttctctgtaccttactcctcacttgcagttaatctttgtacctcaaatattggcaaattgcatccatacattagctgtgccctcctcgaatacataagaaaaccaatttcagaatcatatttggagggtttctttctgggagacactttaagtaccagttcctcatcagtcgtggttctaataaaaaaaaaaaaagttgaaatgc

SEQ ID NO: 198879 - DNA, 372 bp, Homo sapiens
tgatctagtcatttgtcaatgtatcatcctaggactttctaggggatttgaatcaattggcacatgaatattttgtattagctactgcctgctctaaccatatcttgcccattcttcctattttttaatactagaacaatgatttctaatgcctagtaaatgcaatgttttactcagaatggatgtgggtgagatattttgaaattttaaatcatttataaagagaagatttttatgtttatcagaaatgggcacagattttttaaaagatggacaaacaggactagaacctagagactggatagaattattcacatttttgacaatttgtagaggtttcttccagtattattgaaacaaattcatagagta

SEQ ID NO: 198880 - DNA, 103 bp, Homo sapiens
catgctgacagggcccaactcttctctgtccaccggcgaaatccctttaacaaaggagggcttctgtgcttcctcctggagggtcagctcatagtccaagggg

SEQ ID NO: 198881 - DNA, 737 bp, Homo sapiens
caagctcctttaggttattagcagagtgcatttccttgtggttatatgaccgggccttggtctcttattggccatttaatggaggctgccctcagttcctagaggccactccagttatctgccatgtggccctctccagaggcagttcacagtgtggcaatttgctgcttcttcaaggctttcaaggccagcaggagtctctctctagtctgctaagatggtgtcatatatgtcatataacataatcatgggagtgaccttccatcacctttaccctgtgacagagtttagatatatgtccctgccaaatctcatgttgaaatgtaatccccagtgttggaggtggggcctggtgagaggtgcttggggcaggagggcagatcccttatggcttagtgctgtcctggcaatagtcagtgagttctcgttaaaagtgtgtggcacttccctgccactctctctctcttgctcctgctctcaccatgtgacctgcctgctcctgcttcaccttccaccttgagtaaaagcttcctgaggtctcctcagaagctgagcagatgctggtgccatgcctgtacatcctgcagaaacatgagatgaataaacctgttttctttataaattacccagtctcaggtagtcctttatagaaacacaagaacggcctaacacactacataatgtaactaattgagtgagtgacttcctatcacctttaaaaaaaaaaaaaaaattgg

SEQ ID NO: 198882 - DNA, 353 bp, Homo sapiens
tggtcccaaaaggagaaagtacatcagagaggagccactccgtagcatgagagcttgagagctggttggagctcaggtctactcccatcttccccgtttgcctgctaggtgaccttgggcaatgactcactggagttgaagccactatcccctctaccaggagagtggagataataatacttgccacagggagtaactgttttaaatgttacgggcagagcctgtgccaggtatataatacctgcctcctgcgtggctccccagctaaagtagggcctgtggcctaagtcactattaaaaataattaataatgaaaaaagccccagcatttagtaaaatgcctgaaacatttt

SEQ ID NO: 198883 - DNA, 160 bp, Homo sapiens
taactctccattcctccctatccccatcacctgatgataaccactatctactttttgtctcatgaatttgcctattctaggtaaatttatataattataataagtggagtccacttatatggcatcccactatttgtccttttgtgtgtggcttatttta

SEQ ID NO: 198884 - DNA, 225 bp, Homo sapiens
ctgcccatgccccactgataccccacagtacttcctgttctgcttagtactcctgcttctttctacaaacaactgtgattctctacctgggagcttcctctggccacaggagcctgctcacctgattgggacaccctagcagtactggtgagttatagcttccaggagcagctctcttccagcaaaggaaagggttggctgaacagtacttcagctgcctctgct

SEQ ID NO: 198885 - DNA, 207 bp, Homo sapiens
agtagagatgggattttgccacgttggtgaggctggtctgattttcctggcctcaagggatttgcccgccttgacctcccaaagtcctggggttacagacgtgagccaccacacccagcccctattagctttttaagcatgattttagtatgtacaggatcaccacagtccatgttaaaattcttccactagtagtgatgctgttaa

SEQ ID NO: 198886 - DNA, 896 bp, Homo sapiens
aatcagctgggcgtggtgacgggcacctgtaatcccagctactctgggaggctgaggcaggagaatcgcttgaactcgggaggtggaggttgcagtgagcggagatagcaccattgcactccagcctgggccacaagaatgaaactccatctcaatcagtcagtcaatcttgcagatattggagtgtttcagatttcagatttggggtacttaaactgtacgtgaaaattagctgctggggaggagaggaattggaatatgtaacatggactcccacattttaaggatttttctaggactgcatctttctcttaataagtcagatccttatttggttgaaaatgtttactgcatgactatcactgactatgtaagatgctgatgtacaactctatgacttgaagattgagttgcttctatgggaatatgacaccatttgaattaatttgttctcaatattttaaagagttttagtgaattctgttcatataaaaatcaggttcaataatgcgtgctttttacgctatcattgagtatccagtgtttacaaggtgtttctgagggataagattattattgctgtgtaaagaatttggcagatggtgtgtaccttctaagttagcttgaggtttatttaaatctcatctttttagcttgctgaagttgatactatgcagttgcaagtttatattgactatttgatattgctgtgtttttatttgaaatgggactgttaaacacatttttctttatattgagcaatagagctggaatattaaagatgtatgcattaacccttgcatttggaacatttacatgtcataagctgcctttcagtaagtggttaggcatttctacgggtgtgtattatattttgaataaattttatatggctt

SEQ ID NO: 198887 - DNA, 450 bp, Homo sapiens
ggaatgcatttagtgggctgaaagttgcaaatattgtatatgccttttcccctgattgtcattaatttggggttttgaggaggaggaatttacaacttactctttccattttcaaaaccagagtataaaaacatgctctttcgaccttgaaaaattgattttcaatttattatacatcagaggaactatagccaatatttttagagtatataattctttcccatgtaaacaaattcagaattgtttctttaaaaaaaaagctttttaagcttcatttatataactggacttgaggaacagtttttctatgggaactcagaagcaaaacttgcctttgcctgaagtcaccgactggggcccagggaagccaaagctcctttggagttgaggtcagacatggctgtatgtgacatggacattctatggaatacagcagggtagaaaagagtt

SEQ ID NO: 198888 - DNA, 419 bp, Homo sapiens
tcaggctggtctcaaacttctggcctctagcaagccccctgcctctgcttctcaaggtgctgggattactggtgtgagccaccgtgcctgaccctaaacccatatttattaaatgcccactatgtgcaagtcaccattacaggcattggaaaacagcagtgagcaaaagaaatagtctctgctgtcatggagtttacattctactggtggcaatagacacaaagataagtaataaacagagaagagaaataaagcaggatcagggttttgagtatagcccgattgtgtgtgtgcgggtgtaagcatatcttagattccctaaaacacagagcctgagatacaccttatgtcctaaaaaatcttaggagatgtggttccagggcagcaaaggtaggggaaaagggaacataaagcagtga

SEQ ID NO: 198889 - DNA, 338 bp, Homo sapiens
ttacagacgtgaggatttagtgaagtcctaggggaaagttaaactttagccagccggctaacacaaaagacgtggacatcactgagtgagaagttcaaagcctgcaccaccctagtatatatacttacataaagtggcccaacgacatcttcttcctcttttaccccttgagcaccagtggaataagaaggagttcgctgtccctttttgctcttcactgtgatttcaggtgaggaagtgtctcttagccaaacagcacactgacttttaaaatgcattaggacccatatgggcaagacagaggtttccattccatccaagaccccttagaatcatgg

SEQ ID NO: 198890 - DNA, 238 bp, Homo sapiens
acataaggcagatttttttctttaaggctgaatgatacttttaggctgaacacattccattgtatgtttgactatctttttaaggtcctttcccattctaaaatctgggtaatcatgtatttttgaagtttgattttttttccatgcatatgtgattttatttttctaaaatttaaacattacaaaaatggtttaaacttgagaaaataagtttctcatcatctgataatagtttaag

SEQ ID NO: 198891 - DNA, 332 bp, Homo sapiens
taaaaggttacggtatgtagtggaagacaaggtcaaaaagtagcacatatgaagatgagcatgctaggtgaaggaatcggaactttatccaggagagcagtgagaagccaaggaaagattttgactagaggagtcaaagaacagctgtgctttaggaaggttaatctggaaagaagaggaaggccttttaggcaaagatcaattaggaggtgcttatagcaatgaaggtataaatgataaagtctgaagtcggtgatagcaaaggaaagacaaaaggataaatataatgcattttaaaggtacatgacaaatctagtcacagaggacagcca

SEQ ID NO: 198892 - DNA, 647 bp, Homo sapiens
tcatgaaggctctgggggcgagggtgggggagtgtccagggtgtcagagccctcaaaggatgcttccagagtctagtcgggtgctgctgcctaggtgtgcagagggggaacagcctggtgtgcagagagggaaaggaaggatgaggaaagccttcccggccctgcagactcctctggccctccccagcagtgcccccgcctctcctggggctggaaagcccagccatactgggtcttggctccccttgaggctccttaaaaggcaacattggaggtgggagccttggacagcttgcaaggaggcagttcagcatcttgtaataacagagttatgagcttgtaaaagcattatagaattcatagaatgcagcccttcagtcggcacctattattaaagacctactgcgtgacaggcactatgctgagctcaggagatggagcgggaatgcaacagacacagtccttgtcccatttctagtgtaaggtgaagggcatgggaagacaacaaatgagtatattctgacaagctgcccagtgttatagggaaaagagaggataacgggggtcccagtttagagtagggagtgggtgggaaagctactctgaggaagggacatttatgctgagaccagggagaaggataggag

SEQ ID NO: 198893 - DNA, 416 bp, Homo sapiens
ctggaacagcttatcgtgggtcgagggggctgggctatcgtcccagatggtggacacctggctgaggctgtccgccggcaggaagtcgcgcgtgtccacgatgtccggactggagtaaacctgcgaagagaagatggagatgttggagaagtcctcaaaataggaggagtccttgttcagagcctcaaactgcagccacagctgcagctgggacatggtcccggcgctaggggggccaggggtccccctggaagtgctgcaccagcaggcccatctttgtggggaaggagaaagtgtggcgtgaggacagggcaggtggcaaaagcagggtggcctgattgaacggctttgctcaaggaaatggagtcagccattcattttctttctttctggatacaaacaggttgtaccctata

SEQ ID NO: 198894 - DNA, 446 bp, Homo sapiens
tgcaggctcttcctgtagccaaagaccttgacctcatcttacctgctccccgccagtcccccaccgtggcccactggcactgtcctcttctgcccaggagacctggggacctcatctcctcccgctgctccaacaatgcattctcaacccagcaggtagatgggtttctactttaaaatatgtaggatgaaccagtctggtgatccgatgtacaacaggaggaatgtaggtaataaaattgcactgttttgggagttcctgctaaatgactagacttcagctgctcttgccacaaaatcctaaaagtggttgactctgggaggtgatgggaatgttaattgctcccctgtagtgaccattttgctatctgtttgtactttgtaacatcacgttgcataccttaaatatacacaatgaaatttattaaaacaatgaaaataaaaact

SEQ ID NO: 198895 - DNA, 597 bp, Homo sapiens
ctacggaataatgtatgtggcatctttcatgttatccatattatctagcacataaggaagttcaaaacaacttgcatcatttttatctccttccttcttataatctcttgccttcgatggagactgggtcaaattacattgtcctgcataaatgaagatgctgacaaactgttcttcataaaaactgaaaaaaagaggactaaagggattataacagaagtttttactggatctggaaaaaatagtaaaatataatatcagaattgcacaaaggatagaaaacaaaatactttatattcctgaagaacatccagaagacaatttataattgctcagaaacttacacctgcagaccactgaaccaaatggtttttagtccaataattacacaggactaaatattcagtgccttttactggatggccagtagaagaggcctgccattatatttcattagtttctaagggtccacatttttttgctgttatcaactttctcaggttgaaaggtctacatttttaaaacattgtaatgctttgaaatcggaatgtatcttacaaacaatggcaagtcagaattaaattgcaacatttttaa

SEQ ID NO: 198896 - DNA, 434 bp, Homo sapiens
agatgtctgtatctgggtgagagcttttctctctagaggcaaataaaatagataataaccctaagttgccagaatttgacatggtgagccaaaacctatcaggagacagtgaaattaatttatacaagtcagaaagtagtttttgaatgtatggcaaacgctttggttttgactttaaatgcctattctgatcactttcagattgtttctggcacactctagatagaaattgttccagctaatcagaccattagcaactgggtcaaccttctgaatcatacatctttggaactgcttgtattcatttagtttgtcacatgcattctgtttgtgatttattgagcatttttttggtaagagctcgatagtttttaagaggcactgtgtcatttctcaaaagaattatacttcatgagcactagcacaagcttccc

SEQ ID NO: 198897 - DNA, 488 bp, Homo sapiens
  misc_feature (400)..(400): n is a, c, g, or t
tgtaattttcagataatagttaaagttaaatgtgtttttagcatattccaaatattgcaccaagaattttgcctgaattttcataacaaccctgtgagacagttgctatgattattccacttcaaggttgagaaaattgaggcatagagaagttacgtatttgtttgaagttgcatatgtagtagataatggaacctgaatttgagtccagatttgtctaactttaatttttattcatgcttttaactaccactacataggaaaatgtttatagtatcatatgaatatggcaaaaatgaaataaggaactcaaaagtatgattccaattttatgtaaagaaactatacaccaagatatatatttaagcctggggcgacagagtgagactcttgtctccanagataaaaataataaaaatgagtttgccagcctgcatggtgatgcccggggattgcagcagctgccttcaggttcccgggggcagagg

SEQ ID NO: 198898 - DNA, 669 bp, Homo sapiens
ttttttgtctctcacattactagttctgtattttgcacagtgtcaaaaaatatttggtgatttacaaagtaaatggaatctgcttaaagtaatggtaataatacagtggattattgtcattctacacctaatacctactaaatgttaacattattttatgtgcattttcctctttatttttcttaaatactcaaacatattatgggagggggagtggaaaacaaaagatgttaagtgagaatcccctttcacagccgtgttctttgtttcctccaagattcttgaagaatggtatatacctgccttttagcttccaaccctctctgctacactgaaattgcagttgtcaaggtcaccagtcacctcctaattgccaaatccaatggtaaattttcagctctgatcttacttgacctttctgtggtacttgacactatgaaacactccattctccttaaaagtttctccttccctaaccttttgtgattttatcctctcctgattttctttcttcctcattttcgtatttatcttccctttgttcacctttaaagaaagatactttctaggattttgtccttggcactctacatagttttcatgagtgatcttatttgtactcatggcttcaactgctgtggtgactctgggccagttttctcttccgag

SEQ ID NO: 198899 - DNA, 189 bp, Homo sapiens
agtctctgtttccttatctatcaaatgggaatgatcataccctaggaatttgttgggaggatcagctgatacaatggaacttgatacagaaaagggttaacgcatagggttttaagccagatattcattgactcattcagtacataattattgagtgtattctatggggaggtccagtgctaagccttg

SEQ ID NO: 198900 - DNA, 320 bp, Homo sapiens
gcggccgccgcgcccgagcacatggcgtccatcttactgaggagctgccgcggccgggcgcccgcccgcctcccgccgccgcctcggtacaccgtcccgcggggtagtccaggggatcctgctcatctcagctgtgccagcaccctggggttgaggaactgcctgaatggatgttgaatttgtcaagcaactttttagcatttaaatttcatactaaaacataaatgctggccgggcacggtggctcacacctgtaatcccaacacttttggaggctgagtcgggcagatcacgaggtcaagagttcaagaccagcctag

SEQ ID NO: 198901 - DNA, 740 bp, Homo sapiens
tggcctcccaaagtgctgggaatacaggtgtgagcccctgcgcccggctcacagcagggttcttgataggccaccagtgaatcccatgccaccgaatctggcattcatttcacagcctcatctcagttctcactcagcagagccctcttgcctgtcctgccacccaggctactaatgttctggttcattctctgctgacagttagctgtggctgtcctcagcctcagtcctgggtctccccaagcagtcattagcatcaccttgactgatttccagggaacacttcaaccaccccttacctctgagctccagccccgagacactgccttctctctgcatttgttgatctctgtgcagcagtgcccacatcctcatcccagcttactgccgtctcaccaccttcaggttgtgaggtgcccataaactctgctgttaccattgccacttccctgtcttagcagctgtccctttcagtctgccctccactagtggccatgaagggggctgtgaccgtggtccaggtgagaaaggaaggcctgaactaagatgggaggtgggtggccagaatggagaggggagaagtggatggccagaatggagagatgcttagagggctgtgttgggaagtggtgactggatacaggggagggaggagagatacaagagggcacctgggctcatttgtggactacgtgattttgagactccaaataagcactgggtatttgggttggagatac

SEQ ID NO: 198902 - DNA, 606 bp, Homo sapiens
acaaaaggccgtgtattgtatgattccatttatatgaaatgtttagaatagacaaatccatcaagacagaaagtatattagtggttgccaggggctggtgagatgtgtggaccaggcagtgactgctgatgggtcagagtttatttggggcataacaaacatgttctgaaattagacagaggtggccaggcgcagtggctcacacctgtaatcccagcactttgggaggccgaggcgggcagatcatttgaggtcaggagtttgagactagcctggccaacgtggcaaaaccctgtctctaccaaaaagtgccaaaaaaataaaataagacagcagtgatggttctgcaaccctgtgaatacactgaacaacactgaaatgtacacatggtgaattgtacaaaagggtaaatctcacatcctgtaaattatctctcaataaagctgttattaaacagagagagagagaaggagagaaaagggggagataagatgaggacggtaatgggagtgacagcgaagagagaaatagagaaaacagcagagaagagagtgcctaagagggagagaaacccctcccccactccccacagttagaggaaggtct

SEQ ID NO: 198903 - DNA, 379 bp, Homo sapiens
ggaggctacaagcaggtaaggtgtgaagggatataaaaattaaaataacctatttattatttttattttcaaaaatcaatttatttagtgagtttgtgttattaaatgatgaaaaaaattacaatgaagggctaagggctttctacttagctttagtttaatagtttcagttttcattttcaaatgaagtgttagtacttcatttaatctataacaaccatggaatgtggtatcattaacatcagttgaaaaagtaaactaagtttaattcatggtaattcatgagacgaattcattgaccagaggaggtcaaagagtcatggttcttaaaatgaatgttgtagtcctctgcctttcgataaccttactatgatcattt

SEQ ID NO: 198904 - DNA, 710 bp, Homo sapiens
gatacctagcgttaattagggaaatgcaaattaaaaccacagtgagataccacttcacacccactagaatgctgtcaccgaaaacacaggaaataaagttggagagctcgtgttttctgacttcaaaacttacactgcaaagcaacagtaaccaagaaggtggaaaaacgaattctcatacattgatagtgggaatgtaaaatggggaagccactgtttggcatgatcttaattaagcagacttgctgcattgactcagcagctgcactcctaggagaaaggaaagcgaacatccactcagagacttggtgtaagttccctggaacctcggtcaacacaaggaaacaatccaggtatccgctagcaggtgactgaacaggtgacgcctgccacgtccacatggtgggtgcttctgcacaggatgagctcagaagcacctgctgagggagggaagtgtggctgtgtggtaggcagtgtccagaaaaggcaaatttgtaaacaaagtagaatgatgactggggctagggctggaaatgggactgactgcagatggacacgggatccctttcaggtgatgggaatgttctagagtagtgaccattttacaactcttcaattttattaaaagccattctgtgcttaaaatgagtgaaacttagggtatgcaaagtatacctaaataaagccgacgggtgttttaaaaagaatag

SEQ ID NO: 198905 - DNA, 421 bp, Homo sapiens
agagggtggtaaactggaagcagttcaatgggacagtgcttgatgggactttggaggtgatgaggtttgatatagtttggatttttgtccctgcccaagtctcatgttgaattgtaatccccagcgctggcagttgggcctggtgggaagtgtttggatcatggtggtggatccctcatggtggatcccagttctcatgagatctggtcatttaaaagtgtgtggcacctccccaccacctctctctctcgctcgcttgctcgctcctgcttttaccatgtgatgtgcctgctccccctttgccttccgccatgattgtaagcttcctgaggcttccctagaagcagatgtcagcattatgcttcctatacagtctgcagaactgtgagccaattaaacttcttttcttataaattaccca

SEQ ID NO: 198906 - DNA, 623 bp, Homo sapiens
gactcacccagataataagaacatgggtagccaggtaattattcagttctgtgtcactcagagcagtacttttccatgttggttgcacaagtaattacaaaaagagcttttaaaacgtaatgcttccatactgacccatcacccctaagtctgagcagggtctgagcaaagataatttttaagtttcctgggagattctatgaggttggtgaatctcctaatcttattctattaggttctattattttgccagtaatggccaaaatcgcaattacttttgcaccaacctaaaaatatggagctgggcttcagaacctctaataaaggcttccagtgtcctgttcaaaaccaggtcggataactccaaatggcagccggtttttctgccagaacaatatgggtatgttgagtgatcggtttgttttgtgtaagatacacatttattcagcacctgtgttctaggtgctgagagtttttcgaggaacaagacagaacctgcttatgccttaagatgctttcttttttagtggatggagacaaaaagtaaatatataaacaggactgcggttaagtgttaggaaggaaataaactaggaaattaggagtcaaagaaggcctctaat

SEQ ID NO: 198907 - DNA, 372 bp, Homo sapiens
tattacggatgtggaaataaaatcaaggctatcttgctggacttttttgacatttaacacaggaagtttttatttcataaatctgagcagaaagaactaaaactttgcagagggcttagtaaagcagtttggaaaataagctgtttttatattttctcttttgactttgcattcataccagtgattgtgcacatgcatatgtgcatatgtaacatatgtaagagaggaagaactagaagtggcaaagatagaaagacctagaagttgctgacaacaaagtacatacaggcttaaataattctatttacaatgttaaccagtagagaaagcccaaagtagagtactaggtctccttcctccataggctcagat

SEQ ID NO: 198908 - DNA, 181 bp, Homo sapiens
cccatccaggaacagaagtcagcaagaactcacttcaaccccctgtaattttatcttcaatccgaccaatcaacactccctacttcctgagcccatacctgccaaataatccttaaaaacgctgatccctgaatgctcagggagactgatttgagtaataataaaactccagtcttccaca

SEQ ID NO: 198909 - DNA, 325 bp, Homo sapiens
tcaaccagtaaccctcctgtatgcaacacaaggtgtgtgggaccttggaagctggtggaagagggcatcttggggaagaaggagtggtacaggtggtcaagtatttgcaagagggaaaattaatgtacatacttagagaagctatgatcatgaaaggccaccataaattcaagaataaattcataccaaaagaacctcattgctttttaaatttattgtgttactgtgtaagactacttagaaaggagagtgcccatcacttctcggccttctggctaagatcaagtgtagaaagcagaaagccctgaatgaagtgtgtcttgat

SEQ ID NO: 198910 - DNA, 598 bp, Homo sapiens
caactatactaactactactaacaatgatgaaatagatgcacttctgtcctcatgcagctcacagaatagtgaggaaacacagaaataaacagtaaaatccagggtcaggatgctactaagaggaacatgcagggtggtgtgggagcccagatttggggtgatctgggagggcttctcaggggaagagtcttcaagcctgacccttggatgactgggtaggagtcatccagtcacaaaaagagggtgaatgcctgctccaggtgagagaaatgacatgtgcaaaggcctcaaggtgaaagggaataggatgacttcaactggaaactcaagacaacttgtctcagtcaaggtctcatttgtaagcaacaaacacggagtctggctcctccaagcagaaaagggatcgattaagtgacattcgttggcccactgaaatctctgagaaactaaaataaattcagaggctacgggccaggagcaacccttgaaataacatgacgaaactggccctgtgaagacacccccgtcttggctgctggcactgatttggtggcttgcatgaccaacatccctgaggctgaattctggatgctgccc

SEQ ID NO: 198911 - DNA, 401 bp, Homo sapiens
aaagagacttccaagcactctgaacccacgggctaggataacatgccctcatcttctaagtcaaaattctcaatctacatcagaaagaggaaattctcaatgtgaaacccctttcccatattctgaaaattaagtccacacccaaacataaggttttatgcacatagatggcttcctgtacttctttatctagaagttttaccccatcctccagaaaatatccagaactagatggagataaagaagaaaaatattagtaaatacagattcttacacatttcatttttctatggattagttctataccagcaagaaggaatttccagaaaggttgatgtaagtgcatccctaggactcaaatgctaacatacttctccctcccacccccactttcaagtgaa

SEQ ID NO: 198912 - DNA, 392 bp, Homo sapiens
tgccttggccttctggtgtgttgggattacaggcgtgagccactgcgcccagtctattataaaggttttccaggtgcattcatgttgtagcgtgtatcagcacttcattaatgtttatgacctaataagtttgtattatattgatacaacacattttgcttgccaattcactgttgggttatcaacatttgggttctgaacaggctactgtgaataatgaaaaatgctatgtattattttaggctattattaataattatggtaatgctgctataacatttaggaccaagcttttgtatgtttcattcataaatttcatttctcttgtgtatgtacctaggaatggaattgctaggtcataagctacctatgtatattcttttcagcaacca

SEQ ID NO: 198913 - DNA, 158 bp, Homo sapiens
ccctaaactatgaactcagctttggaccccaagaggcaggtaccatgcagaatccactcagctgacagtagctgtggcagtgctatgccaatggtgttgtgcctgtgtgcagcctggcatcattgctgaaccagctctagatatgactttggactgca

SEQ ID NO: 198914 - DNA, 383 bp, Homo sapiens
gcaaattctgtactatatatttacaattacctatttattttcttatataaaaaaaaaaaaaaaaaaatagcatgtatgatataataatacttgtcatggatggaaaataatgtaatatatctgtcagtttttattgaaatataacattttataggaataagttcaaaaatagtatatatgatacaatacttgtcatgtatggaaaataatatatatatatctttaagctttttattgaaatataaaactttatagaaataagttcaaaaatcatacgtatataattcaatgaatttttacaacatgaacacacgtataaagaaaagctttagtctgagcacggcggctcatgcctgtaatcccagcactttgggaggccaagg

SEQ ID NO: 198915 - DNA, 335 bp, Homo sapiens
aagtgtcccttccccaagtgagtagtaaagtcaggatggaaaaccaagtcctctgacaccaacagaaatgttcaaacatttaggataaaggctcatttacctctaaaggccattcacatttctattaataggtatttatcaatgttgtcataccagcaaaaatgaggcatttaaaaaaaaatccttctcttttataaaaactgaaaagcaattttcataaaaacttttgactacaagtaatttacttaaagacagccaagttacagaaatgatttttttttttttttttttttttttttttaaagatggaatctcactctgtcacccaggctaga

SEQ ID NO: 198916 - DNA, 281 bp, Homo sapiens
tgaataccccatgctggggacacatcgagaattcccccatcagttcaggcatgacccgctggagggcaagtaaaggacagctcaggccacggggacagtccagaaagagcaggcgaggaagaccaataggaaaggaagtggctggggctgactccagatttctttgcaaggtaaaggcagagaaggacacagagggccctcgggcatcccactctggtctgtcgcactaaaaagctcgcacccagcatgaggggaaagacagggatgaagccgctcataga

SEQ ID NO: 198917 - DNA, 415 bp, Homo sapiens
tctgaggccccaggcagagctgcacgtgcatccgcaccagggagcactgcacaggggccctggcctggcccggccctgctctgcacctcacgggcagctgctgacggctctttgggctcacaggggatccagcaggcgctcctggtccttaggaggcaggcagctcagggctgcttcgctctccctgccacgccctcccagggtgtctgccaaggcttgcttgcgttttagtccctttgattgccagacctttcggttttccttgagtaaacctgagaaattcctgactttatttttttttgccagttggaagcataaactgtttgagatccgcttcctccaccagcacatcttgttctcatggccgctaaggggacgttcaccctgggcctcccacctgcttggccgcccctct

SEQ ID NO: 198918 - DNA, 795 bp, Homo sapiens
ttatttcaaacaacacaaacaaccaaaaaaatcctttaaaaacaacaaaacctttaaagactgagccactgattagtcagtgtatgttttagccaggtcatcggtttattttccttcctcttgtcttctggccatttttccaccacagaatcctagaatattacttttttttataaacacaagtaaaaattagaactagtctttgttcctgctttttaagtgcttgacaaaatatttgataaagagaaaatctggaactactgtgtaaaataatattaacaataatgcttatattatttctgcctcacattagaaaagactcaagagggatttggtactgtgggttcaactcaagcattacctgtcagattctcctttaaccatgattatggtttaggagatcgatgacacttcagcctgagacagttctgaacacctacttggagctctttcatagtaaatcatcagggagtgtcacactttttaattaattccctacatgcatatatgcagttctttactagaggtttttcatgtagcttaagactctcctagcattaaatatttcagttatctcactacatagtacacctggacacaaaaaatgtaacattataaacagctacaaaatcatagacctgcaacaaatcagagtaggtaatatgaacttctttcattgtaacacttgggctaaatttaaatggtcataatcaggttagacctggcagctgaagggggcattaatgccttgtggttaagaacataagctgtgaagtcaagatggggttcaattcc

SEQ ID NO: 198919 - DNA, 553 bp, Homo sapiens
aagggatgatgctaccagcacaacagctttcgttgtcagccaaataagatctatcgagaagaggccgggtgtggtggctagcacctgtttccagctactcgggaggctgagacagaagaattgcttgaacctgggaggcagaggttgcagtgagctcatattgtgccattgcatgccagcctgggtgacagagtaagactgtctcacaacaaaacaaaacaaagaaaaagtttgctgacctctgatctgagctcttgtctcttgcctggacaattgctcctgacttgtttcctaacttcactctcagagtagtcatcatggcctttgaaacattatgcaggtaaggtaattatagtgtgggaaagtacaaattacagaaaaccagaagtcaacagaagaaaaactactggtttacttgagagaaaggagaatggttcaccccgagcagagttacttggtgaacgccgccaccaccgcccacagaacctcattggtgttggccttcagacattccacttcagggtctaagtcgagaagctgccgcactctcttg

SEQ ID NO: 198920 - DNA, 427 bp, Homo sapiens
aaaaatgatgtcccattagaaagctgatggataatatatcacatattactcatttgagtatcaggacccaagaaaacaagatgaatttatttaaattgcaatgtcccttgaagcttgtatgagctctctaaagggaaatacttttaaagttcttataaagagagaaatttatagccaagtgtgaaaaatgaagtgcagttttgaggaccagttcccatcctgtcccttcctggggagcaagaggtgtgatgttgatggagcagtgatgaaagcagggggaatcatggcaaacacccgctgtgtgatgattagatgctaggcagtttccgtgctgggcatcgtatattcctttcatttgagaagtggtattgcatagtggttagaagcctcagtgttggacccagacttctaggttcaaatcctgccc

SEQ ID NO: 198921 - DNA, 467 bp, Homo sapiens
aaattatctgggcgtggtggtgtgtgcctataatcccagctactcaggaggctgaggcaggagaatcgcttgaaaccaggaggtggaggttgcagtgcagtgagccaagatcgcgccattgcactccagcctgagtgacaagagtgaaactccgtctaaaaagaaaatattcggggaacttttgcagggcagtgagggagccgctggaacccggctggcggctggccccaggcacagatccttgatccaggctgctgcttggggcctattaagcaagtccgggtgggcgtggttagtcaggccagcagcttccttccctggaaatgctgattgtggtcaaggaactggaaacaaggaaaactagcaaatagattttggggagcttcttggaggccttggtagcctagagcaggtgagtgtgtggttgggaaaaagcaatgtggccctatggtggttttaggtgttga

SEQ ID NO: 198922 - DNA, 269 bp, Homo sapiens
gggtctgtggtgtctgtaagtctgggggcctaggagggagtctcacacaggagtccggtttgatcacagtggatagggtactctacagtgtgcttaaaggcaagggggctctaagaaagagcagccctggtcagtgtgttctgagaaagcagggcagtgtctgagaggtgagttaaaataggagtgagtagtcaccattttgggatattagacaggaagtgctttctgtacatgcaggctggaaatgcacacaaccctcctgccccacc

SEQ ID NO: 198923 - DNA, 276 bp, Homo sapiens
aaatttgcccaaaaattgctacctgaagtataacccatattcttttgtgttaaaccgtgtttattattcttcagatgtatttctaaaaaacatgacatcaattttgctgtgctaaataagtattgtatattacacttttggaaacacttacagacataaagcatttccaacagacaagacatgtacaaataatttcccccagatttttgtatagtcattttagagctttttaacaagggtaagaactttgttgatgagatgtaagccttttttccc

SEQ ID NO: 198924 - DNA, 364 bp, Homo sapiens
gcctacaggacttatgggacaccatcaagaaagccaaatatgcattatacaagattcagaatgagtagagcaagagaaagggcaaaaagcttatttaaagaaataatgacagaaaacttcccaacctggagaggaaaatgaacatcccaatccatgaagcccaaataatccaaatagattaaacataaagatcttcatggagatacattataatcaagttttcaaaagtcaaagacaattaattgtgaaagtgacaagagaagagtgaattgttacacaaaggaaatctctgtaagacattcagtgcatttttcaacagaaaccttgcaggccaggaaaggagatgtgacatatcaaatgagat

SEQ ID NO: 198925 - DNA, 492 bp, Homo sapiens
gcgactgaatgagaccccttatctcaagaaaaagaaacagaattatttaaatgcatgaatctgaatgccgtgcagagagtatatgccatatagagttatatgagaatgtcatgatagtagtagctttttttttcttcttttcttgagacagagtcttgttctgttggccaggttgggagtgcagtggcgtgattgatcatggctcattgcagcctcaatctcctgggctccagcgatcttcccacatcagcttcccgagtagctgggactacaggcatgtgccaccacactcggctagagtgtgtgtgtttgtgtgtgtgtgtgtgtgtgactacaggcatgtgccaccacactcggctagtgtgtgtgtgtgtcaataggatttttccatgttgccaggctaatctcaaactcctgagctaaagtgatccacccaccttggcctcccaaaatgctgggattacaggtgtcagctactgtgcccagccaaat

SEQ ID NO: 198926 - DNA, 375 bp, Homo sapiens
tactggttaagaatagcgcttagtgatgtgaacagtgtggtcttttctttgtcattctgagttactagattaagctccagtgaaacaatgtagttcatttctgatacagtcccaacacaaatggctgtcctatttagatggcattggtcaagactgatatcaagataggtaactataagactaaccttagttaaccaacccatttttcaatcacgtaaggtataataaaatacactctgattattctgtgaactttgattattgtcattaactctgttatcaaatgatcatttgattccattatgtcacctggaattatgtaatttatatataatgtatacagtggtataaaaagaaaatatgtattttggaaca

SEQ ID NO: 198927 - DNA, 461 bp, Homo sapiens
ccacttgaaaggatgacagaagaaatcacatttctccttcaggaatagcaagaaagttaaaagagctttcagagctcagtgacgtctggaggcagagaacagtgagagaggaggtcaggcctggagatgtgcaaaacaattcaggctgaacacccagtgagggatgggtaggttaaggatagattcactggaactgctgcctctgaagtcttctagaaaaatgagtgtcactgggcgtggtggctcatgcctataatcccagcactttgggagaccaaggcgggtggatcacttgaggtcaggagtttgaaaccagcctggccaacatgatgaaaccccatctctactaaaaatacaaaaattagctggctgctgggtgcatcaaaccaacatggcacatgtatacctatgtaacaaacctgtatgttgtgcacatgtaccctagaacttaaagtataata

SEQ ID NO: 198928 - DNA, 263 bp, Homo sapiens
aggaacctgttctacggccagaagaacaagtaccgagcaccccgagggaagccggccccggcctcaggggacacccagacccctgcaaaggggtccagtgtccgggagcctgggcgcagtggtgttgaggggccacattccagctgagtggccttgctctgtgtgagccccgtgcgagggccctgcttgtagctggaccctggaaccttctgtagctaagagggaatcctggccccctccccagaagccatttgtcaataaac

SEQ ID NO: 198929 - DNA, 382 bp, Homo sapiens
gcttctcaagggagcgctgacaccttcatccccaggctttcccacaacggcgagcatcttctaggcacccacttagagcccctcaacagacatgtgtccattcggtcctcgaccctaacaacctagtgttcaccccacactgtacagatgagcgaacagggaatggacgttgagaagcttaagcttctcaacggctaacagctgttttcatcttttaactaatcaactgtcctgtgtgtagtgcccagttacctattggcttcctgacctttctttccccttgtttattgcatagataataaccatttggttgtggataaatattcatcaccaatttaagtttactgagaaaaggggctgggcacagtggctcacgcctgta

SEQ ID NO: 198930 - DNA, 185 bp, Homo sapiens
gctactgccacctcaactgatcttcctttccttgtttgctaaccatttccctgccatgctcaccccgctctggcctctagaccgtgagcgcgatgatggggatcacatgggcttcatctgctccatgtccagcacccagcacagagcccccactgaactccgccagggccccagcctgacaacct

SEQ ID NO: 198931 - DNA, 193 bp, Homo sapiens
agtagtagtagttggacatgtgggtctggaacgaaaggaaaaagtctgagatgaagatagaatttggattaagcatttagtgattgaagttaaaatgtgatgattttctccagggatattatgtggaataagagggtaagggatagagccctgaagtatgcacattttaccctgatgggaggggctgattgtg

SEQ ID NO: 198932 - DNA, 314 bp, Homo sapiens
ctcatttcctagttcatagcattaaatgactacatcaaaaagtctgaaagagtacagcttagacaacctaatgtcacaccttaaggaaccagagaaacagaacaaactaaatccaaacccagcataagaaaagaaatcacaaagatcagagcaaaaataaatgaaattgaaacaaaaaaaatacaaaagataaatgaaacaaaaagctgattctttgaaaagataaacaaaattcattgaccattagtgagattaaccaagaaaagaagacagatgatccaaatgagctcaattaaaaatgaaactggagattt

SEQ ID NO: 198933 - DNA, 345 bp, Homo sapiens
tgggagacgagagtgaaactccttctcaaaaaaaaaaaaaaaagaaaaagaaaagaaatattgaaatgaatgttagatacttaaaataccagaagagaaagacaattagcatttgtggactactgtgccaggggaacacgtattcctgtttaatccttataataaacaacactttgaggtagataatcttaccctcattttacaaaagagaagcctgaggcccagagaagtccagtaacaatctttagactctagtttgcctgtcttttaaaaaccttacttttttcactataccacattttcttcaaagtaaaatttctcatcagcagcataattgctgtgctt

SEQ ID NO: 198934 - DNA, 366 bp, Homo sapiens
tcttcagttaccatcagtggttagagtggaggggacatatcccgagacatgcttggaggagaaggaaactgtgttggttgatatttttcctcaaagttgcttctcttgactgtcaggtggcatatgactgtggggattaaattgagtactgaatatgggcagtgtgatattcagcagctcacactggttcagtgatatcaattatttaagtcctgcatctggccgagtgcagtggctcatgcctgtaatcccagcattacggaggccgaggtgggagaatcacttgagtctgggaggtcgaggctgtagtgagccatgattgcaccactatactcccgcctgtgtaaaagagcaagtctgtgtctc

SEQ ID NO: 198935 - DNA, 523 bp, Homo sapiens
gagtttgctaggacgaatagtaatgaggatgtaagcccgtgcgccatatatgagaatgactgcgccgttaaagctccagggggtttggatgaaaatgcttccatttgctcctgcattcctcttctttagctctgattcttgctacctacactgttagcaccaaagagctcctcccatcatccagttcacttcttcataccttagtcataggacccagtctttaaatcaaggatgtacatttagaacagcacagtacaaaagaaatataaagaaggacacacatacaattttttaattactaggttagtaggttcatatgaccaagttattccaaagataaacatttcccattaactaaatcaagcacaaatcttaaaatttaaatttaacttaattaaaatcaaaattctgttcctgagccacactagtcgcatttcaattgctcaatagccacatatggatagtggctaccatactggacaccacaattctagaaaacaaactaactttcaagaacaattac

SEQ ID NO: 198936 - DNA, 288 bp, Homo sapiens
atttgggttgtgagtattttcaaaatttcagctcagggatatatctttagatcttctactggtgcatctcctccattctgttctctctctggattcctcacgtgaaaagagtctatttcctgtgactattctcatgttactttattctttcatatttttatttttggatttttttgattgaccttcaaatgaatttcttgagttagttttctaatttattaatttgacttctaactaggtccattcattgtgtcagtacctttttttttttttttttttttttttttt

SEQ ID NO: 198937 - DNA, 145 bp, Homo sapiens
tagagtagggaattattgttgatggactggacgcaaccttgaatatgaagtttcaagatacacattcaatgatcttgagatgaaagaattttgttttgatgtaaaagctctcatagcacatgggcttcagaactcagacgttctt

SEQ ID NO: 198938 - DNA, 554 bp, Homo sapiens
ctctgttaattttcactcaatcagatatctaatttgatcactgtattttcgtgtctgaagtatatttttcaagggaatccatgttaacaatactgaactgttctgttaaacttttaaattattgtcagaattttttccttataggtcattcattgtaatggagtaagaatgaatctaaatctggattaaaagattttggtgaattgggagtgttttttccccagactcagaattaatgacttaatgctccctgaagatttcatatctataggcaacatgcaccatcttgctgagttaaaatcctagtaaggattggattaattctccatttctaatgagaagagaataataccaacaatgattctaattatatctcggacttgaagagttcattccttcctaggagctaaaggaaagtctgcatctgttacgtaatttatgcataaagacaaagtcatttgacaaaggttacactgtatgattagaatccaatgtgatagaaattctgcatttttgattctacatttagttctctttgctttaagttcccaatt

SEQ ID NO: 198939 - DNA, 514 bp, Homo sapiens
atatctcagtggattgaatgcagatggagaggaaactttgatcatttgagagatggagtaccagcaagtcctctcatccttcaagttgtcagaggaaataacatttacctgaatgaaaggtcagttgggatggcaaatactgagaagattagagtccctcactttgccctccatgtgagctacccagctccaatgacaaaagagtttgaagtggagtgctttgggagagagtctcagccttctggctcaactgctgctttctgcttatagaaagtattccaggtgctacctttccttcatgttttgcacggctgtatgttgaaaagcatgacctatgtgtcagtctgggttccagcaggaaagaatcaggtaatttagaagagtttaatgaagcgactctttaaaaagatatgttcaggactacataaaacaacaagagattgtgagacatcctgaggtttgcaacagtggggagctttaaccctatgtaggcctgaaggggccaagagattta

SEQ ID NO: 198940 - DNA, 576 bp, Homo sapiens
aaagttggagtaatgtattggtaaaagtactgccaaacagtatctgtgtttactaagtataaacaataattttctaagaataaaataattatgtgaagctcagaattgcttatacagtttgcccttgaacaacatgggtttgaactctgccagtacactcgtggattttttcaaaacatatatttaaaaaattttttggagattcacaacaatttgaaaaaattcagatgaaccacacagcctacaaatatcaaaattaatgcataaaatacatgtagataccagtctatttatgtgttaaccaactgtttatattgtcggtggggcttgcagtaaacagtaagctattagtagttaagtttgagggagtcaaaagttatcaatggattttcaactgcacagggagtgggtacccttaactcctacactgttcaagggtcaactacattagaatacttcattataatactagaaccaatcagaaaatatatctatctatacatgttctctttaaaatcagagaatattttccaattctatctgaaaatgtctatttcactattttacccttactcc

SEQ ID NO: 198941 - DNA, 137 bp, Homo sapiens
gttcctcagtggggaatatgtctgagtttgttcatgtttgtgcttcccataatgactaacatcgtaattggaatagaactgcagtgctgtaagtggtcagttagtaaaggtaatggcagaggggaaagtaagccaaa

SEQ ID NO: 198942 - DNA, 487 bp, Homo sapiens
aaaagagaaacactgtgcctgcttattccagtctttattgcctaactctggctgtcttgagttacatgacttttagttacaagagaaagcatgtgtaacacatgactgtttttgtttttgtttttttgtgatggagtcttgctctgtcgcccaggctggagtgcagtggcacctgcatgatctcggctcactgcaaactccgcctcccgggttcacgccgttctcctgcctcagcctcccgagtagctgggactacaggcgcctgccgccacacctggctaattttttgtatttttagtagagacggggtttcactgtgttagtcaggatggtcttgatctcctgacctcgtgatccgcccgcctcagcctcccaaagtgctgggatgacaggcgtgagccactgcccccggccaacacatgactgttttagcacatagcactatatacataactcattgcattttatcgaatgataatttggaatt

SEQ ID NO: 198943 - DNA, 386 bp, Homo sapiens
cagctccatcaggtcattcatgttcttctctgaactggttattttagttagcaattcctctaaccttttttcgaggttcttagcttccttgcattgagttagaaaatcctcctttagctcggaggagtttgttattacccaccttctgaagcctacttctgtcaattcgtcaaactcattgtccatccagtgttgttcccttgctggcgaggagttgtgatcctttggagaagaaaagtcattctggtttttgaaattttcagcctttttgtgctggtttctccccatcttcgtggatttatctacctttggtctttgatgttggtgacatctgtacggggtctctgagtgaacgtgctactcctttctgtttgttagttttcctt

SEQ ID NO: 198944 - DNA, 358 bp, Homo sapiens
atgttgaaggggatggtaatactcagtctggcatctgttactaagatctgtccccagaccatttgtcttctagagggggttacaattaaaacttgatggactgtctctgattcccatgacaccaactaggtgtacaacaatccgatcctattctgacatcgactaaccagaattagtgtcagactccataggtttaagggctcagtgccacaagacagccctcacttgggacgccagccataagtcctgggtttctgggctacctgcacttttgtccaatttggctacaaattcagaaatccccatggcccatgcctgcttcaggtactataatttgctagaatgactcacagaactc

SEQ ID NO: 198945 - DNA, 1928 bp, Homo sapiens
  misc_feature (17)..(17): n is a, c, g, or t
  misc_feature (386)..(386): n is a, c, g, or t
  misc_feature (761)..(761): n is a, c, g, or t
ggcgggagggacacgcngatgggaacatcccagctggtccaggcctctgctccccccagctcctcctccctggcgggcagctcttctgggctcctgaggtgctgcgcagccccttccctggccctgggacccccagtgcctgagatgaaagaggagttgcttccatggacggtcccagtgcaagctggggggcgctggcctcaggacaccaggcatccaagacatagggacaccagaagccccggctctgcctctgaggtccagcagccccaaagcccctgctcagaagccagcgatgggagggcagggcctgcctgtgggacccatcatgggcgcagcaatcgccaggccctgggcagacagcagcacagcctgtgagtccaggnctggggagcaggcaggtgacaaccagtgtcctactttcctgcattaaaacacccaaatcaacaggacggagaaggcccggaagaggggacctgagggagccagccgggcgctcagcctgcttcgctgggatgcttgtcgaggtcgggacggcaccaccaaactcacctctgtgcgccctgcggggcccaggagactcggtcctccctgggctcccccaggcctggggtggacgttggaataaagtggggacaacacgatgagagaccccagccctggaggtgccctcggcaaagcccgagatcaaagctgggagattcgtggctggacagcaccacctggtggacacgttggagattaccaaagccgaacagtcnattcgttcttggttctgggattttcttaattgggtcttagctggggcttcctttccctttccccagtagcaggggctttgtgactatcagaaacacctgccaggcctgggcaacatggtgagaccctcgtctcttaaaaaaaaaaaaaaaattgcctcccaagacacatgcctgtagtcccagctacttgggaggcctaggagagaggattgcttgaggctggaacgttgaggctgcagtgggctatgatcaacccactgcactccagcccgggtgacagagcaagactctgtctcaaaaaataaataaacaaaaataaagaaagacatagcctttctcttacagacatggtcaggcatcatggaaatcttattgcagaagttgctcgcccttcacccctaagcctcacctctctgtttcaggggatccgagtttggggaaggaaagtctatggggccatcatttctcccttgtggctcctgcgcccgcagccatgggcccctcacactggggctgggtgcctgagcagagtccctgtccagcccccaccaagctccagcatcctggacacctcatgccatccctcctggactttgtgctggggatgaggtcaatttgagagcctccctgaggtctggtcactcctgcacaccctccacagtgggcagaatggtgccccccaaaaggcccacatcctaatcccgggactgtgaatgggctacttttcatggcaaaagggacattgccagtgtgaccgagggtcctgcgatgggaggctccccggcatcatgcaggtgaacccagtggcatgacaagggcccctgtgagacgagaggcgggggtcagagcagacctggtgcaaaagcagtgggtgtggtgatgccccagcctgggactgaggcccagaacgtggtggccttcagaagccgggaaaggccaggagatgcatctgcccccagcctccagaaggagccagccctgctgacaccgtggctttagcccagtgcggccccgtgggacttctgacccccagaactctaaaataataaattggcattgttttgatccttctgtggctgatatgtgtgatgagggggttttcacactcttgcgtgggacgtgcaacctctttagaacagtggcacattacctgtcctacatggggga

SEQ ID NO: 198946 - DNA, 526 bp, Homo sapiens
atttaggcaagatgatgtgtgcctgtagtttcagctactcaggagactgagacaggaggattgcttgaacccagaagttcaaggttgcagtgaggtgagattgtggcactgcattccagcctagatgatggagcgagatcctgtctctaaaaaaaaaaaaaaaaagcaaactataaacaacccatgcaattttagctaagtttccacaacaataaacacgcatctaaaataggaaagatgggtgatgtatgtaaataataaaattaagatgaatttccctttagatattgcagaactctttaagataatagagtgatctgactgacattaaatgctggaccaatggtgaattttagactggattttaacatgattcttgggaagaaaaaccttttaaatattagggatgtggtagctcatggctgtcatcccagtcctttgggaggctgaggtaggaagactgtttgaggccaggagttcaagaccagcctgggcaatatagcaagactctcggctctacaaaaat

SEQ ID NO: 198947 - DNA, 764 bp, Homo sapiens
agcgtggtgcactgagtgacaagggccatacatttcttgcatataacatcacccactctaatatgctctatgaaataacactctatggaaaacagtgaagaaagcagaaaaacacgaaagtaaaataacaaaaaaattaaaaactcctgcattccaaaggcaaccaccagtaacaatttcatatatgattttctagtctattcaataagcaaaccgtttgtagcctactttttagcttagcagatctagagcatattcagaggtcgatatttattcctctgtaacagattatgtaatggctgcataatccttctatcatctaaagttaccataatgaatttgaccaatccctattggaggacatgaggttgtttccatttgccaattgtcacagtttactgtggttaaagttgttatgctcaataataacaataagtaatatttacaagctatttactaagcaatgagcactgagtaaataaagcacttttcatgaattatgtcatttaacctctcaaagaactaaatgagacaagtactattattatccttgctctgtctgtgaggaaactgagccttagcagcataagtagtgtgcccaagccatgcaactctatatcgagttctacaaataacagctattacaactatggtcaactctgcacagtaacagggatatcaggggaaacatcactgagtagatgtcactagaacctggtctctgttgcaaaataatgcctgacctgttctcttttgaaaatggc

SEQ ID NO: 198948 - DNA, 733 bp, Homo sapiens
atgacacagaaaataaatgttgctaaggaggtggagaagttggagccctcatgatctggctgctaggaatagaaaatgatgcccttgctgcggaaaacaatttggttgttcctcacagaatgagcattgggtgaaaaatgaaatcaagatggaaatgtaaaaaatgtcttcgaactggatgacacaacctatcaagacctctgggatacagcaaaggcactgctaagagcaaagtttgtagtcctaaaaacctacatcaaaaagtctgaaaaagcacaaacagacaatctaagttcacatctcagggaactagagaaacaggaacaagccaaacccaatcccagcaaacacaggaaataacaaagatcagagcagaactaaatgaaattgacacaacaacaacaacaacaaatacaaaacataaataaaacaataagttggttatttgaaaagataaataaaattgatagaccattagcaagattaaccaagaaaagaagagagaaaatccaaataacctcactaagaaatgaaacaggggatattacaactgacaccactgaaatattaaagattattcaagggtactatgaataccttttggcacataaactacaaaacctagaagagttggataaattcctggaaaaatacaactctcctagcttaaatcaggaagaattagataccccaagcagaccaataaagcaagcagcaagattgaaatggtaat

SEQ ID NO: 198949 - DNA, 666 bp, Homo sapiens
  misc_feature (660)..(660): n is a, c, g, or t
gtgcatgcctgtagtcccagctacttgggaagctgagacaggagaatcacttgaacccaggaggcggagatttgcagtgagccgagatcacgccactgcactccagcctgggcaacagagcaagactctgactgaaaaaaaagaatggcattcatggcctgctatataacttttctagaatataggttggcaatgtctgtcaagagtcctaacctaagtaaataatcaacaaatatattcaacactggagaaacagctaaataaaatttggtatgtcatcatgatggaatgctatggagtggtttttcttttcttgacttttaataacttaggggaaaggtgtaagacatcagaaaataaagtaaaatgaaataatataatctcaactagatataaatgcacagaggaaagattggaagacactatcaaattgtaagtagagatttttgtggtggccttatgggccataggtttctttctttctttttaattgtgggggaaagtccacacaacataaaatttacttaaaaatggttaagatggtacacagttgagtagtgtcaagtacattcacatgatcataccagcctatctttagaactttttcgtcttgtaaaactgaaactccataccctataaacactaatccctccttcccantacacc

SEQ ID NO: 198950 - DNA, 193 bp, Homo sapiens
catccccaccggcagtatgcaagagttgctttacatccttactaaccctttaatgtcagattttaatttttgtcaactaataaatacgatgtggcatcccactgttttaatttgtattgccctgattacctttaaaatattcttttaggactattggccgatgaattgttcatttattttgcttgtttttttt

SEQ ID NO: 198951 - DNA, 158 bp, Homo sapiens
gctgatcctcttgccttggcctcccaaagtgctggaattacagccgtgagccactgcacctgaccaacaacactttcatgtaaaacccatattgacaatcacaagggtagacacattggatttgaagttttggtttgtaattagttactattcatgta

SEQ ID NO: 198952 - DNA, 634 bp, Homo sapiens
aggctggagtgcagtggctcaatctcactcactgcaacctcctcctcccaggttcaaacgattctcctacctcagcctcccgagtagctgggattacaggtgcccacaccatgcccagctaatttttgtatttttttcagtagagatggggtttcgccatgttggccaggctggtcttgaactcctgacctcaggtgatccacccgcctctgccttccaaagtgctgggattataggtgtgaggcaccgcacccagcctattttgaataggtaataacatttcatttggttcaaaattccaaaggcacaaaggttgttgtatagtgaagtttgcttcctatttctgtcctccagccacccaattctgctacccagggcaactgtgtgttcttccagggaaattctattggtattcaagcaagtaagactatactcccccaccttttttacataaatggtggcatactttagacatggtcctgcttttacttatcttaatccaaattgctttttggcatatggagtacagttggccctctgtatccgtgggttctgcttctgcagattcaaccaaccatcggttgaaaatattcaaggagagtgggcacagtggctcatgcctgtaatcccagca

SEQ ID NO: 198953 - DNA, 389 bp, Homo sapiens
caggctattatattataaggttaaggacttaataaaaagttttaggccggatgcaatagctcagctttaatcccagcattctgggaggctgaggcatggggattacttgagttcaggagttcgagaccaaactgggcaacatagtgagactttgtctctactaaaaaacaaaaaatgaggctggaggaggtcaagactgcaataagctgtgatcataccactatactcccacctgggcaacagagtaagaccgtgcctcaaaaaaaaaaagccaggcgccgtgcctcacatctgtaatcccagcggtttgggaggctgaggtggacaaatcacttgaggccaggagtttgaaaccagccaggccaacatggcaaaaccctgtctctact

SEQ ID NO: 198954 - DNA, 510 bp, Homo sapiens
tttaatttggcagcttggaaaatcttttcaaagaaatggcttttaagtgtatttctaagaatggttaggagtttgttaaatgggaaatggcaggaagagaattccaggaaggagctctcgaattgcataaagttgaacaacattgaacaaggtgtgagccttggtgaaactgaaggagggctagtggggtaggaatatagtaagttgaggtaaaggtagaaggaagcagtagccaggtcatggaggaaacacaatgcctttgagaagattttaggccttttggaggaaccaaaatatccattagtagttttagacatacttcattaacctgccctctgcctccaatgtggatacactcctcactccactcaagctacagtaccttctactgctctggccctaccataaggacatcctcctcatccatttcctactccagcaccctgtgctaggccacctccctcactcttgggctgtgaggccatcactgtagcatcgtcctataaaaat

SEQ ID NO: 198955 - DNA, 485 bp, Homo sapiens
ttccactagctaacattttttccataatatctgcatttagcacctctgacccacacatacttagatatatactcctacccttcattgaaaactgttaactcctctgccaatattttattttattagcaactaagaaaagcctcattgactttagaatactaaaaagatattatatactaaaaagctttctagccaattagtttatttctgatttccccatatgtgtatattccacttggttgtggaactttctcagcaaatattttatcactgattatcccactattgtgtgtactcttacttttggaactttttattcttttttttgtgccctggaattcacatttttaatcctgaataatatctaaaagactaatactgtcaagcttatgtgactaacaaagctctattgtggtttggatctgatgggaatctgtaaagtagacagaaaagttgtcaaacatagtagttgggtgttttcacta

SEQ ID NO: 198956 - DNA, 423 bp, Homo sapiens
gcataatccacaataacataacatttaaaagcaaaggctctgtatcgattattaacatgaacaatttcctttgctaccatactccatccagataaagaactgaatgttcctctgaaccttccaattaatttcctccattgtgatgaatcctccatagatttattggcaaaacattatttctaagtgttctccaccctactataaattgtctcaaaatagtttgtgtctaccaacaaggtagtatagactataaacttaataaatagtaattattgataattatgagataccaggatgctaatgaaactttattgcttgtattgagaaatgagagtataaattgagtataaaatgaaaagacttgaatgcttagtaaagcatataatgtagctaaagttattaaacagatatatgtatatgcca

SEQ ID NO: 198957 - DNA, 166 bp, Homo sapiens
tcccatttagaggaacggggtaggaaagagagtcctctagcaaacaagggtgtcccattgctggtggcgggtgcagcggtggtagataaagaatcttggctcagttaatccaagatgcaagggaggagtcctgagtgactggcagctttgtctccagtaacagccc

SEQ ID NO: 198958 - DNA, 495 bp, Homo sapiens
gagccctatgtgctctgcccctgtctacagacctgcctctcaccgcatgcccacagtcaccacatgtcagccatggcaaactacctggggacccccaagcgacctgcttgtggggctctgcaccctggtgccagttcttcttttagcctggggtcctccacctgccctctgcctcaatggctcagtagagccttcagagctcacatatcagctcctccaaaaagtggtgccggaccctgcctcccgtccctgaaaaccgagcttgcactgtcacatttaacatgttgtgcctgacctattcttctacacttctgtcctcgtgacgtggggtctgctggaggccagtgaatgtgaattttatctttgtacttgcagggcacaacacgacactaggtatggattagatgctcagtaacaattttaaactggtttaaaagtaattccaacattgcagaagggtctaaggcaaaaaatgaataaaagtttcctgccact

SEQ ID NO: 198959 - DNA, 375 bp, Homo sapiens
tcctccatgaaggcttctttgctctccccagccctgggaagagataatcccacctccctccatgcaaccattgctccccttgaacttacttacgtgaatgcatctagcacacctcattagctctcagagactgggactaggtcttctctgcctttgtgtcccacgcttccaacacaagcctggtacacagaatgccttgaatacccgcctgtcaaatgaagaagataaaattgagacacattgagccatccaggggcatgcagggcaggtccagtgcagcaggctgtggaaagacataaacccgcctgcagcctctctctcacccccacctcctgccctagagagatgaaaatacaaaattacataaaaaatcaa

SEQ ID NO: 198960 - DNA, 1397 bp, Homo sapiens
atacaaaccaagcactcggtcaagggctactgagggaatgactgcaataaaaagcaatctctgtgtagacttcatccttgtcaattgttagcgactttggtcaagaagatattttggaaaataccattcactactctacattttctatggtgctgttgaaaaataaaaaataaagctttgatctggaaagctctgattctcattctcattatctttgtgatcgtggaaaggatgtttattctttccgagtatgttttctttcctctaaaatcagagactacattatctcttatatcttgtcccatgctaaaattctatacatcttattctaagatttcaacaatatctatagaaaaagacaaaaagactaggaattatgagaagagagagagattataaattctatatgaggaagtttcatctaaaacttatcttctcctatcaaaagcaagttgtagatactcttagttaagccacacctgccttgtaaatgccaaacaggtccattttaaagtgtagtaaaaactacattccattctatttttaaacagctttattgagaatccacatgctatgcaatttacccacttaaagtgcacacaattgagtgatttttagtatattctcagtttgcagctatcaccactattaattttagatcatttttatcactcccctcaaaaacctcacactcattaacacttgctcctcattccctcctccagctctgggcaacaactaatctactttctgtctgtatgaattatgaattttcctattctggacatctcatgtatatggaataatacaatatgtttgactttttgtgactgatttctttcactaagcataatgttttcaaaggttatccatgtcataccatgtatcgataaaattcatttctttatattgcttaataatattccagatcctttgcctgtttttaaattatcttgcctttttactattgagttttttgtatattcaagatacaagtttcttatcagagatatgatttgcaaaatttttatttcgttttatatttcctcctggaatgcatttttttattgccatgaaagtagagagcgggtgctaagataaacacattgaggatttgatgaagctgtcttgagggcgaggagaacactgcaggcagagggagcagcatgtgcaaaggccatgagacaggaatgaatttgctgggtttaaagatgagcaggaaggccagtggaatagaaagatggtaaggtagagaagggtaggagacaaagtctgggaagagggaaggggccggtttacatacaccttagagaccacattaaggagtttgaatttcattcagaaagtagttgagtggttttgtggattttagcagcggaaatggcgtgatccaatat

SEQ ID NO: 198961 - DNA, 765 bp, Homo sapiens
ttattctactaacaatatctaatttatatctatgataactccccttcgtaatattctaaatcattaacacttgctcctcattccctcctccagctctgggcaacaactaatctactttctgtctgtatgaattatgaattttcctattctggacatctcatgtatatggaataatacaatatgtttgactttttgtgactgatttctttcactaagcataatgttttcaaaggttatccatgtcataccatgtatcgataaaattcatttctttatattgcttaataatattccagatcctttgcctgtttttaaattatcttgcctttttactattgagttttttgtatattcaagatacaagtttcttatcagagatatgatttgcaaaatttttatttcgttttatatttcctcctggaatgcatttttttattgccatgaaagtagagagcgggtgctaagataaacacattgaggatttgatgaagctgtcttgagggcgaggagaacactgcaggcagagggagcagcatgtgcaaaggccatgagacaggaatgaatttgctgggtttaaagatgagcaggaaggccagtggaatagaaagatggtaaggtagagaagggtaggagacaaagtctgggaagagggaaggggccggtttacatacaccttagagaccacattaaggagtttgaatttcattcagaaagtagttgagtggttttgtggattttagcagcggaaatggcgtgatccaatat

SEQ ID NO: 198962 - DNA, 431 bp, Homo sapiens
tcctattctggacatctcatgtatatggaataatacaatatgtttgactttttgtgactgatttctttcactaagcataatgttttcaaaggttatccatgtcataccatgtatcgataaaattcatttctttatattgcttaataatattccagatcctttgcctgtttttaaattatcttgcctttttactattgagttttttgtatattcaagatacaagtttcttatcagagatatgatttgcaaaatttttatttcgttttatatttcctcctggaatgcatttttttattgccatgaaagtagagagcgggtgctaagataaaataatacagaggttattttagtttggggaacggggtcaagaaagtaccctgagacacattgaggatttgatgaagctgtcttgagggcgaggagaacactgc

SEQ ID NO: 198963 - DNA, 872 bp, Homo sapiens
cgggagcaccggcctacatttcaatggggcctctggaattcagcggaatctaccaacatacgggactcagggaagagttcagcaaggataggggcccaggtgtatggtcaccaagcccacccagagagaaggaatgctggagtgggcaagggtgcctgtcccccagcaggccactcctggcaacaggccaacgccacgccctgaggatgaacagagggcaccaacaggaacctccacttctcactccagccccatgtgcccaggcaaaccctctcccggggtaccagctcttctgagagttgagtccggatgcctgtggttattcttccttctctggaagtttcctcgttccaggaccgcctctattctgaaccacatgaggatccacttaataggttgtggcttctcgatgaaggtctcactcttcatcccaccccatcagtttaattgaggaaattactcagactctcccaatgggaaattcagcttcaaatatgtccttgttatgccctttacctcagggcagacacggaatgtgctgttatctgggttgtgatcccacttctctctcaagtcctaaaaccgaaatattaacatgcacattgataatatgcacaggattaaagaacaaaaatgtcagcagaagcagcacattccacgggcattccaaatttcttgctattataaaatatcaccctgattaagacatgccaatcactccaagccaagtagagcctccacccctaaaagccacctcacctgatcatccaacactcagtgagaacacactctcttgtgatgacaccatcctcgcctctccaatatcagagtgaccttcacactccgcatcatctcattttggctggactccc

SEQ ID NO: 198964 - DNA, 240 bp, Homo sapiens
agtaactgagactacaggcacccaccaccgtggttggctatcagtgctaataactttctgaagctccatgcctttaactccagcgttctttacttagtgttttgaaatatctgctgcccacaaatcctagcacatttctgaagttaccaagactttaagacctcccatactgctttttctcccatcttcccttctcagtgttattagcctcatagtttcaagggcccagcccagtatcca

SEQ ID NO: 198965 - DNA, 312 bp, Homo sapiens
ttagctcattgatctctacatctgtggcacagctattagaaccgggaacttccctgggaattctcttcacttctctcctgttttggatactctaatttctggatgttgttttgctggagtgcattttccaataattttttgagagaggatacatgggaggtatatgttatacccagaccttgaatatcttcagtgatgtctttatacttgccggtttgactgggtatagaattagaattgtaggttggaaataatttttccactgggtattgaaagcacttcatcttctagcttttggaattgctgttgaga

SEQ ID NO: 198966 - DNA, 276 bp, Homo sapiens
aaagtactaaacactcagaataaagtatgtctactagcctaagcagcaaacagctctggttaatagattattagaggaacaaagttactctattttgcctatattatgccaaataatactttatcttagcttatattttccacttaaagaaataactttgccaaatacaggactcctattttctcaaaattcttctaagagtgctacaattaacccatactgaaatgcaccacacatagggtgaccatggccagaacaatccccgttctgtgctgt

SEQ ID NO: 198967 - DNA, 139 bp, Homo sapiens
gtatatcattcgttaaatcggccaccccctactttgaaatgggaaattggaattttggggaattatttaccaatttacttaataaatgtaagataatattaatacaaaataaatatgcaaggctgtctgtacatggata

SEQ ID NO: 198968 - DNA, 477 bp, Homo sapiens
gactattgatgctccactgtaccagacacctcaaatacagaataactccattttatttaagtgacttcagcatctgaggattttaatatccacaggggtcttgaaaccagtccccaacagatactgtgggtcagctatacacaatcttatttaaacctcttgccaactctaaagagtaatggagagccaagtcatagatagctcagagaggtcaagtcgcttatccccaaagtcctgcactttttgttcctgctgtctcctttatgatgaaggaaaacggatcttaggtagctaacttgcagccattgactttgcattcagttgtatggttaaatccacttgtgatgggaaaatggctctaatttagctaacttgaatgaatagatcttcattgctagttgtctaatactccataatttcgataccctacgcctccaaaaaaacacaaactctcttgctgccataactcatgaaaac

SEQ ID NO: 198969 - DNA, 776 bp, Homo sapiens
gtgttggacaaaagcatgaactggaaaacacctatcaggtttagtggcagacctctgccaaaggagttccaggatagcagtgagccaagaaactagattgcagtgcattgaggagggaatgagcagctacgaagaggagggtgtctgtctctttaaacccttgcctgtgaaaggctgacagtacagaacactggctggagtgaggctgacattgacaggaagctgccgaaagagagagggatgctggagaaataaaactcaacttatggcactcacatcaaggaagtgggaagggatggatccagagggacaagccaatggagacgggcgagcagggtaaggagatggtatcctcctccttgatggagaagctttttccaagaacaatggaataggtgtgcggggcatagggagacttggaaggacccccaaagggaatagaaaaggagagcctcttggccactaggatggtgttagggagccaggggaggttggagcctctctggaagtgccctgtggctgcccaagtgaggggagacaatgagtacacatgtgaagaaaggatttcctgtgggaaaaccagattcatgtccttcctgcccagagttatgttcttcaaggagttcagtcctgcacacactagtgaataatccttataaatgtccacatatgccccccaagtacgtctaccaaacatagctcagtcttacgtaaaacagtgtacacatgttactaatcagatgctctcataaggaatcatgccattttgagagggc

SEQ ID NO: 198970 - DNA, 404 bp, Homo sapiens
gggactccgggccgcagcgccgccgagcgcgattgcccgctgagattcggcgccccggggtgcggcaagcttgcggtttcaggtgctggctaggcgtcttggtgcgctcgctggagtgccgagagcatttgggaaacttaacttctcgcccccactccttgctcccgactttcgggtagaaaagcagttgccgagttgttttatttcctcccccatcggactctgtaaaaatagccgtgcgccggggcggcagagcccatctctgccgcaccgctgccccgggtcggcagagcccatctctgccgcaccgctgccccgggtcgggtgtggacctaaaaatacccggcggtcccaagcctgcgctgggggtgcgggcgggtccggccgggccgcagagggcgtca

SEQ ID NO: 198971 - DNA, 381 bp, Homo sapiens
agtgattaaaaaaatgtgatacatagcaaactacagaccattctgaataattagtggtgcaggaataatgccatcagatgtacagatattacaaaagggaagagattttgttgttgaaatgtttctattgatatgaacaacaaactgtgtctcttgcatccagaggtatgctaagaaaaagcatgagctgatgcattactatatttcttgaagaaaatttgtttgcagcaagtcaaaatttctgtccaatttccaatttgtaaaataaaatgtcttgaattatctatgcacatctcaagtttgttgaggtctttaaaacttgaaaagcacaaaaaaagtttgttttaataccaccaggatgaagatgatctccacttttcc

SEQ ID NO: 198972 - DNA, 573 bp, Homo sapiens
catataaatgactaccccactgtatactacccaagattgatgattgtcatattgaaaatctttatgaattcaacagatttttaaaaatcatgttttgttactttaatttgctttttttttattaccactgaagtcatgattttaattttttattagccatttgcactatacctcttcagtgcaataagttaaattagaacctggaaaacaatcaagatgtttatcagagcaggaagagtgaacaaattaaggcacatctcgactgtggagtactctgcagatgggtatgaggtagacctctgtaatattgtacagaaagacctactattaatttactcatttataataaggacccatacatctataaaatactacttttgatattttaaatcctaaaaaatacataaaagcaaaaattattcataatttgactccattttgaattaaatggaattttcttttttatttttctatgtaaacaaattatacccaatttaataaacatcagcaaactctatttacttgaggaatttcttttttcagaaaacatgaagtttaatcaaaaaggttgtt

SEQ ID NO: 198973 - DNA, 290 bp, Homo sapiens
ccattcttatcagggaatagtggcaactctcttgaaatccaggttctcagatgccagctaagggccatccttgaaggcaggcctttttaagtataacagtcttgggcctcaaatgtaaactctatatcaccttctcaaggcatttttctgttacttgctttttggtttcttatatgaatctcactttttttaaaaaatacctcatactttttgctgaaacctacaaattttagataatatattgcagtgatttctggatactgctaccccctcctctactgtggggctca

SEQ ID NO: 198974 - DNA, 651 bp, Homo sapiens
gttgccaaaattataaaactttacactaggtaaatgtagcagaaaaaccatgcccttcctctatcattacacactgcagatccagaagcatttatgagtcctacaattacctgacattataatgaaaaaccaagattaataagtaaaagtgaggctgggcgcagtggctcatgactgtaatatcccagcactttgggaggccgaggcgggcggatcacctgagatcaggagttggagaccagcttggccaacatggtgaaatcccgtctctactaaaaatacaaaaattagcctggcgtggtggtgcatgcctgtactcccagctactcgggaggctaaggcaggagaatcacttgcaccggggaggtagagcttgcaagtgagccaagatcgcgccactgcactccagcctgggctacagagccagaccctgtctcgataaaaacaaaaacaaacaaacaaacagaagaattaaaactgaatttaatctatttcctcctacaaaagatttagtgattaagcacttaagagctctagttcaggggtccactaatttttttctgtaaaggaccagacaatactctaggctttgggagccatacggtctctatcacaactactcaaaaacaaaacatgcacagccataacgaa

SEQ ID NO: 198975 - DNA, 390 bp, Homo sapiens
ttggattcactacaggagtttgaaagtacagtttttatgttcactttaaaaaattataaaaattatatataatataaatttaaaaggttgttacaaattaccatttaacaagcaccacgtttataccaatgaactcaataataaataagtgttgatagaaatcttttaagaccagactaggctgggcatggtggttcacacctgtaatcccagcactttcggaggccaaggcgggtgaatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggag

SEQ ID NO: 198976 - DNA, 416 bp, Homo sapiens
gtagccagttgttgttatggaaaattataaaactattttagatttaaaattacccaaactttgccttgtttcattctgtttttttttttaagagaagtttgaattatttaaaattacttctcaagataagtaaaaacaaaagagactcctacttattgcttaattggtgatgcacatttgctttaacttagttaattttcacgaagtagcaattacaaaacagaccaaactggcgctgattaactaggatcaaaatctaggtcttttttctcttggcatcattgtctagacttccaggcttttggagctatattcacagtaattaagtgagaagacatgctcaaaatgatgccaaagaagtgaggtaataggtgttatctgcctgctgtttctggatttcatttggctctctgttt

SEQ ID NO: 198977 - DNA, 460 bp, Homo sapiens
gcttttcatcttaggagactgaaatggatctaatgagcccagcacttccttgatttcctcgaataagttttccacaaaaggcaaagacaagtgagactcagccccatttctaaggcaagcccagtggagtcactgcctttaaatgctatccacaaggtatggtcagcttcatttgtacaatgcccagggcatccaatgaagaggagaaaccttcatctctgcttcacaggctgaaccgacattctgtggacattgattccacctggcctccactggaaaacaaatgtaccctacatccttacccagaaaaaagtcctctgcatgcttctcctgtgcaagaggggttgttcgggattacccaggaatggggtgtcctggcatgacagaagaattggatgcagcaattgcagattcagaaagaatactgcttaaacaataaagaaaagtcatcaattgtaca

SEQ ID NO: 198978 - DNA, 550 bp, Homo sapiens
aacagatgcaggcctattcagattttctatttcatgtcagtcttggtaaattgtaattttcaagatatttgtccatttcatctaatttttctaatttcttggcatgaagttgttcgtattttatccttttcacgcctctaggatctgtagtgatgtctttcctcatgttgctcaaagaaccaactcttttggctttgttgaagttatctgtttgttttcatggatttctgttccttatgatttccttgcttgcatttatgttgggtttatcctgttactttgtagcttcctgaggcggagccttaggccttgattaacgtgttgtactagtcagcattctgcagaggaacgttgccattatctgtgtctctttctaaaggagatttgttatgaggaattggcccacgtcattatggagacggaatctcatgctctgccatttgctgaagattgaggaaagcagtgggataataacagtccaaggacaggaggagacacgtggccccgctcaggctggcaggcgagaaggaaaacccaggccaactcctcc

SEQ ID NO: 198979 - DNA, 574 bp, Homo sapiens
tttgattaataccgtgtcaattgagaattttctccttagctttttctcccattgtttttcccaaagactagcttctctggccacctgccactgattgagttttaggagttcaatggcatttgtttgtttaattcacttgatgtattccaaatgcccagaccaatgcatggtacatggtagatgctcaataaaaaatcatcgaatgaatgaaaaagaaaccataacccagaatattcagaggggttaatacacattaccaatgactagtactcatgtttacaaataattcatagggtatatcttacttgtagtaccaaaggtagattttgttttatcaatactgggcttaagaacatccttcagtagaaatagcaagtagacatatataaaagcagaaactcttttccttcccactttgatgcagatttcatttctactctagcttttccaccatcactgctgaccaactttaccaaccactaacccaggtgatgccatacggatccagcagacccctcctaccagctcttcctcttcattttcctcctggatctctccaaaggcctcctaactg

SEQ ID NO: 198980 - DNA, 148 bp, Homo sapiens
cctatatatgtgtgcgtgtgtgtgtatataggatactatatatcctattcgttctgtccctctgagagaaccctaatacagattttggtcccaggagtggttctagaatattaaggatggagttatttccttggttttggagtctaat

SEQ ID NO: 198981 - DNA, 571 bp, Homo sapiens
actacggatccttaaaggcgagttgagtaactactacaagagactgtatggcccaagaattgtaaaatatttactatctgatgctttcaagaaagtttgcaaagcctgctcttgaaaaggaatggaaggaagaggcgaggaggaaggcaggaaggagcagagagggacacggggctgtattcaaacatctgttgttaagaaagagaaattcaatttatttggcatggcccaagttatcaaactaggagcactccattgaagtttcagaacaaacactgtgctgaatataaggatgaccccatctgtaatgcctaaccttgtttttactaattttgttggtagactttccttttcttttaatcacttagccttgtttctacctgaattgactttcttttagctaagagagctagatagactttgtcttggctttttcactggcagccccttcctcaaggacttaacttgtgcaagctgactcttagcacctctaagaatgcaattaagtgataagatactgtgggacgagcaatatccgcagttactaggaatttgtctgattgataacgcc

SEQ ID NO: 198982 - DNA, 425 bp, Homo sapiens
tcaaaaataaaaaagtcagcttctgcagataagaaggaaccagtgtaagaacaccatgaatatgaaaaaaacccagtgtttcaacacttccaaaagatcacactagttcttcaacaatggatccaaaccaaaatgaaaattctgaaatgacaggtaaataattaaaatgtgaattgtaagttcaatgaggtcccagagaaatttgaaaaccaacacaaagaattcagtaaaacaattaaagatatgaatgaaaaaatgtatgtaagagatactttttaaaagatcatgcagaatttctgaaaataaaaaattcactgaagaattacaaaatacagttgaaagcttaacaataaactaaaccattctgaagaaggaatttcagaacttgatgacaattctttcaaattaacccagtcaaacaaaaa

SEQ ID NO: 198983 - DNA, 406 bp, Homo sapiens
cccccaggttcaagcaattatctacctcagcctcccaagtagctaggattacaggtgcctgtgaccacacccggttaatttttctatttttagtagagatggggtttcaccatcttggccaggctggtcttgaactcctggaaaggtctttatttttaatatcctggatgctaattcttacttgtatatatgcaattatttttttctagtttataacttccttttctttttgttgttatacaaaatatttaatatgatttttaattttaatgtgagatttgtaatcttttcctctgtgctttttattcttttgcatgaaaaatccttccatatcccattatcataaaaatattctcttctcatctagtagttttgtggtttgttttttacccttatgtctttcatc

SEQ ID NO: 198984 - DNA, 369 bp, Homo sapiens
gctgaatggtgtgtggagagtggaaaggggcaacactttgagttccttaacaaactttagaatataaggtcaggcgcggcggctgacgcctgtgatcccagcactcccggaccccaagacaggatcacctgaggtcaggagtttgagaccagactggccagcatggtgaaaccccgtctttactaaaaatacaaaaaaattatccaggcatggtggcatgtgcctgtaatcccagctacttgagagactgaggtaggagaatcacttgaacctgggaggcagaggttgcagtgagccgagatcgtgccactgtactccagcctgtgcaacagaacgagactctgtctcaaacaacaacaacaacagcaa

SEQ ID NO: 198985 - DNA, 275 bp, Homo sapiens
cagaggatcgcttgagcccaggagttcaggaccagcctaggcaacatagcgagaccccatctctacaaaaaatagaaacagtgagccaggtatgattcatgcgcacgtagtcccagttatgcaggagactgacgcaggaggattgctagagccccggaagttgaggctagagttaagccatgatcccgccactgcactccagcttgggcgacagcgtgagaccttatctcaaaaaaaaaaaaaaaaaaaaaagttacatggatgtaagctaggga

SEQ ID NO: 198986 - DNA, 447 bp, Homo sapiens
gcatacatctccttatgctcatccctccttatgctcatcctccttatgctcatcctccttatgctcatcctccttatgcccatcctccttatgctcatcctccttatgctcatcctccttatgctcatccctccttatgctcatccctccttatgctcatccctccttatgctcatccctccttatgctcatccctccttatgctcatccctccttatgctcatccctccttatgctcatccctccttgtaatgggtgctctctgggtccagccagtccccagtttgtgggtcaagccaggagatggggaagcgagactagaatgagctgtgtccctgagatgctctgtaggacaacactggaaactgtgctgcttcaaggatccaagacggtgtggctgaacacaggctgaagtgcaccctccatctctgggctcagagtgaggag

SEQ ID NO: 198987 - DNA, 558 bp, Homo sapiens
ctagaggaccccccgctgtcagtggaactttttcttcatgaaacatttgaaagtaaattaccaacctgatgctctgtcacgttaaacactttaggatttattttctacaaagacattctcctgcataacaacaaaatactcatcaaaatcaagaaattagccagtgccagtagtcccagctactcaggaggctgagccaggaggatcctttgaggcttggagttcaaggctacagtatactatgatgatgcctgtgaagagtcccatactaaagactggacaacaaatgagattctgtctctaaaaaactaataattacaaaaaataaaatttcttttcttccccctaaaccacagaattttttaaatcaggaaattatcattggtacattaataaccacctaatccctaaaaccccattagaattttgccagctgtccccataaatcttttttccaatttgttttgctgtgttaaaatacacataacatttattatcttaagcattttatatatacagtttagtgatattaaatatattcatactgttgcacatcca

SEQ ID NO: 198988 - DNA, 361 bp, Homo sapiens
catcgatctgctaaaattttagcctatttttttccagatatgagtaaaggtttgcataaactttatttgggagagaatttgtgtatatgtcatttgtcgtgatgtaatgtaagaaatcaatcatttgtatactcttacccttggtataaataaagtcagtgtttacacttggacttggtagacgaatgagtacaaggagaaacctgatattttactttggattttgaatctctagttaaagagaaagcaaggaaacctatttttgtgtcttttatggttaagttctgatttccatttgaactcactgcaaacactaattattctgtatgatgggggaatgctgccacttgttaagttatta

SEQ ID NO: 198989 - DNA, 751 bp, Homo sapiens
aagtcccaatttagctttggaatgtagccagcaaaggcctgggaaggcagcaaggccccaaggcctgactcagccagcctctgtctcaaccactgccctgtggccactcttcccttcactgggggaagggcaagctcatcagcacagctagctgtttactgctgatgagctcactagacaaacagcatcttccatctggcccagggctgggctctggggaccaaacaagctccactgcaggtgtatgagagggatgaggggtaaggccattgggagagtgtcatttgaggggagtcaaaaccccagtggcatacaagtatgagcccacacacaggcactcacttttgcaccagctgaaattcccatgactaaggggatgtcttaaggaccttctttagaagacatatattttggaatcagaaaactcaagctgggagggttcttctggactatctagatcaagactaaaactgacttagccagtttttacccacacagtattttaaatatcaggaggtatcacataaacatcaaaattctcagcatctcttaaagagtcaagtgccctggatgctctaccagcagttctacctggcaacagttgcccatttagagggagtctacacgttacagccaatacaaactcactctattgagctcactaatttactttaattgcctgaccctgtaggcatctgattgcaacttctagtctaaattctcccttttcatagatgagaaaactgcggcc

SEQ ID NO: 198990 - DNA, 504 bp, Homo sapiens
agttatgactataggaggaggtactagatgaagaaagcgcacaaagaagttccgtaatgcagcatggtttcatgattactgtgtaattgtggtcgcagtggtagatgtattgttgggaatcttctcgttgcaaataacagaagacataactcaaactgctaaggtaacaaaggttgcgtgactcaggaaaatatattgaatagatagctgggttctatcaatgcaggatggctgtcaattcttctggaggctctaagtgttcacacttaaagagtatgtcaatggaagagcaagggatcttctttttagtggtctccatctaattatctccttacttattattgctctgcattgggtaccagtcccatgtctaactcaatcactatggacattggagtaggctctcttgtttagctgaagccatccaaagtccattgccaaagcagagagagatccgtttcctcttgaagcacattgactgaatgaggaagcagcttatatttg

SEQ ID NO: 198991 - DNA, 516 bp, Homo sapiens
tgacacctcctcggatcggggagaaatgaggcagcctgcagccagcagagcacgtttgtttcttgattgggcactgtttgccaagacagcggactgaacgacagaactccactgaggacttgtgtgtccagtgttagaggctgggttaaaatctaaaacaccccagagagaagagggcaggcggggaagaggggatggtcccacagaaaaagtgcagaacctgaaaaggtaaaatgtcgaaacatggcagcatgatgtttcacttgatgaggccagcccaggccggggacaatgctgcccaactgtgggccaaagcaggaaggagcttcacctgtctcacatcaaatgacagctgtcaacacagaagacttaaatacaaaaacaaaatgaaaggccaggaaaataagaggtaccataaatctgattagcatagttccagtaggctctggaaaactctttttacctgctctcaaagtaatatattgagaagtaatataatgaagttatcaaattaac

SEQ ID NO: 198992 - DNA, 607 bp, Homo sapiens
ttttttccccacttcccctccagtattatggtgtattccaaagccaaatataattttttggtggctcgttgtgattaatttctgttccactgagcctatccatagaacaggcaatgcaactttggaaaaaacggtagtctaacttatttttgcatcatatagactgtacagcaaaggtgaagggaccaatatgagtattactggggcaccgagggaaaacattttcagaagagatcaagaaaaatgtgactcaacatgaatgaaccctgaaaacattatgctaagtgaaagaaagcaaacgtgaaagaccatacgttgtatgattccatttacatgaaatgtcaagaataggcaaatccaaagaaactaaagtagatgagtgattgccaggggataagggaagagagaaaggggagtcactgctaatggacatgggctctctttttggggtaatgaaaatgttttgaaattagatagtggtagtggtgtacaactctgtgactgtaccaaaaaccactgagttgtacaattttaaaggctgaattttatcatatatgaaatatatctcagtttttaaaaagaagaaaaaagatgttattcaaaaagg

SEQ ID NO: 198993 - DNA, 234 bp, Homo sapiens
ctccagcgtggttggcaaaagcgagactccgtctaaaaaaaaaaacaaaaaacaaaaaaactatacttttaatagtagaccaccccaaaacacaataggtttattataaagaaatattttatagcaaataatagcaagtacacaataaactatagcatttgggtacaattatgaaaatctatgtgtggtaggtatatacatgtgaatggcaaggcaagttaagaagaaaatcta

SEQ ID NO: 198994 - DNA, 483 bp, Homo sapiens
ccggtgccggtaggctcctctctgcagggcagctggctttgggaccggatgagatttgaggcagcagcgagcctgggacccgggcttgtcgtgactctggctcgcgtgctgccccggcagcctttgtgacacggagccctccggctgcctgctcctcgcgcctcgcatggctctgcaacattgtgcaattccagacgcttttattgtttgaaaacagatacgcacaattgctttgccgtgcaggaatttaaaaatttcagctcaactctgcccactcatctctctgccttgtcttctgcaaactcagtcctcaaaatgagttcctgatgtctttcaagcaggcgttatttattaagaatttttccaacgtaaataaaggaaggaagaaaatggagggatttttaaaaagtatgagaatggtaggaaaacacgtgtgttcagttaattttttatttgtcttttaaaaaataaagcgaaagaact

SEQ ID NO: 198995 - DNA, 251 bp, Homo sapiens
ccccttccttaatatagttggaaatgcattactgtttactctccctgaatcagcactggcatcagctgagacctcagtagaaatacagaatctcagtatcagctccagacccaatgagtcaggatctgcatttcaaaaagatacccaagtgatttgtaagcacattacagtttgctatgtactgcttcagataattcaattaaaaaatttaaatttaaaatgttttgatatcttctatattttatagaaga

SEQ ID NO: 198996 - DNA, 429 bp, Homo sapiens
caaactacatttagcatttcatgtctaacatctttcaaatgcaatgtgctcatgagggtttttctgaagtcctgcctggtccctgcctaaagagagacgtagaacctccatatacaaagaaacttgattcaaggtgcttttttttttttttttttttttttttttgagacagagtttcgctctccttgccccgactggagtgcaatggcacaatctcagcccaccacaacctccgcctccagggttcaagcaattctcctgcctcagcctcccgagtagctggaattacaggcatgtgccacaacacctggctaattttgtatttgttttagtagagacggggtttctccattttggtcaggctggtctcgaactcccgacctcaggtgatccgcctgcctcggcctcttagagtgctgggattacagg

SEQ ID NO: 198997 - DNA, 748 bp, Homo sapiens
ttcctgtttggatgctttcttacttgtcctgtttgatccttttaactcttataaggtagacagagagagttgttcctgtattcatgatgagacagttaagacacagcaaattaagtgaccagtgctatttgtttgaagaacttagtttattcttctgtgtacttattttccacatctgcagaactgtgaccatcctccacataatttatagtccataccaagtagtggatcaaacgagctcctgccaggcagtcaccagcttctgatgagaacagcagcatgcagcctgcacttcaatgctgcactcccaagaccagctgtggcccccacactgccagtgctgtgtgtaacgggtgctctgtagttcagtattattgatttcctatagattctttattttttaaatagcccatgtcagtttctttcttttaagtgtgggaagggtcctaagctttagtttcctgttctgtaaagagggatgatactctttgccttgtttatctaccatgcaattattatgatcaagtgagattatttttgtgaagccatgtaaactataaagtgctttccaagcatgaggaattactgtggatgatcttgagtttcacatggaggtcaggagcagttaaaattgttggttgtgataccatccataatctcttctctcaacaccctctgcaagctctaagggggggggattgtaggggtcacacaggtgttattgctagaaaatgaaagagcagaaagg

SEQ ID NO: 198998 - DNA, 769 bp, Homo sapiens
atagagaaattggcatattgtttttgccatgtgctttttacatattcctccccatggctagactaatcagggaagaaatatcttcatgtcccagctcctagctaggtcaggtgaatacaagtgacatcatgtgtatcctcttcaccaagttagcattaagttgccttgccaaacccttgaagcttcttatgtgagacatctgtgcccaatgttatttatgaataggagcaaaatgtataaatatccatgggacttcctgttaaatgtaccacattgaatgcaaatatttatctctgctgcttctgaaactttattaaaatgagagtagaaaaaatagaaggatacaaatcaacaaggaggaagagaacaagaaagatgatcccaccaaataagaaatgccaacaaaattttggaatctggaaatagacgaatgactggtaattatttatcagagcccagaaagaatattgaggagggaggcacaagaaatgagttaatgtcaatttcagaaccctgtaaacatttagaaatttggaggcagtaggtactctgaagttagaggaagtatggggcttaaaataggattcgttaaaaaatctgtgtaaagaagagttagatttccaatcctctttctatctctgaccaccagtcaattaacccttcttcacctaggcaggagaatggaggctcttcttcggggaaatttaacctggaaggctctacttgagcacctagtcacggaagatagtgggggaaatgccaggctgga

SEQ ID NO: 198999 - DNA, 662 bp, Homo sapiens
acaatttgacataaaaatattctgtgatctgaatgttcattttaagaacccctcttggccaggcgcagtggcttacgcctgtaatctcaccacttagggaggccaaagcgggcggatcacctgaggtcgggagtttgagaccagcctgaccaacatggagaaaccccatctctactgaaaatccaaaatagccaggtgtggtggcgcatgcctgtaatcccagctacttgggaggctgaggcaggagaatcgcttgaacccgggaggcggaagttgccatgagctgagattgcgccagtgcactccagcctgggcaacaagagcaaaactccctctcaaaaaaaaaaaaaaaaaaaaaagaacccctcttacaagttcccatggtcccccagccagctcttttcacagaaagagatagaagtcctctcaagaccactgtatagttctctcattgtaaacgaaatgtgttgagaacagtttagtcctgtagcaaagtattccttgtgaacacaaaaaatatggattcctgttttaaaaattagccagtctcaaattgttatagattgagtcagcgaagcttagggactgaatacaaggggagaaataaataccatgaggaacagggtttatatgcttaatgccaatgacatagaatcttgttt

SEQ ID NO: 199000 - DNA, 200 bp, Homo sapiens
acgcgtccgatgaaattgaattactatttcactgacaaataatctgactgtacagcctatttcactgagaaaggtaacagagagctgaagcaaatgaacagctacaaaacacaatgaaattccagttttagggaagttagcctggtcagccacatttggcttcatttggggaagagagaacctaaaggtacagagaacag

SEQ ID NO: 199001 - DNA, 249 bp, Homo sapiens
atttttccctcttcgtctgatatcacggataagtgagacttgtaggtctgtcagatagtacctacttaacatgctattgaatcaacaggcatgccgacaatttcatctacagaaaaaagggatatgcaaagctttagcacgccgttcatcacgttcaagtttctatctgtgtcttcaaggtacctactccttatcttctgtgacttcccaggccacgaaaagggttcagaagtagattctggtgcactt

SEQ ID NO: 199002 - DNA, 817 bp, Homo sapiens
tggagggctgtgagtgatccaacatcccctgctcttgagagtggtgttttggcatgggagtgttaatgaatgtcacaagtttcttgataccaaatagagttcctaccatttgcaggtcataccggtcactgccaagagatggcttatttagtgggaattgtctggcactcctagtataagtcacctaagtggggcaagtgggccttgaaacatccctgggagacactcactcaggctgcctgtgggagctgggctttttgtgtcactctcccatgcagcagtgacggctggggtttctaagtggtcagaggagctggaaaatggcttctgaagtaacagtcccttgtcatagtggtacaaagatgtcttcattcatctgttggcacatgtctctgggtaaactgccggcaaggccaaagtgatgggggttattattagtttttaatagaaaagttagactggcttcactttccaaccagcttccctagttccagcccatttgcagacttttgggtggtctgtgggatgaaaatttcttgtgaggaggtgagctgaagatggccatccctcctggttgctcttggattgtctgggcttcatttctaaggtggtcccagagcccatgtgggggttgggggaagcagcattgtctagcccctttggtttgtacccatgttcaccccacccccacagccacctgccttttctgtgggacttgaaaagcatcaggaatatcttcctacctgaaattcttccattagaccctgattaattggattaatctaggaaaccagattaaatgaccatttaacgaccc

SEQ ID NO: 199003 - DNA, 579 bp, Homo sapiens
cctgggacatatttgtaccccatctctatttaatgcctttatacaattctttacttaattctaccagcctttattgagcctgctttctttgtctagctgagtgccacgtgctgacgtcactaagatcaatacagcaaactctgaaagatggacagagagacaggagatggtcctttataatgcagtgtgatctgtgctgcaatagagatggaagagtgttctgatcggctggaaaacaacgcacatgggaagctgtacagaaatgagtggggaaagttttggaagctagaagttcaaaacgaggtgttggcagcaccatgctctctccgaagatgctaggaagaatctgctccatgcctttccattcgctcctggggtttcctgcaagccctgacattccttggcttgtagatgcatcaccccagtttccgcccccatcatcacatggcctcctctctgtgtgtgcctctgcgttccctctattcttcttctaaggacaccgacaccagtcatagtggattaagtgtccactcctaaccaattacatctgcaacaaccctatttccaaataaagtcaca

SEQ ID NO: 199004 - DNA, 436 bp, Homo sapiens
tcaacaaaaaaaaaaaaaaaaaaaaggctggctgtggtggctcatgtctgtaatctgagcactttgggaggccgaggcgggtggattacctgagatcatgaatttgagaccagcctggcaaacatggtgaaacctcgtctctactaaaaatacaaaaattagccggcgtgctggtgggcacctgtaatccgagctacttgggaggctgaggcaggagaatcgcttgaacccaggaggcggaggttgcagtgagccaagacggcaccactgcactccagcctgggtgacagagtgagactctgtctcagaaaaaaaaaaaaaaagaaaaaaattatgatacagagaacaatgagatgttttataaatttatagttcaaaagaaacattttattttggtaaaagccaagaagtgaaagataaatagttttgcagccat

SEQ ID NO: 199005 - DNA, 562 bp, Homo sapiens
cctgtgacacaacacgactaaattactaaggatgctatttactgtaacagttccaaaactttctaaaattttcatttaaacgctttgtttttatatctttaggtcctgatcagttttcactatgactgaactgccagtcaggatatatacataagactgtttccttaactaacttgtctaaggtcagattgctaaaaagtagcaaaatcagaattcaaaaccacatctatctccaaagaccaaactctatggcatgcttcttcctcaaatcttcttcctgactcacctcctgtaactagcagcttgccttagcaaagtaaatggaagtcatcaggagtgcagtcagaagtcatggaacagagtcaagttaccttagttgaggcttgaacttctaacacagtactctaaccaacttaattagacatttcagctacttaaaaggaggctgggatacaaacaaaagaaaagaaagacagaaagaaagacaaaaaggaagaaagaaaaagagcaaggtgcagtggctcatgcctgtaatcccagcactttgggaggctgaggcagg

SEQ ID NO: 199006 - DNA, 257 bp, Homo sapiens
cagggggtcctcctcacttcatcctggatgatataagcagatttgacatccaacaaggaggcgcaggtaagagtgcaacatcttccctccgtgccctggataggaagtggtggagggtggtgcttacccacagagtcctgccccacttctgagggagaaaggccagttcccttggtgctgccgtggacaaactgctcacgcccagtcctgcagcctgcaatgagcaggggaaaaggagacaggaaaaatgaaagcaa

SEQ ID NO: 199007 - DNA, 261 bp, Homo sapiens
caaatttcagttaccacaagatattatagtagtaactgaatgaagtatgctcttcagcccacactacaaaaatgacagatgcatagcacaaccagtggccaatcacatcacttctttcaaagactgtcagtgactggcctggtcactgcacatctgagcagtagagtgatacttggccctggggcttggggagataaaggaaggacagcaagaaagcagggcacactagccagagggtggttatggatgacctccttgact

SEQ ID NO: 199008 - DNA, 471 bp, Homo sapiens
aaaggttaggatgagccaaatatttattaaatgagtctttcccttattgaagtaatttcagaaatgcaccattggaatgttgtttaatttcaacaggtacaaactcacactcaaggaaaaacccagccattcactcaaaggaacattattttgatagtattcagatatcgtatacaaatcttttgagcaggttagttttttcatgtaaatcataacatatggtattggtcaagtagtaaagttcatattaaccttaaacatttactaagatactgttttcaagtaactcaggcaatgtatgcagagggtgtcatagtttctgtaagtatataagttttggatcaagatcacattaatgccagggccccactacagatcttctgaatcagagattctgaatctgaggtgaagactcatagctccttaaaattccatggagaaaatatatatatacctactattttcccacga

SEQ ID NO: 199009 - DNA, 196 bp, Homo sapiens
taaaggcacattcttccagaatagtaaactaagagggccacttcctagacacagtcatcactgacaagaacactaattaatttacgtttagatttgccataaaaagaaagcaatgactctctctgcctgacaagacacttaaccgtgattgggagccaaagacggctgccccttgcttgtaatgtcagcatctctc

SEQ ID NO: 199010 - DNA, 458 bp, Homo sapiens
actgcatccccttaccctggctgagacagcgtctctcgtagccattgaagtcactgcaatgagcagagcatccatgagcaagatcatcatggcatttacttagcttttggggtttcttgtggtctgttttcacagcacagggtggcctatcctgaggagcataggaggataggatccacttctactcggcactcattggtgcatcattgtccagatggggaccccatgctatagattagggtcttggttgccactcaggcatccatgctgggggtgatgctcacagttttccaaaaacaaatgcaaagacacagtgggttcaactaccgcctccaggctgagacataaaaccgccactcagatgtaaatctcccaggtttacccttgtatccagctttaagctcagctaaaaaagaaagtaattagtctttcttgatttcttccaactcaatggcaaa

SEQ ID NO: 199011 - DNA, 548 bp, Homo sapiens
ccataagaaggtttataaaaaattattacaaaatgttacagataacatgaatgaaagaaaataacataatcatggatagaaactcatatcaaaaaagtaagaattgcctccaaatgattaataaattcaactcaatttcaatcaaactctccaaatggtttttcatggaattgaataaaataattctaaaatatactctatatggaagaataaagggtcaagaataacctggacagttttaaagagcacggagtggggaacatgcccttccagatatcaggacttactatgacgctatagtaattattatagtgtggtattgggactggaataggaaaactgcctagtggaatggaagaaagagttcagaaattgtgcacatagcaaactttggtatgtgacagtgattgcatgtcaaaggaaaaggcagaacgaactgttcaataagaacagcagggaaaaaaatggttatctgtatgagattggatcactaaatacagtatatacaaaaggcaagcccagatgtgttaaagatgtaaatgctaaaa

SEQ ID NO: 199012 - DNA, 446 bp, Homo sapiens
aatagattttgaagtcagatggataaaaatgccatgtggacaagtgcttactttggcattatgaaaattttataatttaacacaaacaaaagtgaaataataattcttgagtttcatgccctttgaggtgcctttttaaaaataatcaaaatgttgttgggagaccccatccaatttaatcgggtgttatttaattatactactataattgttgtatttgcaggtttgactgttctcagggaacgctgaaggttcataacagtagtgatttgtaattgtgaggcttgagtgtggaattgaattacttcattagagagtaaccagttactgagaatccatgtttcattgagactggtgtttctctactttatccttttttttttttttttgagacggagtcttgctcttttgccgaggctggagtgcagtggcgctctctcggctca

SEQ ID NO: 199013 - DNA, 479 bp, Homo sapiens
gggtaggggtgtcaaggaagtcttcaggaagagggagaagtctttaaaggataggtgagtttaattattagataaggttaattttttagcatggtggcatgggcctgtaatcccagcttcttgggaggctgaggcacaagaattgtttgaacctgggagttggaggttgcagtgagccaagatcgtgccactgcactccggcctgggtgacagagcaagattctgtctcaaaaaaataataataataagattaattgtctcagattggagactgagtaaagttacacttgtatagtacctttgttgccaagtaaattgtgaaggtctcattgcccaagtacacaaaaggtatcttagtacagcgcccagcattgtgggaacctaatgtgtgtgtgtgtgtgtgtgtgtgtgtgtattagatatatataatggagtctttgttgtcagagttcagttatggttgaatctaaatgaaaatt

SEQ ID NO: 199014 - DNA, 361 bp, Homo sapiens
tttattttaaactgtcatataataattcaaaatttgccttaggatagaaatctagtaacctttcagataaggaaagggttgaatttccatattttagaatagaccattatgaaagttttagatgtagaagtaataagcacagtattaaagttttctggttttacctaaatcatgatatgaaaatattcatttggagtaaaaaaatagtttttaaaaataaaataaatcctttcagctaaggaatgaattttcatattttagaatagactatcataaaagttttagaaatagaactaattaactacactattaaattttctagttttatctaaatcatgacatgaaaatatctatttagaga

SEQ ID NO: 199015 - DNA, 419 bp, Homo sapiens
gtgagtctagtgggacatgagccttctgtatcttagagcttaatttattatattattcatatgctaaccagtggagttctctattggcatctggcataagattctctacacagtagatgatgcatggtagggaagtgaacttactgaatccccaatagcagagtcactgaccaatgttgcaaagcatgttttacataagtgtaagaacatgccacatatgtcatgtcacctcttataagtaatcctataagattgcatgacattgctctagaaatcacatagttactccattattacgtagcttgtggtatcactgccagggcaaattccaatgtaaaccacattcagattatctgcaaacctgggcaagaaaatgtagcactgtaatggcatagaacactgggttggaatcaggaaat

SEQ ID NO: 199016 - DNA, 454 bp, Homo sapiens
ccaacatggcaaaaccccatctctactaaaaatacaaaaaaataacggggtgtggtggtgggtgtggtcccagctactggggatgtaatgcaggaattaggtactcataaaattgttggaagggagaagagcaggctctaggccaagctttcagggtaacttcccaaacaaccaaacaaccctacagaagtggtccaatgaggaagttactgccctttccaggaagctggggaagcaagaacctgctcccacagaatcacactgcttttgtcaagatccacaccaggaagattcttgatacctgtgaagctgagaagtagccactgagctatttgctgctgtcctccttccaccctcccatactctcaccaactgtggggcatggcctctgcctcttgtggaggctaagtggtgtgcagaggctgcactgcagggagtctgagtaacgcggtct

SEQ ID NO: 199017 - DNA, 1181 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcccgctctccttcctgctgcaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatggggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaaaagaatgtaacagtgttagtattttgaataaacatgttattacta

SEQ ID NO: 199018 - DNA, 1348 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtgaagcacttgaggaagaactggattccatggcaaaacatgaatccagggaagataaaatttttcagaagtttaaaactcagatagcccttgaaccagaacagattcttagatatggcagaggtattgcccccatctggatttctggtgaaaatattcctcaagaaaaggatattccagattgcccctgtggtgccaagagaatattggaattccaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccgtaaaggcatcttaaagccttgaaaaatgttaataatcttttataccttgcaattccatttctgggattttatcctaaggaaatacttataccaaaaatagaggtgcagagatgttgacggattgcttacacagtgtctacttattagtgaaacaaaagtgtccagtgacagggaattaaataaattttggtacatccaca

SEQ ID NO: 199019 - DNA, 1159 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttcccgctctccttcctgctgcaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtaagcagtttcaggacttcattcattaagtggttaaacataatgcttggaagaaagggctccatgtgcctagaagagaggtactgagaggaagactcactttggaggctgtagcatacaattttcagatattgcctcaggtaaaaatatacttcctggactttgttttctgacacataagaggtgtgttctgctccctgtaaagacaagggtgggtatccagatggtcccatgagtagggctgcacaagatgctggaggcttggtaagttcctctgggtcgcagatcggtttctcgggtcgggatagtgtgagtgcctagcacagtgtcgggcacgcagaagggccccttaaaagtttctctttcatctggccagttttagatacacaattttgtcagtttacttacagtgcatactcttgggtagtacttgtgctgaccaagtatcttagaggcttattttattatagta

SEQ ID NO: 199020 - DNA, 770 bp, Homo sapiens
agcagaccaatgagtgagaaactgccccattttgaaggtgaggaaattgaggttctgggtataactttctttggtcacataatattaaattttacaatttgagccttgagccatacacaaaaccaccacaaaattagatttatagactcaaaatgaaaacatcagcttactggtttgtagttcataccagtcatacattccaaaacatgttttgagtcttactctgtgcctgaccttgtgcttgataacagggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaaaagaatgtaacagtgttagtattttgaataaacatgttattacta

SEQ ID NO: 199021 - DNA, 562 bp, Homo sapiens
atagcatgttaccattggcaacttataggtaaggtattgattatttgaacatgatcttcattgattttagattcttagatatggcagaggtattgcccccatctggatttctggtgaaaatattcctcaagaaaaggatattccagattgcccctgtggtgccaagagaatattggaattccaggtatgaccttaaataaggaccatttagtgtgtaatcaccatgattgtttttaaacattaaaaacttcaccaaggtaatttgtgcacatgggtcaacatggcagtatggaagggtaccctataatgaaaatcatcagtttcctgcctcaccttggggctagttccctggaaggaactgtcttgtttttttctgtttcctagttttcagacacggtctattgactgacttctgtgacaatgaggatatctacactgctctccacctccagtgtggttatgtcattattattagtgcctctgttaacttttgttattttaaataatgtataccttcctttcttgttctagtaattaaagtctttgactatatactttatga

SEQ ID NO: 199022 - DNA, 928 bp, Homo sapiens
tggatcccccgggctgcaggctgctccgggtcacatactcgtcctgagtcggcttcagcctctccgcgcagaagtctcccggagccgacttctgagagtcgagtactcctatgtgaagactaccaagctcgtgttcaagggaaccaaggcgaagaggcgagatggaaagaaagtatcaaggagtgagctgaagccactgcccttgagaaccctctcgaggagtctgggctcatgaggatgccagaataagtggcagtaagaagaaaaaaaaaaaaaaaaaaaaagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtaagcagtttcaggacttcattcattaagtggttaaacataatgcttggaagaaagggctccatgtgcctagaagagaggtactgagaggaagactcactttggaggctgtagcatacaattttcagatattgcctcaggtaaaaatatacttcctggactttgttttctgacacataagaggtgtgttctgctccctgtaaagacaagggtgggtatccagatggtcccatgagtagggctgcacaagatgctggaggcttggtaagttcctctgggtcgcagatcggtttctcgggtcgggatagtgtgagtgcctagcacagtgtcgggcacgcagaagggccccttaaaagtttctctttcatctggccagttttagatacacaattttgtcagtttacttacagtgcatactcttgggtagtacttgtgctgaccaagtatcttagaggcttattttattatagta

SEQ ID NO: 199023 - DNA, 493 bp, Homo sapiens
gggattacaggcgtgagccactgctccaggccagaaatgaacacttgatgactgagtgagtgagcctaccagctgaggatactaatgataagggctcacatttgttgggtgtcctgtgatgtgctgggcagtcctaagcccttgaccattctgttattttgaagctttaaggagatgcactaaatggaagtccatataatagagttggatggagtacctggaaattcagatggtccaacttgaatgagtgaataaatagggaaagctatctgattaaaagtgggtcccctctccatgtgtgaattgtcaagttgtggggattactcctgtttttcataatagttacgttgatttttcaggtgaagcacttgaggaagaactggattccatggcaaaacatgaatccagggaagataaaatttttcagaagtttaaaactcagatagcccttgaaccagaacaggtaaagtggagctcatagctcctcatcgtg

SEQ ID NO: 199024 - DNA, 359 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgggcgggcgtcaacattcattgtcgcgggcgcattattgagctccatatttctggcgctttcccaatcattttcgggtcgactaaatttcactattcatccgacacgtgtgctccctacatatcgtaaactcctaatgcggctagttgtgt

SEQ ID NO: 199025 - DNA, 3295 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttcccgctctccttcctgctgcaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtgaagcacttgaggaagaactggattccatggcaaaacatgaatccagggaagataaaatttttcagaagtttaaaactcagatagcccttgaaccagaacagattcttagatatggcagaggtattgcccccatctggatttctggtgaaaatattcctcaagaaaaggatattccagattgcccctgtggtgccaagagaatattggaattccaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccgtaaaggcatcttaaagccttgaaaaatgttaataatcttttataccttgcaattccatttctgggattttatcctaaggaaatacttataccaaaaatagaggtgcagagatgttgacggattgcttacacagtgtctacttattagtgaaacaaaagtgtccagtgacagggaattaaataaattttggtacatccacagaggaaggctacacagtcttaattataacacctatattgacaacagacataccattataggtggtattcatggtatgatcctattcttgtaaaaatatttgtatgtatgcacagaaatctgcaaagatgtacacttagtgaactggttaccaacgaatggtgggactaactaaaatggtctttttacttatatgtgcatttctttttataataaaaatgggttatatgcctaatgaagtcaaaccatctcactctgagcatttcccaccctaggtttttaaaacacaaaaatacttaggtaaaactcccaacaaacttgtctgatcattagctgattatcacaggctctagtatgtactggaagcccagaatatttgagaaataccaaacctcaggttggtgagtatgatgaacaggaaacccagtaattctgaagcagcagtatcacagttggcaggatgaggaacaacagtggctttgtgatcacagaactggaatttaaagaggctggaccttcagaactgatcttggtcagccagcggccctgcttacagatgagacactgaaaggcaaaaggcgatggtcttccctttccgtgtcagcattgtatacaggttccctatcgcacatacaagggttatggaatgtaagccaaaataagggtctggcctaggaggcagcagcctgaggaaaggaaggccctgaagtcagttttcaaagggctgacccttggcctattatgtttctgatacatctgtttaagcaagcggctcctaagactacactaaggtttcttccatcccctagcagctcacagttgacaattcccagttctctcagcaccagtgatgcctgcccttaagacacattgctgttgatcagtgcttgaatactgacggctaattctgataaatttctcaggcttatttccttaatctacattggctcacattgtcccctaacacatccctgttaactgaaatgcattgccaccataaatcctcacgttttcataggtaacatcacttgctaatgtaattgtctacttggctattttatttgtaatttaaaaagttctgtcctagtagtccatattatataagtatacatatgcaatttgtattaattgtataagatagttatacatagcaccatatgggaaactgcagtatggagtttctcccatggggaggttatcagctacttaagagctagaggatactagtttcgaacctgggatggctaaatctatgaaaatcacctataactatggtgtcacagccctgtggctactggagtaagttgtcatcaactagtgacaagagctggtcgcaacacttagtaggaagcacagtggcataaggaaacctggactagtggggcctttatatctaaaattatgtattattccttataggcagaatctgtaagtacgttatgactgctaatgacttttaaagcaaacatgttaacgatctttctatggtaaaaactgttatttggggacatcaccagatgatgtggacattcttgcaggtattttggcatacccaggcaagctgtcattggtgtatattccagttaacctctggagatgatcgtaacagtttacagggcctttccatttgggatggatatatcaagagggagacaaactggtccaaatcaccagaaagaaaatctcacagcaccgacttggcatctgtgttaaaaaatagcaactatatttaaaataaactgtacaacataaaaaatttaaattaaaaaatgcattaagcaagttgcctttagaaatgtgaagacattttaaaacactacaagataatgagcaagtctcacctacataatcatggctccacagacggtgccagtccatgcatccaccatttctcaacacctacaaagttttaagatctgcttggttcagatactgtccagccacagcagctccctctgctgtagagagcagcatattcagctttgcctttttatttcagatactgaatatcctttggcaatttcagatatcacagc

SEQ ID NO: 199026 - DNA, 3024 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttcccgctctccttcctgctgcaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtgaagcacttgaggaagaactggattccatggcaaaacatgaatccagggaagataaaatttttcagaagtttaaaactcagatagcccttgaaccagaacagattcttagatatggcagaggtattgcccccatctggatttctggtgaaaatattcctcaagaaaaggatattccagattgcccctgtggtgccaagagaatattggaattccaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccgtaaaggcatcttaaagccttgaaaaatgttaataatcttttataccttgcaattccatttctgggattttatcctaaggaaatacttataccaaaaatagaggtgcagagatgttgacggattgcttacacagtgtctacttattagtgaaacaaaagtgtccagtgacagggaattaaataaattttggtacatccacagaggaaggctacacagtcttaattataacacctatattgacaacagacataccattataggtggtattcatggtatgatcctattcttgtaaaaatatttgtatgtatgcacagaaatctgcaaagatgtacacttagtgaactggttaccaacgaatggtgggactaactaaaatggtctttttacttatatgtgcatttctttttataataaaaatgggttatatgcctaatgaagtcaaaccatctcactctgagcatttcccaccctaggtttttaaaacacaaaaatacttaggtaaaactcccaacaaacttgtctgatcattagctgattatcacaggctctagtatgtactggaagcccagaatatttgagaaataccaaacctcaggttggtgagtatgatgaacaggaaacccagtaattctgaagcagcagtatcacagttggcaggatgaggaacaacagtggctttgtgatcacagaactggaatttaaagaggctggaccttcagaactgatcttggtcagccagcggccctgcttacagatgagacactgaaaggcaaaaggcgatggtcttccctttccgtgtcagcattgtatacaggttccctatcgcacatacaagggttatggaatgtaagccaaaataagggtctggcctaggaggcagcagcctgaggaaaggaaggccctgaagtcagttttcaaagggctgacccttggcctattatgtttctgatacatctgtttaagcaagcggctcctaagactacactaaggtttcttccatcccctagcagctcacagttgacaattcccagttctctcagcaccagtgatgcctgcccttaagacacattgctgttgatcagtgcttgaatactgacggctaattctgataaatttctcaggcttatttccttaatctacattggctcacattgtcccctaacacatccctgttaactgaaatgcattgccaccataaatcctcacgttttcataggtaacatcacttgctaatgtaattgtctacttggctattttatttgtaatttaaaaagttctgtcctagtagtccatattatataagtatacatatgcaatttgtattaattgtataagatagttatacatagcaccatatgggaaactgcagtatggagtttctcccatggggaggttatcagctacttaagagctagaggatactagtttcgaacctgggatggctaaatctatgaaaatcacctataactatggtgtcacagccctgtggctactggagtaagttgtcatcaactagtgacaagagctggtcgcaacacttagtaggaagcacagtggcataaggaaacctggactagtggggcctttatatctaaaattatgtattattccttataggcagaatctgtaagtacgttatgactgctaatgacttttaaagcaaacatgttaacgatctttctatggtaaaaactgttatttggggacatcaccagatgatgtggacattcttgcaggtattttggcatacccaggcaagctgtcattggtgtatattccagttaacctctggagatgatcgtaacagtttacagggcctttccatttgggatggatatatcaagagggagacaaactggtccaaatcaccagaaagaaaatctcacagcaccgacttggcatctgtgttaaaaaatagcaactatatttaaaataaactgtacaacataaaaaatttaaatta

SEQ ID NO: 199027 - DNA, 1083 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttcccgctctccttcctgctgcaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtgaagcacttgaggaagaactggattccatggcaaaacatgaatccagggaagataaaatttttcagaagtttaaaactcagatagcccttgaaccagaacagattcttagatatggcagaggtattgcccccatctggatttctggtgaaaatattcctcaagaaaaggatattccagattgcccctgtggtgccaagagaatattggaattccagttttcagacacggtctattgactgacttctgtgacaatgaggatatctacactgctctccacctccagtgtggttatgtcattattattagtgcctctgttaacttttgttattttaaataatgtataccttcctttcttgttctagtaattaaagtctttgactatatactttatga

SEQ ID NO: 199028 - DNA, 1283 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttcccgctctccttcctgctgcaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtgaagcacttgaggaagaactggattccatggcaaaacatgaatccagggaagataaaatttttcagaagtttaaaactcagatagcccttgaaccagaacagattcttagatatggcagaggtattgcccccatctggatttctggtgaaaatattcctcaagaaaaggatattccagattgcccctgtggtgccaagagaatattggaattccaggtatgaccttaaataaggaccatttagtgtgtaatcaccatgattgtttttaaacattaaaaacttcaccaaggtaatttgtgcacatgggtcaacatggcagtatggaagggtaccctataatgaaaatcatcagtttcctgcctcaccttggggctagttccctggaaggaactgtcttgtttttttctgtttcctagttttcagacacggtctattgactgacttctgtgacaatgaggatatctacactgctctccacctccagtgtggttatgtcattattattagtgcctctgttaacttttgttattttaaataatgtataccttcctttcttgttctagtaattaaagtctttgactatatactttatga

SEQ ID NO: 199029 - DNA, 3171 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttcccgctctccttcctgctgcaggtgtatgcgccgctgcctggccgcccggacgccttccaccgctgcatcttcctcttctgctgccgcgagcagccgtgctgtgccggcctgcgagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtgaagcacttgaggaagaactggattccatggcaaaacatgaatccagggaagataaaatttttcagaagtttaaaactcagatagcccttgaaccagaacagattcttagatatggcagaggtattgcccccatctggatttctggtgaaaatattcctcaagaaaaggatattccagattgcccctgtggtgccaagagaatattggaattccaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccgtaaaggcatcttaaagccttgaaaaatgttaataatcttttataccttgcaattccatttctgggattttatcctaaggaaatacttataccaaaaatagaggtgcagagatgttgacggattgcttacacagtgtctacttattagtgaaacaaaagtgtccagtgacagggaattaaataaattttggtacatccacagaggaaggctacacagtcttaattataacacctatattgacaacagacataccattataggtggtattcatggtatgatcctattcttgtaaaaatatttgtatgtatgcacagaaatctgcaaagatgtacacttagtgaactggttaccaacgaatggtgggactaactaaaatggtctttttacttatatgtgcatttctttttataataaaaatgggttatatgcctaatgaagtcaaaccatctcactctgagcatttcccaccctaggtttttaaaacacaaaaatacttaggtaaaactcccaacaaacttgtctgatcattagctgattatcacaggctctagtatgtactggaagcccagaatatttgagaaataccaaacctcaggttggtgagtatgatgaacaggaaacccagtaattctgaagcagcagtatcacagttggcaggatgaggaacaacagtggctttgtgatcacagaactggaatttaaagaggctggaccttcagaactgatcttggtcagccagcggccctgcttacagatgagacactgaaaggcaaaaggcgatggtcttccctttccgtgtcagcattgtatacaggttccctatcgcacatacaagggttatggaatgtaagccaaaataagggtctggcctaggaggcagcagcctgaggaaaggaaggccctgaagtcagttttcaaagggctgacccttggcctattatgtttctgatacatctgtttaagcaagcggctcctaagactacactaaggtttcttccatcccctagcagctcacagttgacaattcccagttctctcagcaccagtgatgcctgcccttaagacacattgctgttgatcagtgcttgaatactgacggctaattctgataaatttctcaggcttatttccttaatctacattggctcacattgtcccctaacacatccctgttaactgaaatgcattgccaccataaatcctcacgttttcataggtaacatcacttgctaatgtaattgtctacttggctattttatttgtaatttaaaaagttctgtcctagtagtccatattatataagtatacatatgcaatttgtattaattgtataagatagttatacatagcaccatatgggaaactgcagtatggagtttctcccatggggaggttatcagctacttaagagctagaggatactagtttcgaacctgggatggctaaatctatgaaaatcacctataactatggtgtcacagccctgtggctactggagtaagttgtcatcaactagtgacaagagctggtcgcaacacttagtaggaagcacagtggcataaggaaacctggactagtggggcctttatatctaaaattatgtattattccttataggcagaatctgtaagtacgttatgactgctaatgacttttaaagcaaacatgttaacgatctttctatggtaaaaactgttatttggggacatcaccagatgatgtggacattcttgcaggtattttggcatacccaggcaagctgtcattggtgtatattccagttaacctctggagatgatcgtaacagtttacagggcctttccatttgggatggatatatcaagagggagacaaactggtccaaatcaccagaaagaaaatctcacagcaccgacttggcatctgtgttaaaaaatagcaactatatttaaaataaactgtacaacataaaaaatttaaattaaaaaatgcattaagcaagttgcctttagaaatgtgaagacattttaaaacactacaagataatgagcaagtctcacctacataatcatggctccacagacggtgccagtccatgcatccaccatttctcaacacctacaaagttttaagatctgcttggttcagatactgtccagccacagcagctccctctgctgtagagagcagcatattcagctttgcctttttatttcagatactgaatatcctttggcaatttcagatatcacagc

SEQ ID NO: 199030 - DNA, 3191 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttcccgctctccttcctgctgcaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatggattcttagatatggcagaggtattgcccccatctggatttctggtgaaaatattcctcaagaaaaggatattccagattgcccctgtggtgccaagagaatattggaattccaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccgtaaaggcatcttaaagccttgaaaaatgttaataatcttttataccttgcaattccatttctgggattttatcctaaggaaatacttataccaaaaatagaggtgcagagatgttgacggattgcttacacagtgtctacttattagtgaaacaaaagtgtccagtgacagggaattaaataaattttggtacatccacagaggaaggctacacagtcttaattataacacctatattgacaacagacataccattataggtggtattcatggtatgatcctattcttgtaaaaatatttgtatgtatgcacagaaatctgcaaagatgtacacttagtgaactggttaccaacgaatggtgggactaactaaaatggtctttttacttatatgtgcatttctttttataataaaaatgggttatatgcctaatgaagtcaaaccatctcactctgagcatttcccaccctaggtttttaaaacacaaaaatacttaggtaaaactcccaacaaacttgtctgatcattagctgattatcacaggctctagtatgtactggaagcccagaatatttgagaaataccaaacctcaggttggtgagtatgatgaacaggaaacccagtaattctgaagcagcagtatcacagttggcaggatgaggaacaacagtggctttgtgatcacagaactggaatttaaagaggctggaccttcagaactgatcttggtcagccagcggccctgcttacagatgagacactgaaaggcaaaaggcgatggtcttccctttccgtgtcagcattgtatacaggttccctatcgcacatacaagggttatggaatgtaagccaaaataagggtctggcctaggaggcagcagcctgaggaaaggaaggccctgaagtcagttttcaaagggctgacccttggcctattatgtttctgatacatctgtttaagcaagcggctcctaagactacactaaggtttcttccatcccctagcagctcacagttgacaattcccagttctctcagcaccagtgatgcctgcccttaagacacattgctgttgatcagtgcttgaatactgacggctaattctgataaatttctcaggcttatttccttaatctacattggctcacattgtcccctaacacatccctgttaactgaaatgcattgccaccataaatcctcacgttttcataggtaacatcacttgctaatgtaattgtctacttggctattttatttgtaatttaaaaagttctgtcctagtagtccatattatataagtatacatatgcaatttgtattaattgtataagatagttatacatagcaccatatgggaaactgcagtatggagtttctcccatggggaggttatcagctacttaagagctagaggatactagtttcgaacctgggatggctaaatctatgaaaatcacctataactatggtgtcacagccctgtggctactggagtaagttgtcatcaactagtgacaagagctggtcgcaacacttagtaggaagcacagtggcataaggaaacctggactagtggggcctttatatctaaaattatgtattattccttataggcagaatctgtaagtacgttatgactgctaatgacttttaaagcaaacatgttaacgatctttctatggtaaaaactgttatttggggacatcaccagatgatgtggacattcttgcaggtattttggcatacccaggcaagctgtcattggtgtatattccagttaacctctggagatgatcgtaacagtttacagggcctttccatttgggatggatatatcaagagggagacaaactggtccaaatcaccagaaagaaaatctcacagcaccgacttggcatctgtgttaaaaaatagcaactatatttaaaataaactgtacaacataaaaaatttaaattaaaaaatgcattaagcaagttgcctttagaaatgtgaagacattttaaaacactacaagataatgagcaagtctcacctacataatcatggctccacagacggtgccagtccatgcatccaccatttctcaacacctacaaagttttaagatctgcttggttcagatactgtccagccacagcagctccctctgctgtagagagcagcatattcagctttgcctttttatttcagatactgaatatcctttggcaatttcagatatcacagc

SEQ ID NO: 199031 - DNA, 3258 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtgaagcacttgaggaagaactggattccatggcaaaacatgaatccagggaagataaaatttttcagaagtttaaaactcagatagcccttgaaccagaacagattcttagatatggcagaggtattgcccccatctggatttctggtgaaaatattcctcaagaaaaggatattccagattgcccctgtggtgccaagagaatattggaattccaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccgtaaaggcatcttaaagccttgaaaaatgttaataatcttttataccttgcaattccatttctgggattttatcctaaggaaatacttataccaaaaatagaggtgcagagatgttgacggattgcttacacagtgtctacttattagtgaaacaaaagtgtccagtgacagggaattaaataaattttggtacatccacagaggaaggctacacagtcttaattataacacctatattgacaacagacataccattataggtggtattcatggtatgatcctattcttgtaaaaatatttgtatgtatgcacagaaatctgcaaagatgtacacttagtgaactggttaccaacgaatggtgggactaactaaaatggtctttttacttatatgtgcatttctttttataataaaaatgggttatatgcctaatgaagtcaaaccatctcactctgagcatttcccaccctaggtttttaaaacacaaaaatacttaggtaaaactcccaacaaacttgtctgatcattagctgattatcacaggctctagtatgtactggaagcccagaatatttgagaaataccaaacctcaggttggtgagtatgatgaacaggaaacccagtaattctgaagcagcagtatcacagttggcaggatgaggaacaacagtggctttgtgatcacagaactggaatttaaagaggctggaccttcagaactgatcttggtcagccagcggccctgcttacagatgagacactgaaaggcaaaaggcgatggtcttccctttccgtgtcagcattgtatacaggttccctatcgcacatacaagggttatggaatgtaagccaaaataagggtctggcctaggaggcagcagcctgaggaaaggaaggccctgaagtcagttttcaaagggctgacccttggcctattatgtttctgatacatctgtttaagcaagcggctcctaagactacactaaggtttcttccatcccctagcagctcacagttgacaattcccagttctctcagcaccagtgatgcctgcccttaagacacattgctgttgatcagtgcttgaatactgacggctaattctgataaatttctcaggcttatttccttaatctacattggctcacattgtcccctaacacatccctgttaactgaaatgcattgccaccataaatcctcacgttttcataggtaacatcacttgctaatgtaattgtctacttggctattttatttgtaatttaaaaagttctgtcctagtagtccatattatataagtatacatatgcaatttgtattaattgtataagatagttatacatagcaccatatgggaaactgcagtatggagtttctcccatggggaggttatcagctacttaagagctagaggatactagtttcgaacctgggatggctaaatctatgaaaatcacctataactatggtgtcacagccctgtggctactggagtaagttgtcatcaactagtgacaagagctggtcgcaacacttagtaggaagcacagtggcataaggaaacctggactagtggggcctttatatctaaaattatgtattattccttataggcagaatctgtaagtacgttatgactgctaatgacttttaaagcaaacatgttaacgatctttctatggtaaaaactgttatttggggacatcaccagatgatgtggacattcttgcaggtattttggcatacccaggcaagctgtcattggtgtatattccagttaacctctggagatgatcgtaacagtttacagggcctttccatttgggatggatatatcaagagggagacaaactggtccaaatcaccagaaagaaaatctcacagcaccgacttggcatctgtgttaaaaaatagcaactatatttaaaataaactgtacaacataaaaaatttaaattaaaaaatgcattaagcaagttgcctttagaaatgtgaagacattttaaaacactacaagataatgagcaagtctcacctacataatcatggctccacagacggtgccagtccatgcatccaccatttctcaacacctacaaagttttaagatctgcttggttcagatactgtccagccacagcagctccctctgctgtagagagcagcatattcagctttgcctttttatttcagatactgaatatcctttggcaatttcagatatcacagc

SEQ ID NO: 199032 - DNA, 1240 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttcccgctctccttcctgctgcaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatggggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaaaagaatgtaacagtgttagtattttcattctcagggcatattctactagagaatgaaaatactaaccctgttatcccta

SEQ ID NO: 199033 - DNA, 1169 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatggggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaaaagaatgtaacagtgttagtattttgaataaacatgttattacta

SEQ ID NO: 199034 - DNA, 1247 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttcccgctctccttcctgctgcaggtgtatgcgccgctgcctggccgcccggacgccttccaccgctgcatcttcctcttctgctgccgcgagcagccgtgctgtgccggcctgcgaggtgagccgccaaacggggtcgggacggggccatgcctccgacgcgtgcgcggcgttaattccgggagcgaccagggggacggcggcaagcaccgctgccgccccagcctcagagctccctctccgcgctgccccaggagcaccttctcccgggcccttccaggatgtgctcatttttgctacataagcttctaactgtgcccacgcgcattggtaacccccagcttttaatcagtgggtaccaggtatggtgttaattcagataatagaaattgtcttggaaagatggatcccagtagctttttcgtatttttggcagtcgttcttaacgatcagtcttattaatttgattaactcaaaccacctctaggaggcaactcagttgcgtgtaccggacgaaatctagtttctggattttaaaagcttattcctgaaagcaaaaactttcatttcttttttgtgtgttgagtattttcagttttacgtgcagaggataaaatatgtgaattgctgttttgtttgaagataaaacttttctctgcattcttttttagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccaggtgggtaatcttttttttaagtctcagttcagtttcatcgcctttgtcaacccagatatttccaggacaactttaaaggtaaaattaggaaaggtatagtactttaaaaatttttcatgcctggaacacctttgtaaaa

SEQ ID NO: 199035 - DNA, 1122 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtaagcagtttcaggacttcattcattaagtggttaaacataatgcttggaagaaagggctccatgtgcctagaagagaggtactgagaggaagactcactttggaggctgtagcatacaattttcagatattgcctcaggtaaaaatatacttcctggactttgttttctgacacataagaggtgtgttctgctccctgtaaagacaagggtgggtatccagatggtcccatgagtagggctgcacaagatgctggaggcttggtaagttcctctgggtcgcagatcggtttctcgggtcgggatagtgtgagtgcctagcacagtgtcgggcacgcagaagggccccttaaaagtttctctttcatctggccagttttagatacacaattttgtcagtttacttacagtgcatactcttgggtagtacttgtgctgaccaagtatcttagaggcttattttattatagta

SEQ ID NO: 199036 - DNA, 1206 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttcccgctctccttcctgctgcaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatggggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaaaagaatgtaacagtgttagtattttgaataaacatgttattacta

SEQ ID NO: 199037 - DNA, 1293 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatggggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaaaagaatgtaacagtgttagtattttgaataaacatgttattacta

SEQ ID NO: 199038 - DNA, 3848 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttcccgctctccttcctgctgcaggtgtatgcgccgctgcctggccgcccggacgccttccaccgctgcatcttcctcttctgctgccgcgagcagccgtgctgtgccggcctgcgaggtgagccgccaaacggggtcgggacggggccatgcctccgacgcgtgcgcggcgttaattccgggagcgaccagggggacggcggcaagcaccgctgccgccccagcctcagagctccctctccgcgctgccccaggagcaccttctcccgggcccttccaggatgtgctcatttttgctacataagcttctaactgtgcccacgcgcattggtaacccccagcttttaatcagtgggtaccaggtatggtgttaattcagataatagaaattgtcttggaaagatggatcccagtagctttttcgtatttttggcagtcgttcttaacgatcagtcttattaatttgattaactcaaaccacctctaggaggcaactcagttgcgtgtaccggacgaaatctagtttctggattttaaaagcttattcctgaaagcaaaaactttcatttcttttttgtgtgttgagtattttcagttttacgtgcagaggataaaatatgtgaattgctgttttgtttgaagataaaacttttctctgcattcttttttagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtgaagcacttgaggaagaactggattccatggcaaaacatgaatccagggaagataaaatttttcagaagtttaaaactcagatagcccttgaaccagaacagattcttagatatggcagaggtattgcccccatctggatttctggtgaaaatattcctcaagaaaaggatattccagattgcccctgtggtgccaagagaatattggaattccaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccgtaaaggcatcttaaagccttgaaaaatgttaataatcttttataccttgcaattccatttctgggattttatcctaaggaaatacttataccaaaaatagaggtgcagagatgttgacggattgcttacacagtgtctacttattagtgaaacaaaagtgtccagtgacagggaattaaataaattttggtacatccacagaggaaggctacacagtcttaattataacacctatattgacaacagacataccattataggtggtattcatggtatgatcctattcttgtaaaaatatttgtatgtatgcacagaaatctgcaaagatgtacacttagtgaactggttaccaacgaatggtgggactaactaaaatggtctttttacttatatgtgcatttctttttataataaaaatgggttatatgcctaatgaagtcaaaccatctcactctgagcatttcccaccctaggtttttaaaacacaaaaatacttaggtaaaactcccaacaaacttgtctgatcattagctgattatcacaggctctagtatgtactggaagcccagaatatttgagaaataccaaacctcaggttggtgagtatgatgaacaggaaacccagtaattctgaagcagcagtatcacagttggcaggatgaggaacaacagtggctttgtgatcacagaactggaatttaaagaggctggaccttcagaactgatcttggtcagccagcggccctgcttacagatgagacactgaaaggcaaaaggcgatggtcttccctttccgtgtcagcattgtatacaggttccctatcgcacatacaagggttatggaatgtaagccaaaataagggtctggcctaggaggcagcagcctgaggaaaggaaggccctgaagtcagttttcaaagggctgacccttggcctattatgtttctgatacatctgtttaagcaagcggctcctaagactacactaaggtttcttccatcccctagcagctcacagttgacaattcccagttctctcagcaccagtgatgcctgcccttaagacacattgctgttgatcagtgcttgaatactgacggctaattctgataaatttctcaggcttatttccttaatctacattggctcacattgtcccctaacacatccctgttaactgaaatgcattgccaccataaatcctcacgttttcataggtaacatcacttgctaatgtaattgtctacttggctattttatttgtaatttaaaaagttctgtcctagtagtccatattatataagtatacatatgcaatttgtattaattgtataagatagttatacatagcaccatatgggaaactgcagtatggagtttctcccatggggaggttatcagctacttaagagctagaggatactagtttcgaacctgggatggctaaatctatgaaaatcacctataactatggtgtcacagccctgtggctactggagtaagttgtcatcaactagtgacaagagctggtcgcaacacttagtaggaagcacagtggcataaggaaacctggactagtggggcctttatatctaaaattatgtattattccttataggcagaatctgtaagtacgttatgactgctaatgacttttaaagcaaacatgttaacgatctttctatggtaaaaactgttatttggggacatcaccagatgatgtggacattcttgcaggtattttggcatacccaggcaagctgtcattggtgtatattccagttaacctctggagatgatcgtaacagtttacagggcctttccatttgggatggatatatcaagagggagacaaactggtccaaatcaccagaaagaaaatctcacagcaccgacttggcatctgtgttaaaaaatagcaactatatttaaaataaactgtacaacataaaaaatttaaattaaaaaatgcattaagcaagttgcctttagaaatgtgaagacattttaaaacactacaagataatgagcaagtctcacctacataatcatggctccacagacggtgccagtccatgcatccaccatttctcaacacctacaaagttttaagatctgcttggttcagatactgtccagccacagcagctccctctgctgtagagagcagcatattcagctttgcctttttatttcagatactgaatatcctttggcaatttcagatatcacagc

SEQ ID NO: 199039 - DNA, 3154 bp, Homo sapiens
agcggtccacctcctgtcctccggaaaggtgcccgcctcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatggattcttagatatggcagaggtattgcccccatctggatttctggtgaaaatattcctcaagaaaaggatattccagattgcccctgtggtgccaagagaatattggaattccaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccgtaaaggcatcttaaagccttgaaaaatgttaataatcttttataccttgcaattccatttctgggattttatcctaaggaaatacttataccaaaaatagaggtgcagagatgttgacggattgcttacacagtgtctacttattagtgaaacaaaagtgtccagtgacagggaattaaataaattttggtacatccacagaggaaggctacacagtcttaattataacacctatattgacaacagacataccattataggtggtattcatggtatgatcctattcttgtaaaaatatttgtatgtatgcacagaaatctgcaaagatgtacacttagtgaactggttaccaacgaatggtgggactaactaaaatggtctttttacttatatgtgcatttctttttataataaaaatgggttatatgcctaatgaagtcaaaccatctcactctgagcatttcccaccctaggtttttaaaacacaaaaatacttaggtaaaactcccaacaaacttgtctgatcattagctgattatcacaggctctagtatgtactggaagcccagaatatttgagaaataccaaacctcaggttggtgagtatgatgaacaggaaacccagtaattctgaagcagcagtatcacagttggcaggatgaggaacaacagtggctttgtgatcacagaactggaatttaaagaggctggaccttcagaactgatcttggtcagccagcggccctgcttacagatgagacactgaaaggcaaaaggcgatggtcttccctttccgtgtcagcattgtatacaggttccctatcgcacatacaagggttatggaatgtaagccaaaataagggtctggcctaggaggcagcagcctgaggaaaggaaggccctgaagtcagttttcaaagggctgacccttggcctattatgtttctgatacatctgtttaagcaagcggctcctaagactacactaaggtttcttccatcccctagcagctcacagttgacaattcccagttctctcagcaccagtgatgcctgcccttaagacacattgctgttgatcagtgcttgaatactgacggctaattctgataaatttctcaggcttatttccttaatctacattggctcacattgtcccctaacacatccctgttaactgaaatgcattgccaccataaatcctcacgttttcataggtaacatcacttgctaatgtaattgtctacttggctattttatttgtaatttaaaaagttctgtcctagtagtccatattatataagtatacatatgcaatttgtattaattgtataagatagttatacatagcaccatatgggaaactgcagtatggagtttctcccatggggaggttatcagctacttaagagctagaggatactagtttcgaacctgggatggctaaatctatgaaaatcacctataactatggtgtcacagccctgtggctactggagtaagttgtcatcaactagtgacaagagctggtcgcaacacttagtaggaagcacagtggcataaggaaacctggactagtggggcctttatatctaaaattatgtattattccttataggcagaatctgtaagtacgttatgactgctaatgacttttaaagcaaacatgttaacgatctttctatggtaaaaactgttatttggggacatcaccagatgatgtggacattcttgcaggtattttggcatacccaggcaagctgtcattggtgtatattccagttaacctctggagatgatcgtaacagtttacagggcctttccatttgggatggatatatcaagagggagacaaactggtccaaatcaccagaaagaaaatctcacagcaccgacttggcatctgtgttaaaaaatagcaactatatttaaaataaactgtacaacataaaaaatttaaattaaaaaatgcattaagcaagttgcctttagaaatgtgaagacattttaaaacactacaagataatgagcaagtctcacctacataatcatggctccacagacggtgccagtccatgcatccaccatttctcaacacctacaaagttttaagatctgcttggttcagatactgtccagccacagcagctccctctgctgtagagagcagcatattcagctttgcctttttatttcagatactgaatatcctttggcaatttcagatatcacagc

SEQ ID NO: 199040 - DNA, 222 bp, Homo sapiens
tgaggagaaccagataactgttggaaataacttcgcatccctaaaaagcaggctcttgcgaaattcctgtagagagaggtgagactattgggcctgttgcggttatgctgagtcagtcatacttctttctactgtcgctgtccagaggtcactgatggagatttgtttctctatataaagcttactgatttacagaaaaactattttagtcattgtttaaat

SEQ ID NO: 199041 - DNA, 412 bp, Homo sapiens
tctagccttactgcactgactagaacttccagtacaatgtggactagaagtggtaagggtaggcattttcctcgtccccagttgtaaggggacagtttacagttttccaccaagattgatatgagctgttggttttcagatatcctttatcagaatgatgaagtctccttcgattcccagttgcaagaagtttttataatgaagggatgctgaattttgacatttttcctgtatatattgaaatgatcatctagtttttcagtttcggtctgttaatatgctgaattatattgatgaatatccaaatattaaaccaaccttatacatctgagataaaacctaattggttacaatgtattactttttatatattgttggatttgacctgctaacattatgtgaagaatttttg

SEQ ID NO: 199042 - DNA, 233 bp, Homo sapiens
tttcttagcagagtcatattaagatatattattaaaacactctcaattagtaaaaatgagatctttttatggctaatttactggagttatctttttcttagatatcagagcttattttaaagtgtacttcttaataatttaataacccatctttaactttgaacatgttaattttctgctaccttaatgactctaatggcataaaaaataaatagtacatttatgcaccatta

SEQ ID NO: 199043 - DNA, 815 bp, Homo sapiens
aaggatgagttctgtcagacagcactactgtcaacgttcacaagtatattgattaaattagcccacatacatattcatcccagcaaagaggtttattgtgtagtggaatatctggagcaagatgcgcacatataatcatgaattggcttcacaatgaacactcttgctatgaaaaattctaatttgcccacattttcagccctattgcctaaataatttgctctctcatgcaccctgtgtaattcaagcaggctctccacacctgcagaggcaaatgcagtttcaaggagctgacaacaagtggcagcgggcatcaggaaatcctggaatgcaagggtgctaattaaccaagtggtccttggggctaggctgtcatttagcactgcacttctagaagaagtttgctttgaatttttaattataaaaggaacaagaacttgggcactagcattcttaagatgacatttattcctcaggacctatcttaggagataacatggtccagagaacaatgcccattttcccaaagaattaaaaaaataaaaattgtatgacaggcacccagtacttcattctgtgggtgagtagtgatctctcaataataatctaatttataataataatatctacatgtatttgtgctaataatgtgtcacgcattatatctcactcactcctccaataccctatgcggtaggcatcacttacttaattgttactgtcatcattgtcatcatcatcattgcactcttattaagcaatcactaaccagggctcaaaagacatcccctaagtagtttgtttaaacttaacac

SEQ ID NO: 199044 - DNA, 363 bp, Homo sapiens
tgaatctcaaactgtggatgtaggcagaggaatcacctggagataatttcaaaaacgcagattccctagaccccatactcatggaggcagattcaggaggcctgggtgggcagcagacactggagtactgactctgagtaggtggcctaggaccagcttcaagaaaaaatgattttgaaaccatccctacagggctgacaagaattgcacgccagattctggacagaaatacagttgtaattaaggactaattgggctgcactctggcccatttccttgttgctaaaagtcacctagcactagatattgactatttgcaatcccattgttcctagaggtagatttctggcaacagggtcatat

SEQ ID NO: 199045 - DNA, 316 bp, Homo sapiens
ccttcagaaagttccaggcccctgcctctttgtttcctccttcccttgctcctttccttcttgccactcctggcatcatgcagagagtgaagccagtatggatatcaccttgacagccgtcttgctaggggaagctaagacaagaacagtgctacgatgaactgagcgcaacatgccccaggcacatgctaggtactctcacatggcacacctcaacaggctgaacagccaggcaagataagtggtacccatcttgctgttggggaaactgtggcttaaagagaccaagagctcagttacccagctaggaagtggc

SEQ ID NO: 199046 - DNA, 404 bp, Homo sapiens
tggctgggggaagggctaggtatgggaaagtaccaaatcaaagggaagaaaagtacctcctccaggccccccagtaagaaggcggctgaatggaggtgcctggacaaggaaggaacatatgtgtatgagcatgactggcccaggggtcagggaagcctgagtcctcaactgcaactccttccagaaaactgcagtgcactgactgtgcaccaagcatgttgtgtggtggggtcagcttttctccatgagggctgccaggcacaactttgtaactgcctctattggacctgaaagatcacacagacgatttgggcctggagcctcatgtacctcatgtgtaggagcctcatggctccttgacgttgacaatcgagtagaactcccgattgaagcccccattcgta

SEQ ID NO: 199047 - DNA, 508 bp, Homo sapiens
  misc_feature (420)..(420): n is a, c, g, or t
  misc_feature (450)..(450): n is a, c, g, or t
gtgatggctgactctagagggtccccattcatgcacaaaaagtgtaggaaatgacataatgtagccatgaactatttgatagtggagttgtccgtgactcttacacaccattttatgcaagaaaaaacagcacagcagggattcggatttcattcgaattcggggataaatgattatcttttaagtggagatcgcatgccttggcttagaacttaatatgccttgcacacattaatatcgctcacacttggaactaatctatcaataagctattcccatatttgtttacttacactagcgtggattgcattcttagttcagtttcctccaggataaatcctaaaccatgtattgcagcagaagtgcctaaaggtgaatagtttatgctgtaatagtttatgctgtaatagtttatgctgnaatagtttatgctgtaatagtttatgctgnaatagtttatgctgtaatagtttatgctgtaatagtttatgctgtaatagtttatgct

SEQ ID NO: 199048 - DNA, 370 bp, Homo sapiens
agctccagctcatttgcaccagctgcacacctctgaggtctggctatcatactctttccttacttatgtggaacttaggttgttagcaccatcactgaggtgctaagtcctggcatccttctcctgcttttcatttggagcctatctggactgactcagctcactgccaatgtgctcatcgagctggcactgggattggcaaataaatggatttgaaattggttggggagtttcttacatatatcaagcttttggctacagatatcatcctatttttgtttattaatctttaaacctagcctatgtggtgtcttgttagtacaggatggtgcttttgtgatttatatagacaatactgtcagatattcgg

SEQ ID NO: 199049 - DNA, 420 bp, Homo sapiens
aaattttgcaagttcgaagcctaaaaagttactccaattaccagtgatatggtctcctccaagttacttaacctctttatacatcaaattctccatctgtaaaacggagataacaatactacctacctcacagggtttttcaaggatcagatgagtccatgtaaaatcttaggaaaagtgtgccaggcacatagtaagcaatcaataaatttaactacttacattcttccctggcttagtgcccagtcccacagttgaaatatcgaaaatgctcaaaaaatggttactcaatgaatacaatgccttgatttcctggagagagcactatgggtaaagacagatacattcttttttgtgaaaaaggaaacacagctagagatggagatgaaggaagcatctgcccacctaatcacctctctc

SEQ ID NO: 199050 - DNA, 1985 bp, Homo sapiens
aagcagggaggggccgatcagcgacttaggcctgttggctgtggtggggtccacctgcgtttctggggagcccacggaccctggggtgtacctgggtttcattcccagtgacctctcctattggtccccatttggggcgctgagatgtgatcgtttctttcctgagaatgagctgaggtaaaaacatgctggggaggaagatgggccctgggggcagcgagctgcgcctctgcaccaggagaaaggccgtgtccccagagctgaggcggtggtgggcagggctcctgagaagccggggcagggcagggtgtctctgaggtcaatgaggaacagctgaggtccagggacgcaggaaggatggggtgaactccgggatggggccggcagggagcctcacgcttacagagcctggtgttggcactctcctggcttcctccgcaaacctagccacgtggtcagggagcccgggcctagcagacggcccccaccttgacagaatccccagggtcgtgcgtggcggtgggggcgacttcacagccgagaccgggcctaacgctgctgtctcgcagtcacccctgcaggccgctcagggcagggctctggcctgacgggggttcctggacacgcctctgagccggcagcccctacccgcacccgtgcaccttccacgcccgtctcaagacagacacctgacgcgagaccgcaaacaataccaacactgcaacgcacagtatcacagaacaacaaagcaaaaacgagaagcacgaagaggagagaacacggacaagcgcagaagcaagacaacacgcgacgaaaaaccatacatgagagacaggaacagcaccaagaagcacacaggggaagcgcggccgaaaagacgcggcacaacacacgaagcgagaacacaaagcagaaagaagaacacacacgagaaaaaccaaacaggccaaaacgatactggtacgacggaagaaagcaaagaacacgaacacaaagaaagaagagaaacgtaacgccgcctccggcgcttacacaaaagagaacaaaaacgaagcgaacacaacaagacgaagcaccacagacgacacaaaagaaacacacaacacaaccaagcagaacacaggaacgacaacagacagcagacagatagaacaagagaacacgggagcggaggcagaaaagaaccaggacgcaaagaggagcgacgaggagaaagacacgagcaaagagccgaaaaacagagagaggagacaggggagcagacgaggagggggagagggcaggagaagagggaggaaggggagaggaggaggaggagagaggaagagagaaggagggggaagagagagagaaaagaggcaggcagcacgaggagacaagggagggagagagggaacaggacgccaagagggagagggagaagggagaagccgagcgcaagaggagcgagagcaggagaagaggagaggagaagggaagggaggagggaggcgcgagcaggaacagcgcgagccgcaagacaggagagacgcgcgcgaaggcgcgaggcggcacaaagcagaggaaggagacgagagcgaccaggagcaggacgacgaggccagaggacgcggcacagccagagacacgaagaccacaacaacagacagagggccacgagagacagacgaagaagagagagagggcggaacgaagaggcaagggcgacgacagacacgagagcagcacagagcgaaggagacagaagcggccaacgaagacgagcgagcagaacaggcaacggacgaagacgaacgcacagcgagagcacaaagacggaaggggagagcggggcaaccggccagaaaggaaagccgagcacaacaggcaagccgacacgagcgcgcagaggacgcagcacaacaggagcaggagcaaagaggaaggacgaagaagcaagagagaaggcaaacacgaagaaggagagaatagacagcaggagaagg

SEQ ID NO: 199051 - DNA, 317 bp, Homo sapiens
caaccagctaggaaagatgaaacaggaattctgatgctaaagctcattcctctaccaccatcatcatcatcctcaccgtggctggtgccaagtgctcctccttccctcaggggtcttcagtcaccagcccctctttgggtccacccactgaagtccaccaacctctggacaccttcacactttacatttgctgccttgaacctgttttccactttgtttcctgttagctgagtcttctcttctgacagtgtgcaccttacccagaagcgtgtggtatgacagtaataataaaagtgggcggagctgacattcagagg

SEQ ID NO: 199052 - DNA, 604 bp, Homo sapiens
  misc_feature (19)..(19): n is a, c, g, or t
  misc_feature (34)..(34): n is a, c, g, or t
  misc_feature (41)..(42): n is a, c, g, or t
  misc_feature (44)..(44): n is a, c, g, or t
  misc_feature (72)..(72): n is a, c, g, or t
  misc_feature (86)..(86): n is a, c, g, or t
  misc_feature (165)..(165): n is a, c, g, or t
ctagaggatcccgtgtggntcttgtgctggggtntgcggannangggacagagactgaggatgtgcggtgtnagcagtgtgctcgntggtaccttctcagatgtgccttctagtgtgatgaaatgcaaagcatacacagactgtctgagtcagaacctggtggtnatcaagccggggaccgaggagacagacaaagtctgtggcacactcccgtccttctccagatccacctcaccttcccctgccactctaaaattaatttccggaatacggagtcaaacctgacacacttggtgttaaaataattgtgctgacattcgagctaaaaagtgaacaatctggttgtttctagtgatcccccagccatggggtaaagagcattatcatgttagttgccatgacagttctcgaaatgagccctgaaaatatcaaggagtgtcactgcactaatcccaccaggagagcaccagacacaaaggtaacacccgagcacatggctggggtgttagttttggagtatgactgatgccctgtgcaatagggcagccagggagtcctttctcacccactaatagggctcgtggtgaggtcttgtcccacagca

SEQ ID NO: 199053 - DNA, 299 bp, Homo sapiens
tccccctaaacgtttaaaatatatttctaaacagaatgggccaattcagtcacagtaactgttgatctccatagcagagcaacccacaaagacagaactgatttttttcccataatcaggggtgaaaaatatacaacttgtttctgaaccaaaaccacaatttctgcagtttaaaatgtttcactgctaatatggccctggtagaaattatgtagtttcttttcttctttaaaaaaaaaaaaaattaaaaaaatttcctaagacactaaatgctccatctggaatgtagattctgatca

SEQ ID NO: 199054 - DNA, 443 bp, Homo sapiens
tccccctaaacgtttaaaatatatttctaaacagaatgggccaattcagtcacagtaactgttgatctccatagcagagcaacccacaaagacagaactgatttttttcccataatcaggggtgaaaaatatacaacttgtttctgaaccaaaaccacaatttctgcagtttaaaatgtttcactgctaatatggccctggtagaaattatgtagtttcttttcttctttaaaaaaaaaaaaaattaaaaaacaaatttaaacaataaaagtgggcatgcataagttgggaagattcagacagtaagtcagatggacaagttaggctttagagatattaggaaaatatttcctaatatggaaagaaaaagtttcacgaagattaaagactaccccaacagaattaatacaacagaatatcaaagatggtagaccgctggtccg

SEQ ID NO: 199055 - DNA, 400 bp, Homo sapiens
ttacaggcatgagccaccacacctggccttttgtttttttttaaatagaggggtcttgccatgttgcctaggctggtctcaaacccctgcctcaagagatccttctgccatggcctcccaaactgctgggagcaaggccactatgctcagccttgagttatcagaattttaaaaatgcttaatgcttttttttttcccttgtagagtgaaatatttatttctatactctgatttttttattgaaggtttttttttcaccatttttttaaaccgttaattttgtttcccttgattatcttactcttaaaaccattttctgtacttttctttctttcttttctccctgatgcttcttactgtctttggcatcctggaatagtgtggagccactcatccaagc

SEQ ID NO: 199056 - DNA, 361 bp, Homo sapiens
catggacaagatcatgcaaaggaatcgcacaaatagagcatgatccatggataacatgataaatgtatcacgggcatgggtctcgtgtgcaactcgaccgtatgtttcttgctggggcaagcccctatcttcacattcagatgtgcatttacctgaataatgtgattgagaagattttaagttacagatttcaattcaggtgtttcactgaggctatgacaggtaaactgtttggggttcttctttgaaaaagtcaaattaaaatatttaaattgtgcagaggaaaaaatgcttacatcattgtcatcaatatcaatgtaatttatttaacccttttaggattagccattctttttttttt

SEQ ID NO: 199057 - DNA, 397 bp, Homo sapiens
gggcttaccagtggcgttagtaggtagaaagcaagttcctttaaagcacagaaaggaaaggaggaaactgattggtgtgcttaaaaggctgtgactaggatgcttcagtgaaaagcactcctatagcttgtctcttctagttgctttgatacttttggggggaaaaatctgcactcaacaccatatgaggcctcccttctgcctattagtcttagagaaaacatatctgcccatctattcgtctttcttttggtctatccatttactgtctggacacagttggaaagttgctttttttcgataagaggaaaatgggtacatgatgaaattgatgcttttggattaaatagagggtgcacgtcttatcttccattcctttgtgtgtctacaaagactt

SEQ ID NO: 199058 - DNA, 400 bp, Homo sapiens
tccagaatcatttcctcaagtttatataattttaaaaggtaatttaatgagctagaaattttctatagttgatatttgaggcagtattaaatattgctttaccttcaagtagaaaccatactaaagagaagtaaagtttgcagtcaaatcagcttacacagaaggcaaactatgtaactgtttagaacaatagacaatgaatttttagaattttgtattatttttagttgagaaactataattgtcaatgaattttaaaataattgaaagtacaagtgtgagtgcttcaaacatattaatcttcaagggaagactaatatttcaaacctaagcatttctaaatagatcatatttattcaaacctaagagtttctaaatagatcatatttacactaagact

SEQ ID NO: 199059 - DNA, 219 bp, Homo sapiens
tcaaagcacatgcctgtctcataaaaagatatcagcattagtgctgtcaggacccttcacatcactgcaattaatgaaccccacagtctcaaacatcctgtttccaacattttgataatagtaccctgttttcttttggaaggaaacccaggttggattgattaacaaatacaatcattatttaacctcagaacttggttttgaaattaatttacaata

SEQ ID NO: 199060 - DNA, 438 bp, Homo sapiens
gattcattgcaggtatgcaaggctggttcaatatttgaaaatcaaataatgtaaaccatcacattagcaagctaaagaagaaaaatcacatgattatatcaatagatgcaaaaaagcatgtgacgaaatcccacacccattcataattaaaaattatcagtaaggtggaagtggagagaatgccttcaacttagtaaagaatatcttcaaaaacctacagatagcatcatacttaatggaaagaaacgacaagctttcccactaaggttagaaaccagactagaatttcccctcttgtcactacttttcaatattgcactggaagtactaaatgcaataagacaagagaaagaaataaaaaatacttggattgggcaggaagagataaaactgtttttgtttgcaaatgggatgatggtctatgtaaaaaatctaaaa

SEQ ID NO: 199061 - DNA, 1138 bp, Homo sapiens
  misc_feature (968)..(968): n is a, c, g, or t
acatggtcagagcaagaagatgagagagaggtggggaggtgctactcacttttaaacaagcagagctcatgataaccttctaccatgaaaacagtacggaggggatggtgccagcccattcatgagaaatccgccccgtgatttaatcacctcctaccaggccccacctccaacactggggattacaatttgacatgaaacctctttttttttctttttttgtttttttttttttttgagacacaggcaagacttctcgtgttcaataacaaaaaacaaaaagaaaaaaaaacttccggagaaatatgttcctctctctcccggggagagaggaggcccggggacaactccaaagaggaggcgtattggcgcgacgaacgccgttggtaatatgggcgcccgagcaaatattggccgccaaaatttgggggggataattcgtttccccagggaggtggtatattaaacagcccctcccgtgattttggggtttttggggcgccaaaaaagacaacacgtggtgtggaacattgggacaagatcaacccggcgaagatacagaagacatgctggtggctccacacgagggggaagaacaacaagcaggcgtccataatgttgggcacacatctaatgccccccccccgaggaggatctctaactggagccaagaagaaccacaggggcccccaaaagagattgggtgggccctacacacttgcgcgaagcaggtcggtgtcgaccactttagcaaaaactacaaaggagctatccggggctggcaagagaaacagtttcccctataagacccaagggccctcggctcgggggcccttctcattttcgtggctgtgcccccttccctagggggacaggggcattcaggagtccggaagacacctgtaggacgtacaaggcgtctccagctggccagcggttttggagggtcccgtcgacccccagtgtgnatgtccctccttcttggccctgagtttcgagttccctccggtggcaatacttttcctcggagccaaagagagatgcctctctttgacaactttgctgtcgtcggggcgtcttgggcacatcgtgtcagtgcccgcgcgggaaagacgccccccctgtgcttttggttcaa

SEQ ID NO: 199062 - DNA, 1009 bp, Homo sapiens
ccgggcgcggtggcgcgtgcctgtcctcccaagtagctggcactacaggagtgtgccaccacgcccagctaatttttgtatttttaatagagatggggtttcgtcatgttggccaggctggtctggaattcctgatgtcaggtcatcctggcctcggcctctcaaattgctgggattccaggcataagccacctcacccattcactttttttttttcctgaaaacagatttttcaggattctttattggctgctaaataattctcatacggattagattttatagtgatcatatgagtaatatcttcacaaaacaatccaatcactcattatttatcagccgtctggtgggactgattcagtatgtacagatccatgatgtgaataggtttcaccttatgaaatgcaatgactcatgtactaatttggtatttatgaagaaatattggacctggtaacagcttttaaaaagctgagtatgactgagtcaataaaaacaattttacacaataataaaacaccagatattggtaaatgttgatattaatatatattagtatgatattagtaaactttttttttgcatagaaaagtccatttataaaaaggcccaatttcctcacttccaccctgagaggtaggtagatagatgaggcaattaagtgtcagagtttgtgacttactcagtgccacagaactagaaagcaggaaatctgggagcacagcttaggaattctgcctgatctcgggttctctccaggatatcatgctgcataagacttagggtacagtaaatcctctgagctgtaggaagaaaaaagtgcagcccaagatgtaactattattgttttcctgacaagatgtaaccgtattgtttttagatgtggaatataataaaaatacaaagcatcatcattatttttatcagtattagggaatgtgcaaattgggttggacagaacatttcagtgtaatagaaattttctctgtttttatggggaacgagggtg

SEQ ID NO: 199063 - DNA, 199 bp, Homo sapiens
ccaccctcccaaagaaatagctgaagttgtgaatggtaggaggctacaaagctaagtggaaagtctctgaaaagggcagagatgtttctggcagtctcgtgaggagactagaattagatctcaggatatgctaagaggaaaggaggctgggcacagtggctcacacctgtaatcccagcactttgggaggctgaggcgg

SEQ ID NO: 199064 - DNA, 623 bp, Homo sapiens
agaaaatgacatcatggctgggcactgtggctcacgcctgtaattccagtactttgggaggccgaggtggtcagaagttcaagatcagcctggccaacatggtgaaaccctatctttaaaaatacaaaacttagccaggtgtgatggcgggcgcctgtaatcccagctactcaagaggctgaggcaggacgtttgaacccgggaagcggaggttgcagtgagccaagatcgcaacattgcactccagcctgggtaacaaaaacaagactccatctcaagaaaacaaaaaaaaaaacaaagaaaatgacatcatatgacgaggcaacataaatctgaattagaacaactcaaaaggggtgataaaactcagaaatttcagaaatgaacactaaactaaaagaaacacaagaatgaacaaccaacgggtaacagataatgccttaaagaaactagaaagtaaataggatggaaaagttaagaaagggataaaaagattagagagcggcaatctatagaaaaacaggcaaagaagatccaaaatgtatacaataggagtccccaaagaagaaaatcaaagcaaggaagcataacaaaaactaaaaacaataactaaagagaatatc

SEQ ID NO: 199065 - DNA, 499 bp, Homo sapiens
tacttaattatttaacaattcatatagtattcacaaagtataccaagaaaaaagcacacatatgtcagtggttataatcagattgtaaatatggacatatctatatatatctcttcccttacctttctttctgccccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccaga

SEQ ID NO: 199066 - DNA, 106 bp, Homo sapiens
tacaaaataatattaacactaaatgttaacattattaacattacttaggtccttacccctctacagataagtaacagggctaagcagatgctttccccactaattg

SEQ ID NO: 199067 - DNA, 470 bp, Homo sapiens
gatatgacaccaaaagcataggcagcagaagcaaaagtggacaaatggggctacactaagcttaaaaactttgtgcatcaaaggacacaatcaacagtgtgaaaaggcagttttcaaaatgggagaaaatatttgcaaatcatgtatctgatatgggattaatatccagaatatataaagaattcctgcaactcaataacaacaacaaaaaatcaaccctatttaaaatgagcaaaggacttaagtagacatttcttcaaggatgatatacagatgaccaaaaagaacatgaaaagatgcttaacatcactaatcatcagagtgatgcaaaccaaagcataatgaaatgttacacctattagaaatggctactataaaaaaaaaaaagtatcaggatatggtgaggatgtggagaattataaacttttgtgcattgttggtgggatgataagatggtacagccattaagg

SEQ ID NO: 199068 - DNA, 712 bp, Homo sapiens
actgtgaggcttttatttcttcttttacctaagtaaagacccgctaatagccaccttgccttggccattatgttgggatataaggagctttaattttcttacaggcatttttatattcctttcatattctcagtttcccttcactcattgctcaaaccatataactgatcttctgagatgatggtaaattgtcggtaaacagaaattccctgaagcagacatcatcaaaactaaaagttgtggcccttggtactatcaacagaaaaatatggaaatttgtatgatttggaaagcttacattcctttgttcatatgtgcatttgtgactactgagcatgtcctccatgatcggtacattctacattatcatactagggagagatgcccttgtgcacaggtagcgcaaacctgagataaggggtctgacactgtgatgtctgattccaggtagggacaaagacatggtggctctgggagcccagtgaggggactgggcttcctagaggtgagccttcaacaagagtcggtttttgctaacatctattgcatgcctactgtgtgccaggttgtgcccggtgcccagggtacagagatgagtaacagacatccttgccctcaaaactcacaatcttgtggcaggggaagggaagagacattactacagaatttcattcaaaggaagaatggaagttcagtcaaagccctgaagttg

SEQ ID NO: 199069 - DNA, 429 bp, Homo sapiens
cattactaatactctctgtgtaactatgcacttctaattaaagcctctttaaatctgatattgttcatcaatgaacagtttggtttagtaatactaattaaggatggttctaaaatttaaaactttgaaaattaggattgtttcatttagtctaatgcttttgatttgtaattcttacagtggttgttcataggatattaacttttccagttaccagataaaggttttttgttttccagatgatctgtcttgagattaattttttaaaacaacaaaatatacatttgtctcatttgagtatcaggtcataattccattattcacagaagtttcatcatgtgattgattactttttaaaaggtaaatttttgatagaattaattaaaataactactttagaatagctttttattgcataacaataattct

SEQ ID NO: 199070 - DNA, 248 bp, Homo sapiens
tgacattagatggactaaatctttaatttttaatactttgtgaatactgcttctctcagttagcaatgcaaagcctttaactcttaaaatgctgctttctgaaccactttttagtcataagaagagcacatgcttgttctttaggcttcagcgtctaaggaatgagaagcaagtcagaaaacagcagcatggggcagacagttcataaataaatctgctttacattttcagcaagaaaacctaattct

SEQ ID NO: 199071 - DNA, 602 bp, Homo sapiens
ttctttcttaagaaaaaattgctgttattttttcagaaatcctccacctactttacttcatccagaaaaatggtgtgaagaattcaaccactttatttcacagtgtcttattaaggattttgaaaggcgaccttccgtcacacatctccttgaccacccatttattaaaggagtacatggaaaagttctgtttctgcaaaaacagctggccaaggttctccaagaccagaagcatcaaaatcctgttgctaaaaccaggcatgagaggatgcataccagaagaccttatcatgtggaagatgctgaaaaatactgccttgaggatgatttggtcaacctagaggttctggatgaggtactaaatatttagtagacaattctcattgaagacatttgtttcatgtgaatggtctgaactttctgttgtagaccatgtcctcctaaggtcatttgaaaatttaattgtttgtgtagctatgggatgaagttcagggagcattcagttgctgtgactatgatcctgtgctgtgtttatttagatagcccctagaatgatgaagagaaaaggatttggatttttgcaataaagctctttatattgt

SEQ ID NO: 199072 - DNA, 277 bp, Homo sapiens
gaatttccattttaaccaaggagaaagggaactaagaaaatcatcagatgttcaacaaacgtaaagaaaggagaataaaggaaataagaccgcataataaccagaaaaatacttaacacacatatagtgacaaacaccaatggttcgctttccctattaaaaggaaccttttttccctataaaaaggttcagtccctaaaaatgaacccagtggttcacttcccttggcagatgaaggaggcggtggcagtggtggaagaaggggtggtggcggcag

SEQ ID NO: 199073 - DNA, 1155 bp, Homo sapiens
tttttaaaaagacaaagcaggttcaaaaaatatccaaatagaacttcaggaggtgaaataaaaaatgtgactgatgagtttcaagtctcattgaattacccaccatttctgtctctcttctcttctcctcttttacaatggtatacgctgttcaatgtgtttctttcccatgctgtgtatgtgtgtgtgtgcatgtgtgcatccataaaaactagtattgtttgttttctttagttttagtgctattagtccatatgtattctgaaaattgatttttgtcattcaacattagtttttggagatctagtcatattgcatatgaatctagctttttttttttttaatttgtatgcacagtataaatacaccagcttacttagacatttttttcctaatggaccctagttggctaatatatttttttgttataaaccatgtagcaagggataccctacatatatctctctgggcataattgtgaatgtttctctaggataaataccacaaagtagagttgctcagttagaaattatgcacatctttattttaacatatacttccagattggccttcaaaacatcttgacagttggcccctttccctgacccacgtactaggcttatattttattttttgaattaatttaaatgaggtaggcataaattttggatactgaatttttactttttatagaagttgcgaatattttttcccactttaaactttaaacttttatgtggtgttttttagttgtgaagaagtttcattatatttcctcctattatttgcatacttttccacctttcactttttaacccatttatgatatagttttatgttttgtgtgtgagaaggaactaattttatggttattattttgtactgttagccagcgtctcaactttcttaactgaatagttctccttttcctgatagctttgaaatagcactctaatcatatttcagttcccaaactctgttctgtttctctactgttacattgttttacaaagttattaaagtacttcccaaagtaagaagtacattttactttgcaacctgatgcaccaactgcatgttcacacacatatgaaacagaatattcatcgaataacacctacacctaataggcttgttatactctgataatttctc

SEQ ID NO: 199074 - DNA, 184 bp, Homo sapiens
tactgcttgatctcttataagtggaatctaaaatagactcacagaagcagagaatagaatagtggttgctaggagctaggggtaggaggaaatgggaagacattggtcaaggagtacaaagttttgttaagagttgagggtgtccaggttcttggcatcttgaaaaaattggacaaaacgtaca

SEQ ID NO: 199075 - DNA, 394 bp, Homo sapiens
cggtaggactcacacaattttgcaagataagtaaccaaagcaaaagtcatcttaggctcaccaaaagggctacatagattagttacagaaaacaaggcaaggctaagcacactacctaacaatattactttttacttttcattaagcagtggaaagtcttttataaatgaaattttacttgagaaaggcaatagataatacataagagcagaactgctttgtctgaaacagggttgcgggtgtgaggtggtacgcagcgttctgctgattttacttccgtcttattttcctgcttccatacctacccggggggattctctggagtcctgaggattatctataatcttttccatatgataaaaaggcacttgggggatagggccatgtcttctgt

SEQ ID NO: 199076 - DNA, 899 bp, Homo sapiens
gagggacccggtccccgccccgcgtgctcaggctgaacagcttttcttccctgatctctcggaggcgccggctgctggccaacgcagggcagcctcctgcgtgcgtgctgtgggtttctccttcagtttcctctcattgcctgaggttgggcccgaacacggcggtacatttccttgagagtcttctacattcatgctgtagaagctatgaaagtcgtgggaaactatagagtcaacactgcaaactcaagcactgatacgtccggagagcacttgacctgccttagaagatttgaaaacaatttgtagccaacttcagtatgaatcaaagcattgttttaaaaggaaagattccttctgacattaaattgcattttccaagaaccagcaacatcaaccatccagactttaattatggaatcacaggtgcaactgcgtatctcctcagtagaggacaggaagatttgtgtgactgggactttatggatttggcatctcctgcaagatgtgtgtccaactcctgggaatactgtagcatgattatagaattggtttctattgtctgttttctgtttgttgctctctcataagttaagaatcttggatttcaagtctatagtgtaacactcttgttcataatttcttatttaaaaaaatgtttaaatatttctatattaagtattttttcaaactatttgggcttgctattgaacaaatgttctctttgtattgtatattttgaaggtgctaaaaagcatcactaaaacattttggaatataacagaaagatggttaatacattatactgactacttttttctcaattaagatatacaaatcttttatatttagtaatcagaaaggcaataaagcatatgtaccttacctcttcaccatcc

SEQ ID NO: 199077 - DNA, 1026 bp, Homo sapiens
  misc_feature (51)..(51): n is a, c, g, or t
  misc_feature (53)..(53): n is a, c, g, or t
  misc_feature (69)..(69): n is a, c, g, or t
  misc_feature (71)..(71): n is a, c, g, or t
aaggacgatgatgtagagcatataatggtgaggcggccgggggctttagcngngacgactctcttaatntnccccgctacagtcttctacattcatgctgtagaagctatgaaagtcgtgggaaactatagagtcaacactgcaaactcaagcactgatacgtccggagagcacttgacctgccttagaagtcagctctttgtagcctacagaaatggaagagtggatgaagcagtctctctgggttttctggattgctggataggtggagacctgacaaatttcaaaggctgctacctgactaaccaactgcctattcagatttttacagccatcttcgacatgaacacggatgtaatcatactctcacaattcatgtactacaggttaaagaatcagaagaaaaaaatttctgaagaagatctacggaaggaacttcatttctgctgtttgcattggccatgattgggaacttcacgtatggacttggtgtggttttaaaggcaccagctgctacgtgtcacaagaatacttactttgtgcatcatcttccttggcttattgcaagttttggaatcttattccttaactcttttgtgtcttttgccatcagattgccattagagaataaacatgtatagctacttaatatatcacccaaaaagtacatatatatatatatatatatattctaagaagtgtaaatagctaatgctatagtcatttcattattatatttgaaatgttcatttataaggaaagtcttctctttcccaaagtctcctaattattattattctagcaaacgatcaaattcagatgaagatttcttggtttctttggttcttctgataaaaaaaaaaaagtggggccaagtttagaagcattgaaattaacacatcttagatattaaattttattaaaattataatagcagatattaagaaaaaaccataccatctctgaaaatctctacagagaacactttgaattaataaatgataactgatgccttgccttttgttg

SEQ ID NO: 199078 - DNA, 915 bp, Homo sapiens
  misc_feature (909)..(909): n is a, c, g, or t
  misc_feature (915)..(915): n is a, c, g, or t
gagggacccggtccccgccccgcgtgctcaggctgaacagcttttcttccctgatctctcggaggcgccggctgctggccaacgcagggcagcctcctgcgtgcgtgctgtgggtttctccttcagtttcctctcattgcctgaggttgggcccgaacacggcggtacatttccttgagagtcttctacattcatgctgtagaagctatgaaagtcgtgggaaactatagagtcaacactgcaaactcaagcactgatacgtccggagagcacttgacctgccttagaagatttgaaaacaatttgtagccaacttcagtatgaatcaaagcattgttttaaaaggaaagattccttctgacattaaattgcattttccaagaaccagcaacatcaaccatccagactttaattatggaatcacaggtgcaactgcgtatctcctcagtagaggacaggaagatttgtgtgactgggactttatggatttggcatctcctgcaagatgtgtgtccaactcctgggaatactgtagcatgattatagaattggtttctattgtctgttttctgtttgttgctctctcataagttaagaatcttggatttcaagtctatagtgtaacactcttgttcataatttcttatttaaaaaaatgtttaaatatttctatattaagtattttttcaaactatttgggcttgctattgaacaaatgttctctttgtattgtatattttgaaggtgctaaaaagcatcactaaaacattttggaatataacagaaagatggttaatacattatactgactacttttttctcaattaagatatacaaatcttttatatttagtaatcagaaaggcaataaagctttggcctcgttggcctcagcggtggagctctgcgnccggan

SEQ ID NO: 199079 - DNA, 804 bp, Homo sapiens
  misc_feature (798)..(798): n is a, c, g, or t
  misc_feature (804)..(804): n is a, c, g, or t
gagggacccggtccccgccccgcgtgctcaggctgaacagcttttcttccctgatctctcggaggcgccggctgctggccaacgcagggcagcctcctgcgtgcgtgctgtgggtttctccttcagtttcctctcattgcctgaggttgggcccgaacacggcggtacatttccttgagatttgaaaacaatttgtagccaacttcagtatgaatcaaagcattgttttaaaaggaaagattccttctgacattaaattgcattttccaagaaccagcaacatcaaccatccagactttaattatggaatcacaggtgcaactgcgtatctcctcagtagaggacaggaagatttgtgtgactgggactttatggatttggcatctcctgcaagatgtgtgtccaactcctgggaatactgtagcatgattatagaattggtttctattgtctgttttctgtttgttgctctctcataagttaagaatcttggatttcaagtctatagtgtaacactcttgttcataatttcttatttaaaaaaatgtttaaatatttctatattaagtattttttcaaactatttgggcttgctattgaacaaatgttctctttgtattgtatattttgaaggtgctaaaaagcatcactaaaacattttggaatataacagaaagatggttaatacattatactgactacttttttctcaattaagatatacaaatcttttatatttagtaatcagaaaggcaataaagctttggcctcgttggcctcagcggtggagctctgcgnccggan

SEQ ID NO: 199080 - DNA, 1307 bp, Homo sapiens
gagggacccggtccccgccccgcgtgctcaggctgaacagcttttcttccctgatctctcggaggcgccggctgctggccaacgcagggcagcctcctgcgtgcgtgctgtgggtttctccttcagtttcctctcattgcctgaggttgggcccgaacacggcggtacatttccttgagagtcttctacattcatgctgtagaagctatgaaagtcgtgggaaactatagagtcaacactgcaaactcaagcactgatacgtccggagagcacttgacctgccttagaagtcagctctttgtagcctacagaaatggaagagtggatgaagcagtctctctgggttttctggattgctggataggtggagacctgacaaatttcaaaggctgctacctgactaaccaactgcctattcagatattccaacctcagttattcaaagactccatcaccagagagaaagtcagattgtcactttggggagtcctctgccctgtatatatcccatattctttcagataagtgaaattagcatgcctgggtattacagttgtttatgccatactactataaatacttctaagagaagatttatcttgacttaagacttggaattttgttaaattaatgcacaaatgtatatgaccataacttaacgatgatttgtatattagctgagtcaagtggcatatataaaagcaatgaaggtttcttggacattctacactgaaatgtttagaatgtttaaaaaatttatctttctattttccaatagtgtggtaaatgtaaagtgcttagcactttgcgtgacacatggtagggcctcaaaaaatattagctattatcattataaaccagaggccctgttatgtggcagtttgtatctctctcttgactaatagaagcactttgcagatgatatgtcacacaatctagaaaggtagtgcttaaaggaatagacttatctccttattttacaaatgaggacattgaggccctaggaagttaaatgacttagacaaaatcacaaaggtaaagtggaaagcccaggagaaatcccctggccttcagcctgctgtgatttctaccaactatagattagaacttttcagacaagtggcacctgcaagtgtcttcgagcaaggcctcaacctccagcacagctcttgccacctgcaaacaccagggaagagcaagattgagttacatggcttggaagaagagtgaaacacctcgcaagacccagagaaaactccacatccatttgcagctaattttaaagcccaaataaaagcacaatcttt

SEQ ID NO: 199081 - DNA, 1125 bp, Homo sapiens
gagggacccggtccccgccccgcgtgctcaggctgaacagcttttcttccctgatctctcggaggcgccggctgctggccaacgcagggcagcctcctgcgtgcgtgctgtgggtttctccttcagtttcctctcattgcctgaggttgggcccgaacacggcggtacatttccttgagagtcttctacattcatgctgtagaagctatgaaagtcgtgggaaactatagagtcaacactgcaaactcaagcactgatacgtccggagagcacttgacctgccttagaagtcagctctttgtagcctacagaaatggaagagtggatgaagcagtctctctgggttttctggattgctggataggtggagacctgacaaatttcaaaggctgctacctgactaaccaactgcctattcagatttttacagccatcttcgacatgaacacggatgtaatcatactctcacaattcatgtactacaggttaaagaatcagaagaaaaaaatttctgaagaagatctacggaaggaacttcatttctgctgtttgcattggccatgattgggaacttcacgtatggacttggtgtggttttaaaggcaccagctgctacgtgtcacaagaatacttactttgtgcatcatcttccttggcttattgcaagttttggaatcttattccttaactcttttgtgtcttttgccatcagattgccattagagaataaacatgtatagctacttaatatatcacccaaaaagtacatatatatatatatatatatattctaagaagtgtaaatagctaatgctatagtcatttcattattatatttgaaatgttcatttataaggaaagtcttctctttcccaaagtctcctaattattattattctagcaaacgatcaaattcagatgaagatttcttggtttctttggttcttctgataaaaaaaaaaaagtggggccaagtttagaagcattgaaattaacacatcttagatattaaattttattaaaattataatagcagatattaagaaaaaaccataccatctctgaaaatctctacagagaacactttgaattaataaatgataactgatgccttgccttttgttg

SEQ ID NO: 199082 - DNA, 937 bp, Homo sapiens
  misc_feature (51)..(51): n is a, c, g, or t
  misc_feature (53)..(53): n is a, c, g, or t
  misc_feature (69)..(69): n is a, c, g, or t
  misc_feature (71)..(71): n is a, c, g, or t
aaggacgatgatgtagagcatataatggtgaggcggccgggggctttagcngngacgactctcttaatntnccccgctacagtcttctacattcatgctgtagaagctatgaaagtcgtgggaaactatagagtcaacactgcaaactcaagcactgatacgtccggagagcacttgacctgccttagaagtcagctctttgtagcctacagaaatggaagagtggatgaagcagtctctctgggttttctggattgctggataggtggagacctgacaaatttcaaaggctgctacctgactaaccaactgcctattcagttctgaagaagatctacggaaggaacttcatttctgctgtttgcattggccatgattgggaacttcacgtatggacttggtgtggttttaaaggcaccagctgctacgtgtcacaagaatacttactttgtgcatcatcttccttggcttattgcaagttttggaatcttattccttaactcttttgtgtcttttgccatcagattgccattagagaataaacatgtatagctacttaatatatcacccaaaaagtacatatatatatatatatatatattctaagaagtgtaaatagctaatgctatagtcatttcattattatatttgaaatgttcatttataaggaaagtcttctctttcccaaagtctcctaattattattattctagcaaacgatcaaattcagatgaagatttcttggtttctttggttcttctgataaaaaaaaaaaagtggggccaagtttagaagcattgaaattaacacatcttagatattaaattttattaaaattataatagcagatattaagaaaaaaccataccatctctgaaaatctctacagagaacactttgaattaataaatgataactgatgccttgccttttgttg

SEQ ID NO: 199083 - DNA, 1396 bp, Homo sapiens
gagggacccggtccccgccccgcgtgctcaggctgaacagcttttcttccctgatctctcggaggcgccggctgctggccaacgcagggcagcctcctgcgtgcgtgctgtgggtttctccttcagtttcctctcattgcctgaggttgggcccgaacacggcggtacatttccttgagagtcttctacattcatgctgtagaagctatgaaagtcgtgggaaactatagagtcaacactgcaaactcaagcactgatacgtccggagagcacttgacctgccttagaagtcagctctttgtagcctacagaaatggaagagtggatgaagcagtctctctgggttttctggattgctggataggtggagacctgacaaatttcaaaggctgctacctgactaaccaactgcctattcagatttttacagccatcttcgacatgaacacggatgtaatcatactctcacaattcatgtactacaggttaaagaatcagaagaaaaaaatatattccaacctcagttattcaaagactccatcaccagagagaaagtcagattgtcactttggggagtcctctgccctgtatatatcccatattctttcagataagtgaaattagcatgcctgggtattacagttgtttatgccatactactataaatacttctaagagaagatttatcttgacttaagacttggaattttgttaaattaatgcacaaatgtatatgaccataacttaacgatgatttgtatattagctgagtcaagtggcatatataaaagcaatgaaggtttcttggacattctacactgaaatgtttagaatgtttaaaaaatttatctttctattttccaatagtgtggtaaatgtaaagtgcttagcactttgcgtgacacatggtagggcctcaaaaaatattagctattatcattataaaccagaggccctgttatgtggcagtttgtatctctctcttgactaatagaagcactttgcagatgatatgtcacacaatctagaaaggtagtgcttaaaggaatagacttatctccttattttacaaatgaggacattgaggccctaggaagttaaatgacttagacaaaatcacaaaggtaaagtggaaagcccaggagaaatcccctggccttcagcctgctgtgatttctaccaactatagattagaacttttcagacaagtggcacctgcaagtgtcttcgagcaaggcctcaacctccagcacagctcttgccacctgcaaacaccagggaagagcaagattgagttacatggcttggaagaagagtgaaacacctcgcaagacccagagaaaactccacatccatttgcagctaattttaaagcccaaataaaagcacaatcttt

SEQ ID NO: 199084 - DNA, 494 bp, Homo sapiens
ccaggaccaagctcagtatccagcattatgagatgacaattccaacagcaagccaaaaccaagctcagtatccggtatcacccagtgtcacatttcaacatttacacctggagcttaccataactccagaacccactatggaggctgagcattctataatgctgaggatgactacagctcctccaaaacaccctgaggtgacccttccaccttcagaccatgtgcaggctcagcacacaaacctgaggccacagtgcaacctttggatctgaaatttaccacgaatcaacaacctactacagagagtatattttctccaaccatggagaattcaactcagcttccagagccacctatggaggttgtaactcaacctccagctcattatgaggtgacagttccaatacaagatcaggatcaagctccgcattcaatactggccagtgtcacacttcaacctttggacctggggcttaccatcgctccagaatcca

SEQ ID NO: 199085 - DNA, 761 bp, Homo sapiens
cgtgtacatatttactgtttctctcaactttaagaactctagtctcacttcagatatattatacaaatcctaatcaagaaaaaaaaaaatcaatggattttccacttttaaaaatctttcttccctctccttttaggaaacgcagaaaaactaagctttctttcaataccaacaccaacaatgggctttcaataccataagcacatcaggggaattaaactcttccatggcagaaagaggagataatttaaaatgaaacctcagcctactcttcatagtctaccttaaatagttatactatgtttttaaaaagcaagttattactttagtaaccatttaaaagaaagtaactagaactattttgttataaagcatagctaagaaaacaaaatgtcccaatcattatattaacttacaaaagcatactaaattcaacttttgtatgtatctaatctgttcctttaagaattagtctaggccaggcgcggtggctcacacctgtaatcctagcactttgggaggctgaggcgggcagatcacaaggtcaggagttcaagaccagcctggtcaacatagtgaaaccccgtctctactaaaaataaaaaataaataaataaaaaataaaaaaaaattagccgggcgtggcagtgtgtgcctgtaatcccagctactcgggaggctgaggcaggagaatcacgtgaacccaggaggtggaggtttcagtgagccaaggtcacaccattgcactccaggccgggtga

SEQ ID NO: 199086 - DNA, 449 bp, Homo sapiens
ggtgacgtgtttcatggcatcagcaaggaggaccacagacactcggccccagccgccccgaggaatagccccacgcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctact

SEQ ID NO: 199087 - DNA, 2018 bp, Homo sapiens
aatggctggatgcatgtcagtgcataggatttgagtcattagtgtgccacaaaacattttaccaagaaatggtgcgtcatcaaatagttgaattacaatggtagctgtaaacgggacccaatttacaaaagtaaatagtgtccccttttacaagaaagaaaattaaccatgctcattcagattctgaagtttaattagctttaacttgctaaaagaaagaaattgaacaagtaaatagcatgtacttcaccatatatagcaaatcctgaatcactgccattttttatataactgacccacatgggttctttgctttttcttttatctgtttacctcagattttttttttttaataaaggactataatttgattggcttgtaaattcttcccatttctaacatgctataagactttaagcctaatttcctttgagccttaatcctcttgctaattgatgtgactgagttgtctggaatcaacctccttggtgcaaatgactgagactgtgacgttctatggaagcagtttggtccgggaatgaatcctttcattcagcaaacaaatgccatgccagctgagtcctgaaagagcccatgggcacgtaaaggaatatagttgttttacaacatgtcccccaaaattatttgacactcttctcattagcaagtgggactctgccccttccacttggatctgagctctgtaactgcctgccaatagaatatggcagaaatgacgcattgtatcagtttctgggcccagaccttaagaacctagcagcgtccacttcctgtctccttgtatgctcactcttggaacccagctaccatgctgtgatgaagcctaaagacccaagcagagaggaaccaacttgtcagctgtatgaatgagccatcttggaggtggattctccagttccaggagagctgccccagttaatgctacatgaaacagagacaagtcatcagtcatccatccccactgtgccctttccaagtttgtgagcaaaataaatgactgttgagttaagccatagagtttaggaatgatttgttgctggaacaaggaggtagacacataaacaattttgaagcaatgtagattacaatgacagtgatatttactacgtatcacaggaacactgagtcgagacacctaatccttccttcatcatcaaggaagactccctcaatgaatgagatggcaactgaactgaatctcaggttaaccaggttggagaataaagggtggcgtgttctaggcagaggggacaacagtgtgatcacaagcagagaggaaggaaacaacatggtgtgcagaaggaattatgagcacttaggtgttgctggagcttaaagctggaataggaagtactaattatgtagccagagataattggcaaaggttgaatcatgaaggcccgtgtttgccaggtgaagacatattgtgtacacacagcttgttattttcattattgttgtattgcattttggattgaagctgtctgatcaggtttgtgttttagacaaatccttctatcagcagtggggaaggtggatttcagggtatgaattctgaagcatgaagaccagtcagatggccgttgcagcagttcaggcaaggacaatgaggcctaaattaagactgcgagggtgaggatggggaagagaaactagagtcaagaaataggtggttttaaaaagaagtatttagagggtaaaaagaatactaactggccggatgtggtggctcacgcctgtaatcccagcactttgggaggctgaggcaggtggatcacaaggtcaagagatcaagaccatcctggccaacatggtgaaatccctgtctctactaaaaatacaaaaattagctgggcatggtggcgtgcacctgtagtcccagctactcaggaggctgaggcaagagaatcacttgaacctgggaggcggaggttgcagtgagctgagattgcaccactgcactccagcttggggacagagtgagactccgtctcaaa

SEQ ID NO: 199088 - DNA, 159 bp, Homo sapiens
gggccgggcgggcacccggcgggctgtggcggcgctaacaggtgcacctctctgcccgcagtgaccagctccgctgcacgacctggctgcacccgcgcaccggggagcccgtcaactcgggccacatgatccgctcaggtgggcgccgggccggcgggt

SEQ ID NO: 199089 - DNA, 165 bp, Homo sapiens
ggcgggacactttacctgagcattggtcctacggggtgtgccgggatggccgcgtcttcttcatcaatgaccagctccgctgcacgacctggctgcacccgcgcaccggggagcccgtcaactcgggccacatgatccgctcaggtgggcgccgggccggcgggt

SEQ ID NO: 199090 - DNA, 375 bp, Homo sapiens
atgtgataccaaacacaagaagccacacacaaatgactgcttattttatgattcccaaagctgataacattaattaatgatgttagaagtgagagtgatcgcccaggcatggtggctcatgcttgtaatcccagcactttgggaagccgaggcaggtggatcacctgaggtcaggagttcaagaccatcctggccaacatggtgaaaccccatctctactaaatatacgaaaattagccgggcatggttgtgggggcctgtaatcccagatactcaggaggagctactgtgaacctgggaggcagtggttgcagtgagctgagattgcgccactgtactccagcctgggcaaaaagagcaaaactccgtctcaga

SEQ ID NO: 199091 - DNA, 300 bp, Homo sapiens
aagataagaaaagttaagtgtattgagtgcacagaatactgttgattgtctctttcaattgccattccaatattctcctagcatatccctctaaactatcatggctggaaagctaaaaactccatttatcagacgccctttaagttatccagggttgtagatgggacttcggttctgccaattaggcgtgactgcaagatctgatatgggaaggaaatactcgagaagacaggctggctgtgggcatgcattttattggcttagttggtactgcgggcagcaagaccctccagtcagcag

SEQ ID NO: 199092 - DNA, 415 bp, Homo sapiens
ggaacagcaatagtgtgtaaacattagatgccattagaaccaaaattgaccataagaaccagagttcagaaaaatgactaactgctgtccttcattatgtatttccactcaacattagcatttatgaaacattttgcacattatcctgtcctcacccttgcaatgttacatttatataatctgtgtaagtgctccactgccccacagagtcataagtccctgggacttggtgatgtgcacagtgactggcacagagggtgagctctgtcgtgcttgggaagaaaaatggtcttcaaatgaatcttgccttgtcttgaaatgtataaactgccttttctagcaaaagcatagacactctttcccttggtgacatgtgctacgaattcagctgggttgaggatctgggctaaatgaa

SEQ ID NO: 199093 - DNA, 655 bp, Homo sapiens
tatcgaggtcactctaaggatcccgatcattgaggcagaaaactgacaaagatattaatgacctgaactcaatacttgaccatatggacccaattgacatctacagaacactccaccccaaaacaacagaatatacattcttctcagctgcacatggcacatattctaaagtcaaccacacaatcagatatagaacaatcctcagtacaatttaaaaaaaaaatgaaatcatactaaccacactcttggagcacagcaccataaaatttaaaccctaagaacattgctacattaacaagcaaagataatatcaaaacatttgtcaattaagttaaattaggaaaaacctataaagtttccaagagattataaaggacaaaagagcaaaaattttgccctactgaaaagttacatgatttatagtcatcataagccatccaaaccagtcttatttgctttagcttagtattgacaaaactgaagatgtttaacaaaaacagatataaaagtaagaggagaaaatctttaagaaatgctttgaggccaggaaggtggatcacctgaagttaggagtttgagaccagcctggccaacatggtgaaatcctctctctactaaaaatacaaaaaattagccaggactggtggcaggcacc

SEQ ID NO: 199094 - DNA, 273 bp, Homo sapiens
aatggtgtgttggactcccatgtaccctcaacccagccttatcagttttcaaaccatggccaagtaagaggcacttttgaaagagaacataggaggagttaccaaacagtaaaggcagaaattaaaagcaactgtgcctgctttgtttagaatacccaaaacctggaaacaatccagatgcccaccaataggtgaatgcatcaaccaattgtggtatatcttttcactggaatactattcagcagtgaaaaggaaatgaactatttatacata

SEQ ID NO: 199095 - DNA, 837 bp, Homo sapiens
ctcgctggttgctcagagctgggcagcagcgtaggtttagaatcaaaagacagcacagaccaccggggctgaggactctgtttttcttgtgggctgagttgttaataagtatggccgggtgcagtggctcacgcctgtaatcccagctctttgggaggccgaggtgggtggatcacgtgaggtcaggagttccggaccagcctaaccaacatgacaaaaccccgtctctactaaaaatacaaaaagaaacaaattagctgggtgtggtggtgcacacctgtggtcccagctactcgagaggctgaggcacgagaatcaattgaacccaggaggtggaggttgcagtgagttgagattgtgccgctgcactccagcctgggtaacagagcgaggcttggtctcagaacaaacaaacaaaaaaggtagtgtgacttctacatcgcataccattgtcttggttcatacaaagcgtctttctgaagaactgatggttttgctttggctcagtgaagtaaaatatggcctacctttaagaagttaagatagtcatttaactatgcttaattaggtttacttggggaaaagtaaaattacaaaacaattccttgcattcctcaccgttcctggttaatgtagtgtttaaatcgcgggagggccaactgcggtgaaagtctgtgaggaaggaggcggatgttcagcgcagtcacggggaacataggaacgatttccgtaaagcgctcagtttggaaaagtcaccctgagactccataccagacttctcctcatctttttcttttccgggtaaactgaactgtggtccctgggctgtgttttgaa

SEQ ID NO: 199096 - DNA, 466 bp, Homo sapiens
aacattgtattaatatataaagaaaagataaaagccactaaagccatgaaagaaagaaggataatgccatagaaaagactggaggtcctaacaccaacaccctaatgggatgttggtgactggagtcagtccagtggccttttgggtaacatcaaagtatagcctcagccagataattgccccagaacttccttccaattccatgcaatggctagacctccatgaagaaaactggattgaagcaaagccaacattcccaacacccaagggcgatgggtgattgacaaacccctccccagcaagcctgtcctctgaagacatgccattcactcttaactggctaacagaggcccaatgcctcatctgtttttggaaaaaaaaaaatctccatacaagaagccttggaatgaaagtgaaagaggtccactcttattcacccttctgccaatcccagatgagcccctgg

SEQ ID NO: 199097 - DNA, 290 bp, Homo sapiens
cattagcagcattaatggcaggctgggtccttactgtctatggttcaaatgtcctaaacacatttctactgactactggccattttatgcccctgaagaaatgtcctctactttttatggtctgaacacaaatcctatctaatatggaactgaaatccatgtctttatggtttccacttacttcctcactttgacttttggggacacagtgaccaagttagaggtttttgatacaggacagtctatcagttatgagaaactggctgccatacccacccaactcctttatt

SEQ ID NO: 199098 - DNA, 166 bp, Homo sapiens
gccgtgggaactgttcagctaacttcctaaggcttgttaaactgtcagcaccaagctgacttaatattccaggaagcatttctgtgattggtttggcttctgcatgaccagtaattgcaaaggtattagcagaaagggaagcttggactttgggattgttgaaatg

SEQ ID NO: 199099 - DNA, 562 bp, Homo sapiens
ggaatggtaacagctaccgcttagaaaaatagggcttatttaatcaatgcacagatgctaaagcagagaatgggcctcttctccaagtgatgttgaaggtacaaatcgtaacggtcaagtctacttggaagacgttttttaaaaaagatcatctctgctgtctcctactacatttggtgggtaaatttcagcaaggaagtttagttcctgacactcagaatgaagttggatttcaatttaaatgaaaaaggacccggtgtgtctttattctgtgctcagtacaactcctgttatgctttgggaaatgtccagagaggaggagatgggggtctttgctttaagaacttagtctttaacttggacgagacaattaatgcactatggataacttagagaacaataactagatccttgagcggaacagtcaagacagttaaggattaaatggtgtgatagaagcactaagcaccatagcattttggaaaaagacttgatttacttcaagtaccaggagattgggattcttggctaagggatctttaaccctacacttttctaccac

SEQ ID NO: 199100 - DNA, 274 bp, Homo sapiens
  misc_feature (32)..(32): n is a, c, g, or t
ggacatgatacgactcgagctcggaccggaanggtagctgtactgacttcattcctcctattttgaagttgaaagagatgcatttactttgttggaacaagatgtgttcttccaccggctggttaattgtcatgataacagtaattttgttagaagaaggtgctctgctaccatttgccaaaagattgtcataatgtacaattttcccaatgcaagggtcagcagattataataaaaatatgaaaatgtttcacagtaacaaaaatgctagtat

SEQ ID NO: 199101 - DNA, 371 bp, Homo sapiens
ggggtgggtaaggagtccttgatgtcctgtaaatgaaggaaccaaatggagttcctccggctttctcagctaagggagagcttattcacatggaaacaaggctaggtgattaagggagaaagggacagtctgaaaacaaggttagtaaaaacaaggttaggtattagaactgcaaagagtattaagtgaaataagtgaaggaaaatatgagctcttatttttaaaaagttgtgttggggcaaatgttaaatatctttctttctctggacattattaagaaagatagagtgatgtgaatgataggaagcccacctgtaaccacttagctgacatgtccaactatgggtgaacaggaaataagcgacattcac

SEQ ID NO: 199102 - DNA, 455 bp, Homo sapiens
aagcattcttatgtgcccagctcagtggtggtcacttggtggaagaatatgatctatcaccaaggagttactacttagtttgggaggaatcttaagtaacatggaataatttggtctatcttagccccccaaaagattgctttcatttatttatttagccacgctttggcataattctttaacttgctattgggagatattttggttacccattgtcaataatggggcatagtgaatcttccccaaactctgtggcatgcaacagtgaacatatatttagctcatgcatctgcgactggggggtggctgaacccagctgggcttgcttatgcaactgcaggtcagcagggggtgtgctgagctaggctgggctcagctgtgtggttctgctgtaggctacaggtctgtgggttaagttgaatgagcttgactccaggtatttttttaccttcttt

SEQ ID NO: 199103 - DNA, 592 bp, Homo sapiens
acagctgcttttacgactctttcatgttctagcagacgccagatgcgaggcttctccttacagggaagggttatgtttgatttatcatacatttctggagtttttgtttagtttttgttaaatgcaaagctctgtgctggacattgtgagaaacaggaagttgaacgcccataaggagtttagaatagaagtggaagaagtcagtaggtgcccaaatgctatttgaggtttgaatagagaatgggtagaggggagtgtcaagggtaggctaagtttggagttacctaacctcaaagttccaaactgggagactggtgttataattgggagctactgcttttacagtcccctcctaagtgccgtgtgttcccgggacattgggaagcaggagaaaatgggtggtgaaagccaggtggcttctaagatccatgtcagttctaacacttttgacatctacgaatgattcagcatggttgtctctgaagcatgctgcaaatcacctctcgtagcctgcaagtacctgtaggggctaagctttgtagatgccacaggtgctcttagaaagcaaggaaagaaagaagagagagaagaa

SEQ ID NO: 199104 - DNA, 744 bp, Homo sapiens
tgatgaaacattggtagtcagttaaaggtacccattaagaggacccatggaagaaattgctgtctagtcttaatattagaatagttgggtttctccagagcagatgcagtgtatattatacagacagtgaagcgtatagccagtggtgttgtttatgcaatggctgtcagaacgctgaggatcagatttttgacccacttctaacaaatgtgaaagacctatgccatgcatgttatgtatttacagtactcatagtttcatcttctctaccttcattttcctctggtcatatcaccacccatttttccataagcatcttttaatgggaaaaaagtgatgcataaataaggttttaaataaaaatcaactctttaatacttgaacaaatatgttctaagtagttaattgtggaagtgtggcagaccagtctctttcttgttcactttgtctttttgctgctttgcccatcgaaggtgctcaatacatattgattgtgttgcatggagttgctgtaagaatctaattttgatgctatagttctctctcaaagaaagatggtagtactgaagttactactctcctcactcacttatggaagtggattcctcttttcttcctgctgccctcacctgctctaaatcttcctatttccttgctaccccatccccacctgagttaaagtatagtttgcatcaactaccaagccctgtaaccatttgttctgagagtttcctgtgtcataaa

SEQ ID NO: 199105 - DNA, 209 bp, Homo sapiens
tgacatccactcaggctacagcagcaagtgtagttgctcacacagagtactaataatgtcattttacacttaaacagtattttcatgcacagaccactttcatataaatcaaaactgagctaaatcgttccaagctcctgagaaaacttgaggcttggaggggtgaagtacttcactcaaggctgtggctaggaccagtgacagtacaa

SEQ ID NO: 199106 - DNA, 292 bp, Homo sapiens
aggctcttcttccccagtcaccttactctcaagccagaggggttgaggaagccccatcatagaacctagtcatctcttaggtggaatggcctctgagacaaaacattaaagaggatggggagtacatcttgcttcttaataatgttattgataccagagctgtattttgacattatgcaaaattgatactgagatgccagcaaggtcattttatctcagttttgcaacagctaatttgaaaccatgggcacggtgagcagactgcatgctgtcactggtcctgaggacattg

SEQ ID NO: 199107 - DNA, 319 bp, Homo sapiens
agaaaatgtctgccaaattactcaggtgtgaatacccattgtttgaccatcagtaatgctttgaagtaaaaacggtgttctgtgaaaaatgaagctagcttctgtcttctcttgggactccaatcatttatgttagaccttactggccatgttctactgatttatcatgctttttctgcattttccagccttttatctctctgtgcttcattctggatattttctactgtccaatctttcagttcactaatcatttctttagctggtctactactgcaaactcaccaactgagtttcttgatttcagtgattttttgtt

SEQ ID NO: 199108 - DNA, 532 bp, Homo sapiens
atgatatgtttccttttgttcattttgtactgggttgaatatcgtcccccataatttcatgtccgcccaaaacctcagaacgtgaccttatttggaaatagggtcatgtagacatgattagctcaggtgaggtcatattagatagagtgagccctaattccaatgactggcgtcctcaccagaaggccacgcaaagactcagagacaggaagggaggccacgtggccacacaggcagagactggtgtgatgcagccaccagccaagaacagcggcagcagcaggagctggaagaggcaaggaagggtctgtccccggagcctgcagaggaagtgtggccctgctgacactttgactttggacttctgacctccagggatgtgagagggtaaattcctgttgtttcaagacacccagcttgtggtaccatgttacagcagccccaggaggctaatataatcctttcatttttgttttgtgttatgtttagacttatgaatataaaacaaatacaataaaaaaataaatgatct

SEQ ID NO: 199109 - DNA, 258 bp, Homo sapiens
tgtttaaagtatgtttccaaccactggtcttggcctggtcagagggtgttttgtttaagtggccaattcctaaacaatagtggattccagaatgggttgactttcttacagagtgtgtgcacttgaagatttcagctagtctctcaaaatgttagtaaaaggccggcctctcaccaaatgctccacgcagagccagtggtcccagaacttgctgagtggcaagaggagacttgtcttcaagtaagggacagccttgaa

SEQ ID NO: 199110 - DNA, 499 bp, Homo sapiens
caaacactttctgattgaaaaattatcagagactttaaagtataacagtattgatttaagagcaaccaggtctgcacatttgtaagatgacaagcaagttgtaggctgacaacttgctgcagtgatttgaatgatacagacaaggtagctgattaacatttgctgaggatttactctacgtcaggcatgatgttaaagatttcacatgtaggccaggcacggtggctcacccctgtaatcccagcactttgggaggccgaggcgggcggatcgcaaggtcaggagatcgagactatcctggctaacacagtgaaaccccgtctctactaaaaatacaaaaaaattagccaggagtgttggcgggcgcctgtagtcccagctactcgggaggctgaggcaggagaatggcgtgaacccaggaggcggagcttgcagtgagccgagatcgcgccactgcactccagcctgggcgacagagcgggactccatctcaaaaaaa

SEQ ID NO: 199111 - DNA, 526 bp, Homo sapiens
gattagacagactacatagataaacagataggtagattagactagatagatagatagatagacggatagataggtaaaaacagacagatagcacctgcaaaagactggatcataagaactgcaaaggtactgtagctttcacagaaagaaacatctatgcttggcaattgaatttactttctgaaatcttggagaagtatgatgaaggaaggaagtatctagtttgagtcataaatgggagcagaaaaagaacccaacgatctccaagtcctccaaatgctgtgcagcggataacagactgtcctcatctggattaactggaaatttggcacacgttcgggggtcaacagctacggctggaaacgaagccagggttcatacgagggctcactcacgtcagtcaaagagaccttttcttgcacctcttcctaatcctattagggctactcatgttttaaaatgttcatcccgtctcagtttcgctggaagggggacactccaatgcttctgacacgaaaacatctca

SEQ ID NO: 199112 - DNA, 268 bp, Homo sapiens
gaacaccaagtctgagatgctcgggactgaatatgcctcttacatatttatacattagtgattttctcctttccaaatcgggccatctatctttagctgtgacactgaacgagccaccaccgcctcccttccccagtgggattgaacatgcacttcctcttacacaaagcacaacagtcctgaccaggcaggacgggggctgtgtgcagagacgctccaggctggaagttggaagtggtactgcacagctttcctatgtgattttctc

SEQ ID NO: 199113 - DNA, 403 bp, Homo sapiens
agttttcaacccatgatactaattttgttgaatataattaattgtcattcatacagaacatttggggaaaggagtattttgatttactggatattctcagagtcagtaaagaatgacagtgggtaatatgtgtggatcacagattctgatcaagtagaatcaatcgcataagacactgaaatgtggctggttgtgctggatgctccatttgggatggtccatcacaggctcgctgagcatccaacgagggccggtgctgtgttgggcacgctggggaggccagaaacgcatctctggttcttcccaagtcatgtcccgctgttctgatgtcagctgaggagctttcacttgcctttcttggaagagcatgacacatattcagtaaaaccagctgttgagcccc

SEQ ID NO: 199114 - DNA, 377 bp, Homo sapiens
ctctgtggtcagaattccaatatctcatgtcattgtcaatgctaacttggacttcagcattatcccaccatcatgggtttttccttattgacctgtccagctcttttttttcttgtcatttcaaccttggcactggaagccagtcacggacacacacacatacacatacacagctattcctggaaacacagggctgagattggagtctgctgggactagggagggagaaactatgcaaattagataactgtaaagcaaatactgtaataacttgaagtttgtgctaacacacatttccaagacccggacagtccccatggaaacaggactttgctgttgcagttacatcagaattctcttaggtaagtatcagtaac

SEQ ID NO: 199115 - DNA, 399 bp, Homo sapiens
tagtaacaaaaataagaatctaaagtatcattaaccataataatctaagaaataagtaaaaatgcaaagtcctaattacgcctagaagctaaaaaacacaatctgacataaatatctaatcagcaatatgctcgctgtataaagctcttgatgtcgtcccatgaagttgaaggaaaggcaggttcagataaccactgaaagtcattatccttgtcacagcaataaaaataatcaaatgaaggcttatttagctatatttttatatcgcagttaaacattgaacaagataagattgaactgcacagatccctttatacacagatttttcttttgcctctgccacccctgagacagcatgatcaacctctcctcctcctcaacctacatatataaagacga

SEQ ID NO: 199116 - DNA, 541 bp, Homo sapiens
  misc_feature (40)..(40): n is a, c, g, or t
  misc_feature (194)..(194): n is a, c, g, or t
  misc_feature (494)..(494): n is a, c, g, or t
caagtatttactgaatgccttctacttcaggtatttcccntaaatgctgggagtgcttcaaaacagatttgattcttgctttcatggagttcacgatctatgagtgagacagacattaatcaagtaaaaaagtgataatacaattataaattgtgaacagaacaaggtgctgtaaagtagaatgacagggtganggggtgttcagtctataaattagatgatcagaaatggcctttctggtgaacatgacattttcatttgatcagattaagaagtcaaccttgtgaaagtagggaacaagttctccagccagagtgagctgtttcttactaatgtgactggcttgttttatcaaaatgaatcataatgtttagttggtacttcatcagtactcaatacatatttacttattgaatctaatgattagattctgcatgctcttccatctctcttataaaagggcttcgtgttggactatggtacaattaggcacntttaagaaacaacaaaatatttttgaagtaagttctacgtatttatt

SEQ ID NO: 199117 - DNA, 155 bp, Homo sapiens
aattataatcgccgatcactttttccattttaacataatgccactttgcagaaataattccaaaaacactaggatttatggggtaagaagagggacagaactgctagttccaaacagccttgccatgcacactcactgacgcacactcacacaca

SEQ ID NO: 199118 - DNA, 672 bp, Homo sapiens
cttgtaatcatctataaaaaattaactaaaaaatggatcatggacctaaatgtaaagcctaaaactataaaatttctagaagaaaacacagaaaaaaatatttggccttgaatatcatatcaaagatttttttatatctgacaccaaaagcatgatccataaaagaacaaagttcttgtacatgagttccttatgtattctggatctcaataaataaattggacttcatcaaaattacatacttctgcactttgaaagacactttaaaaaataaaatgacaagccacagacagggagaaaatattcgtgaagaatatatctgattaaacatttatattcagaataaacaaagaactttcaaaactcaacaataagaaaacaagcaagctaataagaaaataagcaaagatctgaacagacacatcaccaaagaagatatacagatggcaaataagcatgtgagaaaatgttcaacatcatttatcattagggaactgcaaattaaaacaacattgaaataccactacatacctaatagttaatgtccaaagcatagtaccaaatgctgatgaggatatggagcagcaacagaagttctcattcattgctggtggaaacgcaaaagggtaaagcaactttggaagacagtttggcagtttcctaccaaattaa

SEQ ID NO: 199119 - DNA, 360 bp, Homo sapiens
tgataatattctggggttctttaagtatggattacacaggtacacccacttgttaaaattcattgtgctgaacactgaagatactatgctttatatgtgttatacttcaagaaaaagtatacccaagggaaaaaaagtaattctaaatacagaaaaactctatactaaaactttcatttcaacactaaagggagcatgctttaaaattagtatgtgcatatatattatatgtaattatacatatacataaataaaacattagacagtcaaaattatatctacactaaacactttataacaatgtgttgtccagctgttaccctctccctcatctgttatattgtcttggacttaatctcc

SEQ ID NO: 199120 - DNA, 379 bp, Homo sapiens
atacctcttcccctctctgggtaaccaggatgaaaaaccctatagttggcatggaaaagggcttccaatctaccagtcctctgcctatggcagacattaccaatccatcaccattttctaattccacacaggtggcaggcagacattgctaatcaatctgtgtttccagtcctgtggccaaggcagacattactaattgatcactgtttttccagtctacactgaggcaggcatcatcagttgatcagttttccctcccactgagcctctgaatcctccataacacagaggtaccaacagcacacacagcagtgtcacctcagtttgcctgtctgagttaccatttctcatctgggcaacatagtgagaccccatctca

SEQ ID NO: 199121 - DNA, 202 bp, Homo sapiens
atgttccttcaccatttgggagggcaccctctagaatagtattgggaattacatatttgtaagggatttgaatgtgtttttaaaatcttctcagagcttataatattagataatattattagataaattatcacaagggtccatcagcaatacaatgggggcaaatattcaagcccatcctgatcaacgggtgtaagtgttc

SEQ ID NO: 199122 - DNA, 360 bp, Homo sapiens
aaaaaatattaacactatgtgtaatagttatcccagtctgtcatttctctttaacttagattatggtatcttttgtggtgcatattattttatttttttatgtagtcaatactaatattattttcctttcttgtcatgcttccccacacctagaatttttatggcataactttgagaatacaatgagaatttattgttaggggtgatacaaggattctagttatatttttcataactagaatttattgttaggagtaatacaagaattctacttatatttttcataaaatgccttggtagttgttcctaaatggaataaattcaccttttccccactctttgaaatgtggcctttatcat

SEQ ID NO: 199123 - DNA, 673 bp, Homo sapiens
ctttaaattaattcttccccacttttgattccaaaaccaaagattgtcttttcttaatctctaatccagtacttggttctggtttttgaatacatgacagttcttccattttctcaatgcactgaccactaagaagctcattttgctatgatgagccaattcacacagagctcagagcaatagaaaacattgttttcatttaggttcacttaggtgtttatgtcagcttgcatgatatgtttatatgaaaggctgccttttggtgaatgtaattcccttgaaatatcctattgaggatctataactattatttttataatgttatcgccttgaattctgagaaagaaaaattcagattggcagaattctaaccatataggaagttacccatggtaatatattgttatttaatatacattaaatattgatacaataacatattaaatgaaaggtctataggaatctggaacttttttgttccatatctatcttaccacctacctccttccctgaaaattttccatctgtcattcaatattagaaaataatataaaatgttctgaggctgggtcagccaatgcgcaaaaagttaactctccttctttgctctaaccttagcagagagagatctactagttcagtcataatatggtgttgggaaggtagccaagtg

SEQ ID NO: 199124 - DNA, 442 bp, Homo sapiens
gggccgggtgtggtggctcacgcctgtaatcccagcactttgggaggccgaggcagatggatcacgaggtcaggagatcgagaccatcctggctaacacggtgaaaccccatctctactaaaaatacaaaaaattagccaggcgtggtggtgggtgcctgtagtcccagctactcaggaggctgagggtggagaatggcatgaacccaggaggcagagcttgcagtgagccaagatcacgccactgcacttcagcctgggggacagagcaagactctgtctcaaaaaaaaaaaaaaatatgcccacactggaaaacagttttttaaaggagatacaacactatgaaccagcaactccactcctaagactgtacccaagaaaaatgaaacgtgtgtccaaagacttgcacacaaatagagtagcatttttcacagtaacccca

SEQ ID NO: 199125 - DNA, 252 bp, Homo sapiens
aaggtctaggatccgcctattagacatcttctctgatccttgagaaattttaaaaggggctatttatgacttggcaggatatcgaagaggagactgaactactgggggaaggatgggcggaatgaacttaaaggtgccgttgaccttaggaatctgtgactctaagagtttggtgctcctgtaatcagggacgttggtcagagggtagcagatttgctggctggcctgatgtctgatagggaggtggatgcc

SEQ ID NO: 199126 - DNA, 497 bp, Homo sapiens
tgatccttccatctcagcctgctgagtaagtggactacaagcacacaccaccgcacccggattattattttttttaaatttatttttattattttttgagatagtctaactccatcacccagggtggaatgcaatggtgagatcttggctcactacaacctctacttcccgagttcaagcagttcttgtgcctgcaattacaggtgctcgctaccacggccaggtaagtttttgcatttttagtagagacggggtttcaccatgttggccaggctggtctcaaactcctgacctcaagtgatccacccaacttgccctcccaaagtgctgagattacagacatgagtcaccgtgcccagccatacccagcttactttttaaatttttcatagacatgggacttcaccatgttgcccagtctcgtcttgaactcctgaacctcaagtgatccacccgccttggcctcctaaagtgctgggattacagacgtaagccat

SEQ ID NO: 199127 - DNA, 419 bp, Homo sapiens
gggatggccagtcacttgtgacctactttcagagctggcagttctgacttctagaacaaactcggaacaagcccatctacagctggttgactgagtttcctttgggctcctggcaccagaaagaattgctcactggaaggatcataggtggcactcatgtctcactgccccactcagcttgcctgtgtggactcctgcctgctctctgtgccaggatcccgtgacatgaaacagaataagtgcttcataaacgggagtgacactaggcgtggtggcatgcatctggagtcctagctacgcgggaggctgaggcaggaggattgcctgagcctaggagttggaggctctaatgcacttggatagcacctatgaatagccagtgccctccaacctgggcaacatagtgagctcttgtcaca

SEQ ID NO: 199128 - DNA, 478 bp, Homo sapiens
agcaggacagagaagaagctaggttcactacccacacccactttaacaggagtaagccagcttttgttggttttatattaatatgacaaattcacttaaggcttagtccccgaaaccagaggcttgtttcaaccacttttaaaagtttaaaaacttattttacagataagaagccaaatccaaagataaaaaaactggctaggcatggcggttcacacctgcaatcccagcactttaggaggctgaggcaggaggattgcttaagcccaacagtcgagaccagcctgggcaacacagcaaggccctgtctctacaaaacacatgaaaattagccagcatggtggtgggtgtctatggtcccagctactggggaagctgaggtggcaggaccacttgagcccagtaggtcaagggtgcagtgagctatgatggcgccactgcactccagcctgagcgacaaagtgaggctctgtctcca

SEQ ID NO: 199129 - DNA, 444 bp, Homo sapiens
ctggtagcttgaatgtgggatatgacgggcagaaggagggcgtagcaggggaaggaaataaagtggcttgttctgtatgtgactggagcccagctccttgcaccaacccgggctcctgcacccctcagcaggcccagggatccccaccgccaggccggagccaaccccatggaacccaaagtgctcaagctccccagtgaatgaggctcttaatgtatcaccgcccgtcaggcctggcctggcatccgggtttctccacctgcggggtgcaggggccacattggtgggttccagattccaagttccagtatttggaggaggtggcagaggagggcccccaccccaccgttttcatctttcacccaagatttgcacaggtttcattttaatgacagtccactgtctgtttgttagttagctttgagatagagtctcactctgttg

SEQ ID NO: 199130 - DNA, 473 bp, Homo sapiens
gtgagtggatcctgtaagatcctagtttttgtagctgggattacaggtatgcgccaccttgtccggctaatttttgtagttttaatagagatagggtttcgccatattgcccagactgctctcgaactcctgatctcaaatgatccgccgttctcagcctcccaaagtgctgggattacagatatgagccaccgagcccggcccaaagggttattttctgagtgcacccatgatgtgagaaaagttgttaagccctgactttcaaatttctcttcctggaaactgacctggattttactaatgtcctatctatggcagagtctggagtgaaccgaagactaagcataaatgctgcaggtcaggggctgtttcttatgcctgaacatcgcggggccttggacaccgtctttccaaatcaagacagcatagagcacaagtgctcagagggaatgagcgaggatgcagctggctgc

SEQ ID NO: 199131 - DNA, 446 bp, Homo sapiens
tcatggtgctttattttcctgcgaactttgtaccttgaaaccgtcaactcatatttctcgaaactttaactttttttctttgagtaaagatgaacgcccaaggaaagatatgcttttttttttcttctgaaaagtaacataaattaaggctacttgtgatcataatttgttagaaaaaatttttttggcttttccactcagcacccaaggtttgacactggcaattttccatgcagtccctggggtgatagatttattttcaccttacagaaaggtgtagtccatggggttccagctttatgatgaagtttcctaattaggcatcccatatcaggtggaccctgggttttgtctactataactcaaagcaataccaattacagtatcatcataacatttaagcattaacgataattatgacattatgatgagtgaaagaagcagtt

SEQ ID NO: 199132 - DNA, 728 bp, Homo sapiens
ttctcagtcctggcaatcaatcaatctccccactcaggacaggaccccctctgtcctcttctaccttctactgcactgtcgagacaagcttctgtgacttcatcagtgctgagaaatgtgaaagacgtgccacggcacaggtctactgagaacagggaaaggccaatgttctcaacagaatgtggctgggagaataagcaccatcaacaggttaggtccttaaagctaccaggtgccatcccccaagtccctggaagaggggctctcacatccccccgcgccactcaatgacgagtcactgccccctacttattcccacaggcagatgggaccaccaggtgctggtcctgttgctactttccacagcaggcactcaggtttcagccagccccagcccgagcccccaaccacacctctgataggaaaacaaaccctgagttttaaacaaattggaacttgtaaaaatgtagcccatgggtaaactgggcattttctgagaattttgtttcataaaatatgtatataagaacttagagtttcaatttctttaacttgtctgggtatgaagttcagcagtctccatctcttagaagtagaaaccaggcagggtgcagtggctcatgcctgtaatcccagcacttccagaggccgaagtgggaggatggcttgagtccaggagtccaagaccagtctgtgcaatatagtgaaaccccatctctacaaaaaaa

SEQ ID NO: 199133 - DNA, 1071 bp, Homo sapiens
aggagtcggcggcggcagggatgtgggaaatgtagttgggagactccgccctcctcgccattcctgtaatggctgcttcctagaaggtcgtgtcacgtggaacctcttaatctcagcatccggagctccaggaagggaaaatttcaagtcagatagaattctatatataccatttctttggaaccttcagccctcaagattccaacatcatgacctcagtttcaacacagttgtccttagtcctcatgtcactgcttttggtgctgcctgttgtggaagcagtagaagccggtgatgcaatcgcccttttgttaggtgtggttctcagcattacaggcatttgtgcctgcttgggggtatatgcacgaaaaagaaatggacagatgtgactttgaaaggcctactgagtcaaacctcaccctgaaaacctttgcgctttagaggctaaacctgagatttggtgtgtgaaaggttccaagaatcagtaaataagggagtttcacatttttcattgtttccatgaaatggcaacaaacatacatttataaattgaaaaaaaaatgttttctttacaacaaataatgcacagaaaaatgcagcctataatttgctagttaggtagtcaaagaagtaagatggctgaaatttacataagtaatatttcataatcttagaattctctcaaagcatgtgaaataggaagaaggaagttcttgcccagaatcttaggaaatcaccactgttcggttataatcactgcctcctgaatcgttgaggagtcttttaaattagatttttgttttgttgtctcccaagttaatattatatttagatatcagagagtcaggcaaaaaggaaaacttttatctctagggaaaaaacatttagaaaaatgtattcagtgtatctaatactgaaatgcggaaaaaaatttaatgttaaaaaaaaaactatagacattgacatggaaaagagatttaatgttttgaaaaaaaactttatattaactgagtaacatcctcctgatgagaagtactatattaaatataaacccattatgttataagttaa

SEQ ID NO: 199134 - DNA, 441 bp, Homo sapiens
aggagtcggcggcggcagggatgtgggaaatgtagttgggagactccgccctcctcgccattcctgtaatggctgcttcctagaaggtcgtgtcacgtggaacctcttaatctcagcatccggagctccaggaagggaaaatttcaagtcagatagaattctatatataccatttctttggaaccttcagccctcaagattccaacatcatgacctcagtttcaacacagttgtccttagtcctcatgtcactgcttttggtgctgcctgttgtggaagcagtagaagccggtgatgcaatcgcccttttgttaggtgtggttctcagcattacaggcatttgtgcctgcttgggggtatatgcacgaaaaagaaatgggaccagaaaatggggtttttgggggaaaaaccccccctttttttttttttttttgggggggg

SEQ ID NO: 199135 - DNA, 1030 bp, Homo sapiens
  misc_feature (1030)..(1030): n is a, c, g, or t
aggagtcggcggcggcagggatgtgggaaatgtagttgggagactccgccctcctcgccattcctgtaatggctgcttcctagaaggtcgtgtcacgtggaacctcttaatctcagcatccggagctccaggaagggaaaatttcaagtcagatagaattctatatataccatttctttggaaccttcagccctcaagattccaacatcatgacctcagtttcaacacagttgtccttagtcctcatgtcactgcttttggtgctgcctgttgtggaagcagtagaagccggtgatgcaatcgcccttttgttaggtgtggttctcagcattacaggcatttgtgcctgcttgggggtatatgcacgaaaaagaaatggacagatgtgactttgaaaggcctactgagtcaaacctcaccctgaaaacctttgcgctttagaggctaaacctgagatttggtgtgtgaaaggttccaagaatcagtaaataagggagtttcacatttttcattgtttccatgaaatggcaacaaacatacatttataaattgaaaaaaaaatgttttctttacaacaaataatgcacagaaaaatgcagcctataatttgctagttaggtagtcaaagaagtaagatggctgaaatttacataagtaatatttcataatcttagaattctctcaaagcatgtgaaataggaagaaggaagttcttgcccagaatcttaggaaatcaccactgttcggttataatcactgcctcctgaatcgttgaggagtcttttaaattagatttttgttttgttgtctcccaagttaatattatatttagatatcagagagtcaggcaaaaaggaaaacttttatctctagggaaaaaacatttagaaaaatgtattcagtgtatctaatactgaaatgcggaagtatgtagtcgactacatactccgaattctaagtataattaaattggaaataccatttataattatattaggtaatcagagacaaatactttggaatacatttn

SEQ ID NO: 199136 - DNA, 1159 bp, Homo sapiens
aggagtcggcggcggcagggatgtgggaaatgtagttgggagactccgccctcctcgccattcctgtaatggctgcttcctagaaggtaatgtacgaactcgtctccaaaggatacttaggttgcaccagtgtatttgtaaaacaggagcaaatttggaccttgccgggccaaagtcgtgtcacgtggaacctcttaatctcagcatccggagctccaggaagggaaaatttcaagtcagatagaattctatatataccatttctttggaaccttcagccctcaagattccaacatcatgacctcagtttcaacacagttgtccttagtcctcatgtcactgcttttggtgctgcctgttgtggaagcagtagaagccggtgatgcaatcgcccttttgttaggtgtggttctcagcattacaggcatttgtgcctgcttgggggtatatgcacgaaaaagaaatggacagatgtgactttgaaaggcctactgagtcaaacctcaccctgaaaacctttgcgctttagaggctaaacctgagatttggtgtgtgaaaggttccaagaatcagtaaataagggagtttcacatttttcattgtttccatgaaatggcaacaaacatacatttataaattgaaaaaaaaatgttttctttacaacaaataatgcacagaaaaatgcagcctataatttgctagttaggtagtcaaagaagtaagatggctgaaatttacataagtaatatttcataatcttagaattctctcaaagcatgtgaaataggaagaaggaagttcttgcccagaatcttaggaaatcaccactgttcggttataatcactgcctcctgaatcgttgaggagtcttttaaattagatttttgttttgttgtctcccaagttaatattatatttagatatcagagagtcaggcaaaaaggaaaacttttatctctagggaaaaaacatttagaaaaatgtattcagtgtatctaatactgaaatgcggaaaaaaatttaatgttaaaaaaaaaactatagacattgacatggaaaagagatttaatgttttgaaaaaaaactttatattaactgagtaacatcctcctgatgagaagtactatattaaatataaacccattatgttataagttaa

SEQ ID NO: 199137 - DNA, 1437 bp, Homo sapiens
aggagtcggcggcggcagggatgtgggaaatgtagttgggagactccgccctcctcgccattcctgtaatggctgcttcctagaaggtaatgtacgaactcgtctccaaaggatacttaggttgcaccagtgtatttgtaaaacaggagcaaatttggaccttgccgggccaaagtacgaattctttttcaaatcttaatatcaagtcctgaaatgaaattatctctgttctgtttctttttaccttttcttgtgtgggtgaactgaccaacttttaagtctagttccctgttggacagacttttctcaactcattacctatccccctaccgtccatatggcctccacgctctgcactgactctagctgcctctttaaaataataatagtaataataattaatttttaaatccttctctccgccccctccccaccccccatgctaataataggtcgtgtcacgtggaacctcttaatctcagcatccggagctccaggaagggaaaatttcaagtcagatagaattctatatataccatttctttggaaccttcagccctcaagattccaacatcatgacctcagtttcaacacagttgtccttagtcctcatgtcactgcttttggtgctgcctgttgtggaagcagtagaagccggtgatgcaatcgcccttttgttaggtgtggttctcagcattacaggcatttgtgcctgcttgggggtatatgcacgaaaaagaaatggacagatgtgactttgaaaggcctactgagtcaaacctcaccctgaaaacctttgcgctttagaggctaaacctgagatttggtgtgtgaaaggttccaagaatcagtaaataagggagtttcacatttttcattgtttccatgaaatggcaacaaacatacatttataaattgaaaaaaaaatgttttctttacaacaaataatgcacagaaaaatgcagcctataatttgctagttaggtagtcaaagaagtaagatggctgaaatttacataagtaatatttcataatcttagaattctctcaaagcatgtgaaataggaagaaggaagttcttgcccagaatcttaggaaatcaccactgttcggttataatcactgcctcctgaatcgttgaggagtcttttaaattagatttttgttttgttgtctcccaagttaatattatatttagatatcagagagtcaggcaaaaaggaaaacttttatctctagggaaaaaacatttagaaaaatgtattcagtgtatctaatactgaaatgcggaaaaaaatttaatgttaaaaaaaaaactatagacattgacatggaaaagagatttaatgttttgaaaaaaaactttatattaactgagtaacatcctcctgatgagaagtactatattaaatataaacccattatgttataagttaa

SEQ ID NO: 199138 - DNA, 1041 bp, Homo sapiens
aggagtcggcggcggcagggatgtgggaaatgtagttgggagactccgccctcctcgccattcctgtaatggctgcttcctagaagcatccggagctccaggaagggaaaatttcaagtcagatagaattctatatataccatttctttggaaccttcagccctcaagattccaacatcatgacctcagtttcaacacagttgtccttagtcctcatgtcactgcttttggtgctgcctgttgtggaagcagtagaagccggtgatgcaatcgcccttttgttaggtgtggttctcagcattacaggcatttgtgcctgcttgggggtatatgcacgaaaaagaaatggacagatgtgactttgaaaggcctactgagtcaaacctcaccctgaaaacctttgcgctttagaggctaaacctgagatttggtgtgtgaaaggttccaagaatcagtaaataagggagtttcacatttttcattgtttccatgaaatggcaacaaacatacatttataaattgaaaaaaaaatgttttctttacaacaaataatgcacagaaaaatgcagcctataatttgctagttaggtagtcaaagaagtaagatggctgaaatttacataagtaatatttcataatcttagaattctctcaaagcatgtgaaataggaagaaggaagttcttgcccagaatcttaggaaatcaccactgttcggttataatcactgcctcctgaatcgttgaggagtcttttaaattagatttttgttttgttgtctcccaagttaatattatatttagatatcagagagtcaggcaaaaaggaaaacttttatctctagggaaaaaacatttagaaaaatgtattcagtgtatctaatactgaaatgcggaaaaaaatttaatgttaaaaaaaaaactatagacattgacatggaaaagagatttaatgttttgaaaaaaaactttatattaactgagtaacatcctcctgatgagaagtactatattaaatataaacccattatgttataagttaa

SEQ ID NO: 199139 - DNA, 1531 bp, Homo sapiens
aggagtcggcggcggcagggatgtgggaaatgtagttgggagactccgccctcctcgccattcctgtaatggctgcttcctagaaggtcgtgtcacgtggaacctcttaatctcagcatccggagctccaggaagggaaaatttcaagtcagatagaattctatatataccatttctttggtaagtcttattaattccccacaacttcgcagagttatatgttgtgtgacttttgccaaatttgtctgcatttcttggatgggagagaccctaagaaaatgtacaatttttacccactaggatattttaagtttccaagttagtggctcgtgctttttttctgtttgttcttaattatgaactcctgttcaatttttgtttggttgatgcacgaggtgttggcattatcgtggaaaattcctgggtttagagtgttatcacgagatagggagatgaacctcaaattactgtctttaacgtccctctgtttttccacctataagatgaggagatggattggaaatgattcataaagtatccaaaagattggctggcctgttatttgtcatgtgttcattttgtcatttgaaaagggaggaatttttaatggttcctttttgtttccatgtttaatttctaggaaccttcagccctcaagattccaacatcatgacctcagtttcaacacagttgtccttagtcctcatgtcactgcttttggtgctgcctgttgtggaagcagtagaagccggtgatgcaatcgcccttttgttaggtgtggttctcagcattacaggcatttgtgcctgcttgggggtatatgcacgaaaaagaaatggacagatgtgactttgaaaggcctactgagtcaaacctcaccctgaaaacctttgcgctttagaggctaaacctgagatttggtgtgtgaaaggttccaagaatcagtaaataagggagtttcacatttttcattgtttccatgaaatggcaacaaacatacatttataaattgaaaaaaaaatgttttctttacaacaaataatgcacagaaaaatgcagcctataatttgctagttaggtagtcaaagaagtaagatggctgaaatttacataagtaatatttcataatcttagaattctctcaaagcatgtgaaataggaagaaggaagttcttgcccagaatcttaggaaatcaccactgttcggttataatcactgcctcctgaatcgttgaggagtcttttaaattagatttttgttttgttgtctcccaagttaatattatatttagatatcagagagtcaggcaaaaaggaaaacttttatctctagggaaaaaacatttagaaaaatgtattcagtgtatctaatactgaaatgcggaaaaaaatttaatgttaaaaaaaaaactatagacattgacatggaaaagagatttaatgttttgaaaaaaaactttatattaactgagtaacatcctcctgatgagaagtactatattaaatataaacccattatgttataagttaa

SEQ ID NO: 199140 - DNA, 1897 bp, Homo sapiens
aggagtcggcggcggcagggatgtgggaaatgtagttgggagactccgccctcctcgccattcctgtaatggctgcttcctagaaggtaatgtacgaactcgtctccaaaggatacttaggttgcaccagtgtatttgtaaaacaggagcaaatttggaccttgccgggccaaagtacgaattctttttcaaatcttaatatcaagtcctgaaatgaaattatctctgttctgtttctttttaccttttcttgtgtgggtgaactgaccaacttttaagtctagttccctgttggacagacttttctcaactcattacctatccccctaccgtccatatggcctccacgctctgcactgactctagctgcctctttaaaataataatagtaataataattaatttttaaatccttctctccgccccctccccaccccccatgctaataataggtcgtgtcacgtggaacctcttaatctcagcatccggagctccaggaagggaaaatttcaagtcagatagaattctatatataccatttctttggtaagtcttattaattccccacaacttcgcagagttatatgttgtgtgacttttgccaaatttgtctgcatttcttggatgggagagaccctaagaaaatgtacaatttttacccactaggatattttaagtttccaagttagtggctcgtgctttttttctgtttgttcttaattatgaactcctgttcaatttttgtttggttgatgcacgaggtgttggcattatcgtggaaaattcctgggtttagagtgttatcacgagatagggagatgaacctcaaattactgtctttaacgtccctctgtttttccacctataagatgaggagatggattggaaatgattcataaagtatccaaaagattggctggcctgttatttgtcatgtgttcattttgtcatttgaaaagggaggaatttttaatggttcctttttgtttccatgtttaatttctaggaaccttcagccctcaagattccaacatcatgacctcagtttcaacacagttgtccttagtcctcatgtcactgcttttggtgctgcctgttgtggaagcagtagaagccggtgatgcaatcgcccttttgttaggtgtggttctcagcattacaggcatttgtgcctgcttgggggtatatgcacgaaaaagaaatggacagatgtgactttgaaaggcctactgagtcaaacctcaccctgaaaacctttgcgctttagaggctaaacctgagatttggtgtgtgaaaggttccaagaatcagtaaataagggagtttcacatttttcattgtttccatgaaatggcaacaaacatacatttataaattgaaaaaaaaatgttttctttacaacaaataatgcacagaaaaatgcagcctataatttgctagttaggtagtcaaagaagtaagatggctgaaatttacataagtaatatttcataatcttagaattctctcaaagcatgtgaaataggaagaaggaagttcttgcccagaatcttaggaaatcaccactgttcggttataatcactgcctcctgaatcgttgaggagtcttttaaattagatttttgttttgttgtctcccaagttaatattatatttagatatcagagagtcaggcaaaaaggaaaacttttatctctagggaaaaaacatttagaaaaatgtattcagtgtatctaatactgaaatgcggaaaaaaatttaatgttaaaaaaaaaactatagacattgacatggaaaagagatttaatgttttgaaaaaaaactttatattaactgagtaacatcctcctgatgagaagtactatattaaatataaacccattatgttataagttaa

SEQ ID NO: 199141 - DNA, 1034 bp, Homo sapiens
tcctagaaggtcgagtcacgtggaacctctgtaagtctcaggcatccgggagctccatggaacgggagaaattgtcaatgtctacgatcacgaaatttctgagtatgtataccaatttcatttgtggaaaacccttttccaggcccccgttgcgaaagggaattccaacatcatgacctcagtttcaacacagttgtccttagtcctcatgtcactgcttttggtgctgcctgttgtggaagcagtagaagccggtgatgcaatcgcccttttgttaggtgtggttctcagcattacaggcatttgtgcctgcttgggggtatatgcacgaaaaagaaatggacagatgtgactttgaaaggcctactgagtcaaacctcaccctgaaaacctttgcgctttagaggctaaacctgagatttggtgtgtgaaaggttccaagaatcagtaaataagggagtttcacatttttcattgtttccatgaaatggcaacaaacatacatttataaattgaaaaaaaaatgttttctttacaacaaataatgcacagaaaaatgcagcctataatttgctagttaggtagtcaaagaagtaagatggctgaaatttacataagtaatatttcataatcttagaattctctcaaagcatgtgaaataggaagaaggaagttcttgcccagaatcttaggaaatcaccactgttcggttataatcactgcctcctgaatcgttgaggagtcttttaaattagatttttgttttgttgtctcccaagttaatattatatttagatatcagagagtcaggcaaaaaggaaaacttttatctctagggaaaaaacatttagaaaaatgtattcagtgtatctaatactgaaatgcggaaaaaaatttaatgttaaaaaaaaaactatagacattgacatggaaaagagatttaatgttttgaaaaaaaactttatattaactgagtaacatcctcctgatgagaagtactatattaaatataaacccattatgttataagttaa

SEQ ID NO: 199142 - DNA, 1017 bp, Homo sapiens
aggagtcggcggcggcagggatgtgggaaatgtagttgggagactccgccctcctcgccattcctgtaatggctgcttcctagaaggtcgtgtcacgtggaacctcttaatctcagcatccggagctccaggaagggaaaatttcaagtcagatagaattctatatataccatttctttggaaccttcagccctcaagattccaacatcatgacctcagtttcaacacagttgtccttagtcctcatgtcactgcttttggtgctgcctgttgtggaagcagtagaagccggtgatgcaatcgcccttttgttaggtgtggttctcagcattacaggcatttgtgcctgcttgggggtatatgcacgaaaaagaaatggacagatgtgactttgaaaggcctactgagtcaaacctcaccctgaaaatcagtaaataagggagtttcacatttttcattgtttccatgaaatggcaacaaacatacatttataaattgaaaaaaaaatgttttctttacaacaaataatgcacagaaaaatgcagcctataatttgctagttaggtagtcaaagaagtaagatggctgaaatttacataagtaatatttcataatcttagaattctctcaaagcatgtgaaataggaagaaggaagttcttgcccagaatcttaggaaatcaccactgttcggttataatcactgcctcctgaatcgttgaggagtcttttaaattagatttttgttttgttgtctcccaagttaatattatatttagatatcagagagtcaggcaaaaaggaaaacttttatctctagggaaaaaacatttagaaaaatgtattcagtgtatctaatactgaaatgcggaaaaaaatttaatgttaaaaaaaaaactatagacattgacatggaaaagagatttaatgttttgaaaaaaaactttatattaactgagtaacatcctcctgatgagaagtactatattaaatataaacccattatgttataagttaa

SEQ ID NO: 199143 - DNA, 979 bp, Homo sapiens
tagcatggactgtttcactctctctcatcccaactccaatttattcataagcatctctatacccgtatgggttccattgctttcatacatatggtgaccagttatccaaactcaaattgtgtagaaggtctgatgaaggaatttagttgtaaaattattaatatgaaaaagaatgcaacaaataagtaattatgcagttaaataaccattattgaaaagaaaaacatgaaatcatatgtctcaaaattgggggcacctggccacaaaatctactttgtatgactcttgtctttatccttaccatgttcaacttctctgctacgttcaaattttcccagaaagcatttcatgatcaacttcattctacctggatttttttctgttctttggttccagtacttgctatttattgctgataggttgtctgtaagtgcgtaccttctctgtcattctagaatggaagcatcatgtcacaacagactgtcccatcgcaaaagacggtgaagtgtcacccttgtggatgctgaaccccagtggggctccaggtgttctgggtcccctagcatagtccaggagatttgaacctttgtagtttatgcaggatttgtttgggtctgagggatagtggattaaccagaaatctctggcgatcactgataggtctcaaaaaaaaaaaaaaaaaagagaatggctcttaaagctgcagtatgaaactattttaaattttcaggttactaaagagcactaatggcattttatttgaggggtgtggtattcccttatttattcaaatctttttttgagacagggttttcactcctatctcccaggttggagtgcagtggtgcgatctcagctcactgcaacctctgcctgctggattcaagtgattttcccacctcagcctcccaagtagctgggactataggtgtgcaccaccacttctggctaatttttgtatttttggtagagatgggat

SEQ ID NO: 199144 - DNA, 727 bp, Homo sapiens
ccttgggaatatttggggatatttactttttcaagtaattgagttatacgtactttgcctgccactttttacattgcattgccaatttaagttaacatcaccgacctaatgtcagcaatgttccactcttaaagctggaaactggattcgagggtgagcaaggaaggatgaggagagggaagtttaccttaaatgatccttgaagtcaacattaggtaccttgagaatgccttgctgcttgattttaagatcttcaattacagcactttgattcttaaccttaaaaaaattctccttcagccatttcaagccatgtggaatatctcttactgcttaggaatttgctgtggtttttcattgaccgtggccccagactctggaatatgtattaatttatctgggcagagaatacagaaatccacatgcagaataaagtgaactttatgctgaagcagaatattgaagctgggaatggttaattcttaaaaaataaagcatcagcgttaataaatattgaattctaagaaggtattttgcagtttgcttcttaaagtactgagataatctgactgggttcccatttaaaagagagaagttttttccctccatgaataatattcgtttacagtcattggtaaattattaatctgcattccagtgtttcatgtttgaaatggtcgccaatccgcggattggcgaccatttcaggagccacaggtaagggtct

SEQ ID NO: 199145 - DNA, 648 bp, Homo sapiens
gggctttttaaataaaaacacaaatgaggttaccctataagtaccattttgtcagcgtgctcttttatttaatataatagttcatcttggattttaaaaaaatatcagtaccaaaaatactcctaaaactagaataagagagtaagtaaggctaattatagcttattggccatgggaattaaatatattttgaaagataatttgtattttcctttgattttaaaagttatattctactcctttactaatgcaacagtcatgctcaccaaaataaataaggagtgtatttattatagtcatccatatcatactttatgacagagaggcagagtttgtttaatctttggaaattaaagattaaacaagttttggaacaatattgtgttttattttaaaatttaatttgaaaataataaattaaaatactgggcctggcatggtggctcatgtctataatcccagcactttgggaggcccaagcgagagaattgctttagtccaggaggtgatgtggtgaaaccctgtctttacaaaaaaatacaaaaattaactgggtgtggtggcgcatacctgtagtcccagctactagggaggctgaagtagaaggattgcatgagcctgggaggtcaaggctgcagtgagccatga

SEQ ID NO: 199146 - DNA, 498 bp, Homo sapiens
ggaaagagacaagtagaaatgaagggctgagggaggagaaaaagtgaaaaaagggagcacagaagaaaggtgaatctatgtggaaagagaatctacaccacgggagagagactatgaggtaaggcgagggggaggtagaggaaaggaaataaaatgggaaatgagaaaaagaaatggccaactgattgttaacagtaagagaataacatatagggagaaagagggaagaaaagaaggaagcaagcaagcatattttgtgagcaggaaaagacatagatgtacattgtgctatttcagtttctttactgcttaagggccatatgagcaggaaaatcctggctgagtagagtaagaactgcagaatgtcacacatggaagtatgaaaaggagatggagcaactatagagatcttagagataggaaaataacagatgtggtgccacttgagagacggttggagttctgtcagctctccaccttattctccgtctgtcctct

SEQ ID NO: 199147 - DNA, 514 bp, Homo sapiens
cagagtgagactcttgtctcaaagataaaataataaaatgagtttgcagcctgcatgtgatgcctgggattgcagcagctgccttcaggttcctggggcagagctggagagtgcagcaaaagccagggcatgccagccagcaccccagtccatgaggggcttcccctcagtgcagccacgctccctgccacctgcttgtttagcaaggtatgcattgtgcggctgcatgctctgttaggaagcattaagtcctgcctctgtagtgtgactatcatgttttgcctcctccttcactactcaagttccacatcaacagataatctctctggacaggatgttcctgcatttgtttctatgtcaattgcttcacaacatctgagtgtccacatgttggacagggtttgaggcttataagaccacagttttgaaacagacaagttgtcttcaaagagtttctgttgtagtttgggtaaaagacagacattaaacatcaataaataggaatttaaaacgg

SEQ ID NO: 199148 - DNA, 487 bp, Homo sapiens
ccttcctcttaaagggacatagtggtggccacaggtacccccctacctggtcctcctgggtctgtacctcagggcaaataactctccctctctgggtttcagtggcctcatcatgtggaaagggttgttatgagaatttacggagagactgtaggaaagggatttgtaagcagcagcccatttgttaaggggccaagggtgcttatctctgtttttagaaaagtagatccagtccataggagacaaacacccctcctgcccagtgggccaccttccagatgttctggatccaagcactacgggtagggcccaggaattcgcacttcatctgtttctaggaattcttcagtcatggaacaggaaaatgaagatacctggtcaagtgtcctgtgtggtggtcagcccatagtaaaggaataagcatcagtttggtttttttgttttgttttgttttggtttttttgacacagagtcttgctctgtcacc

SEQ ID NO: 199149 - DNA, 543 bp, Homo sapiens
agccatggggtaggaattaaataaccagtgtgatggttaagaaacccatttaatgggtaagtaaccaatgagttgaaatgaatgtgagtgccttgctcaagcaatgcaaacttagatgaattcctgataaagagatgtaacagcttgggccaagcaagactttcagctgctaattcctgtctgataaaaatctgaacggcttagaaatgattgggtaatctctaaaactggcacactgaaactgttttagagataccagagctccctctctcctgccggggtattaaccccgatttgtgctctctgtcgctgtgttttccacattcttcaagagtgaaacgagtgggtcatttgagagtgcttttgcagcctggggtttctgtatggaaaatcttgtgattgagctgttgagctgtaaatgttgatagctgaaggggatagacaagcttcatcgaagttactcaaattcaaagcagagtgagtatgtaggtgtgcaatttgggaactaatctgtaattataaagatgttattttcctctttgg

SEQ ID NO: 199150 - DNA, 447 bp, Homo sapiens
aactttctcagagtcagtggtggagtcagtcttcaagcccttgatgtccagcttcagagtccatgcagatagtctcagttgacttagtcctaaaggcagctgtgggttgaggttccaacagcctctggtctgcttcattcctcaaagtaatctccaagcccgaatcctagcatggtggtagaggtgaggctccataaaccttagaaatagctctcccagatatgacaacatttgggccttggaccagtggtcgtgcatccactctacagtaacaggggcttctatagttaatttgattctcagttttaagattactagagaatcaaatgttgagtatgcacttttgtatgttagtgggatatctgaagcaacattactgataaaaagtaattgcacatttctggatagtgataactggaataatactctcttgtgataaaaggaaaa

SEQ ID NO: 199151 - DNA, 235 bp, Homo sapiens
agatctcgccactgcactccagcctgggagaaaaaaaaaaaaaaaactgatgaggccgggtgcaatggctcacacctgtaatcccaacactttgggaggctgagatgggtggattgcttgagttccagatcagcctaagcaacatagtgaaaccccatctctacaaaaaaaaaaattaatttaaaaataaaaatgggtggtctgaaatatgaactgccccctccactgaagaccg

SEQ ID NO: 199152 - DNA, 179 bp, Homo sapiens
gttctgctgagttaaggaccccccttccccacagtgagcattggtgcccctcagagaaggaagccttcctctgggaggtgaatgccagcctcggaagggcaggaaggagggtgcacatcttgaacaccagcagcatccacacgtaccagctagtttaagctgctgcacggcccctgtgc

SEQ ID NO: 199153 - DNA, 346 bp, Homo sapiens
tatataaagcagataaaaatgtagctgacatgcttggtgcaggtgtggagatctagctgacttgcaatggtagtgccaagagatgtgtggactcccacaatttaatggaaaacattcataagattcttcccattgtttgatgtaaaagtagtgttaggtaaaacattatgtaaaataaagattcaagctttctcttccagccagatagatgtctctcagtgactttactgcagttctcccacgctcactgcaactcatcttttccctctgctcccctcccagttctagacctgaggctctggcccttgcactccagattgggcaataggagtgaaactccatctca

SEQ ID NO: 199154 - DNA, 629 bp, Homo sapiens
cgccaccccagcccaccccagggaaccctccccaagttccactgttcaaacaaggccctgatgcaccagcctgacatttgtggccattccagagtgactaggcctctgacaggatgctaatctcatgatctgagactgctgcacagcaatgagtcacttggccatcagaaaaaccttacaaacttgcttggcctcaccttggcagcctgaaacctctctgcccatgatgtatttaatggagaaaactatattcagaattggtactcctgaattcaggaaatcgctaaaagtcctatatatatcatacataaagtcctatatatatcctacatgtaacctgaacattcactgccccccaaacagatcctgacaactcctgatctcaatttcccttccttccccacacatttcctgtacatacaaattggaggcaaatataatttacttcaagttttttgaaactgccagtctctcttgaccctggatatttgttcaatgctattatttcttcctaaaacacctcccccactatcttacctgtactttactctttccctattaatcccacctttaaataatttaacttttatccttcaagtcacaacacagatatcatttccttttcatag

SEQ ID NO: 199155 - DNA, 561 bp, Homo sapiens
gaatgatttggtgagaagagagggttacgacatttacctttaaatcatgaagattttgagttgaaaggaatcttgaagatcataatagtctaggcgcctcagttcctagatgagttatggattatgcacagggctatgggagcacagacagcccccatctctggaggaatagggcagatgaccagggaatagctcgcagtaggtggtggtgtcatatcctgaaaccacacaccagtttcattttgtgcaccagtggcaatcagtagggagaggctatcacagtcacttttctgagatggatttttgaggcccagttttggcccagcaggaaagaatgccacagtctcttagcaatatcttccacggataccccttgggggagtggcagtcagctccacgtatgtacagtctctgttttagaggatgaatgttagccaggagaagagtaggaaaaagacaggtttctcgcagaggggccagcgtgagcaaagacacagaggaaataagggcttgacatgggtcgggggcgggctgctacaaatgattgggcgtggctgggac

SEQ ID NO: 199156 - DNA, 1110 bp, Homo sapiens
acttttcatgactcttgacttccctacttcaacagtttactagtctccatcttgaatgtttttattaatctattttgtgttaattctacccaggttttttgtttttccttgctactattatatatatttctgccagatgtcacatggtataaatgcctatatggacttttgtaacagaaaatttacttactagaattaatgtagggggctttttaataagagtgcatgtaacatagtaacagtagcagagctatatcagaaacagttctgataatatttcatgatctatagtttgttgcatgcccattgcttcatactgcttgtgttcttggttgagtcataagtaatttttatggggtgtgtcatgactgtcatattcatagagagttgtctgccttgccccatggtctttgcatggcttaaacaggaccccttttcatacacaagtcattcaattttatgtttttaatagcatcaattttagtgtttaacatgtgtctctggactatgcatcagaatacttgactgttagtgtgaaatgaaaattcatggatatcataatttatgtaacataatttaacatttctttattaataagactttagattgtccctttcacaaaaaaatggtgcggttaaaacttaatccttgtgtctttttgtgagtagttctatgatttctatatgatggcatccttgaaaaagttggtaaaaataagaatagttcttatttattaaagttcttctcaaattgctcttccaaaacattttagtttatactgcaatgttaaccattttacacttgcttaagtaattttcttcaaatacacacgagtccaggctatttaaccttattttaccgctatagcacaaaacaggttttccaaaattgtccttgcacacctgggattttacaaggatattataatcttggttcagtttgacttactgaatttgtagtaagtatattttagcacatagaaaattcaaaatatgtgttaatctgtttatagggtaaatttttatgagggtggatgtcatcctgttttttttttttttaataaatgttttgtttcagaatgttttttatttacagaaaagttacaaacat

SEQ ID NO: 199157 - DNA, 623 bp, Homo sapiens
tgttctcaaagtatcccaccaaagattactattagttgcaaaggggaaaatctacctgaaaagacccggcagtcatcattctaccaagtggtcattatcaggatgggctgatattatgagcctccttacgtgatacactgggaggttacaaaaattcactggtgttcttcctggaaatgtctgaactaaatctgactatacacgacatttggaggacaacttgaaaatggaccatatgtcagataattttttttaattaatgttgatgtttttagaaaataaaatggagctgtggatatgtagaaggccatccttattcttgagagatacatgccaaagtaaaggtgaagtatcatgatgtctccagcctactttcatataacttagcaaaataaaagtgtgtatatgtgtgtgtgtgtgtgtgtgtgtacatgcacacatgtgtcagagaacatatgggcatgccaagatgttaacagctggtgaatacaggtgaaagttatacaggttcatcctccaatttttctgtgggtttgaaaactgtctacatataaaaaaaaaattataactagttcaaaaagaggaatgacattaaaaattatttctaaatggcatggttttta

SEQ ID NO: 199158 - DNA, 555 bp, Homo sapiens
atgctataattttacttttccagcacccttacctcactaacttgaatcttttatcacattgtattttaggggggaaaacaaaccagcctcattagaattgttggcaaaatagaatagcctttgagtgagaggctgaaaagctctcatgtatcagattaaggactctgtttggctcttcattggccttttatggttctcagagtgttgcccttacgtaaattaagtaagatgtctgagttcctaatagatgaagaactattcatcttttatttttgcatatactctttattcctaactagattatcggaagaggtcatctttttgatgttttaaaaaatgttatcttcagtgcctttcccagtgctttgaacatactgattacgattaaagttttttcatgataattatattggtaacctaattttgtgaatacctgaactatgttatcccaaatttacagaaccaatatattaaatcatatagtatatgattttctagaacaagagttggcaaactttttctaaaagggccagatagtaaatatttttggctttg

SEQ ID NO: 199159 - DNA, 1604 bp, Homo sapiens
ggattccgggcccctcctcccgccgccgcgccagttctgcgcacctgcagccgcgggctctcctcgccggcgcccgcgccgtccggcctctcctccaggatcatcgccgcacccgctgcgctgggggtccctcggggtcagccagcccgccgctcgcgcagcgctccgcagccgggctagggccgcccgcaccacctgggccgcgggctcctgagtgcccgcgccggtccccgactgtccctcctgagtgggggcggcccgcggcgcggctgggcggggcacgggtctggcgtgcgaagctggccattgcccaataggcggcaatgccgcttcgacggacagctatatcagccaaccagagttccaggaaggcgggctctggacggccagctccgcccgcccgcgggacggtaacccctggcaaccgcggccggaacgcccgcggctggctggcaggttgtactgcgcatgcgccgcggcggccgctgagcgtgcgggagaagttcgggaaacggagaaaaaaactatacggaacgtcccaagctgagagtcagggcggacctggactcggcgcgcctagctcctcggctccctttgcggggactccaggagtctgcccgctcgcgccgtttcgtcctgtcaccccggcaacgggaccctctaagaggcttgttccaaaaatgttcacaatggggtttttaaaaacggttttgttagggacaagtgcttgtgtgagtcctccgacaatgcctgctttcttctctctgcccgcggagcggaggctccaggcctggccccagtccgaggcgcctctgtcggtgtcgtcctgcttccaaaaccggcctccagaacccgcctccttccagaacctccgtccagaacccgcctccctccagaacctccgtacagaacccacatccttctagcacctgcctctggaacccacgtgctttcagaactacctgtttgtagaacttgtttccagaacgaacctgctttccgaatctctttacttccagagcttgtttcctggactgacctattttcagaacctactttcaaaaccagcttgcctccaggaccacctgcttggagaactggcctgcagccccaggactggacgacctgagactgcacagctccctgcggggctcacccggctgtgtgtgtccttccgggccttccatacttccctaggtgtctggtgactccggagcccgctcggatttcgtgtgggtctcgcctcagctcagaacacaccctttgaagagcaggaaggccagggcacaggcggtaaccacggctcctggtcatcaagttcctctgaagcccaggtcttgtccacgttcactgccccaccacaggcccagcggagccttggagctgagccctgggatcattctggtgcctgtgctcccggctccgcaacaagcacacaggagcctgtcatccccagatctaaatcctgaaggctaagctccgtggtctgccgcagccatctgcagcaggcccctcccagcaacagccttctcataaggcccctgccagccacgcgaaacctcctggctagggcctgtcttccactcctggccttttgagacagg

SEQ ID NO: 199160 - DNA, 377 bp, Homo sapiens
gtagttctctggacttttccccagaatagaagaaaagagataaatgggatctgtgcacagatatttactgcctcaggcctgtgagggaatgccaagttgtttgttgacacaattttggtagtctcgatcagaatcagcaaactgtgactcatagaccaagccctgcctgtcctgtttttttgcatggccctgaacagaagaatgagttttacattttttgatggtttaatggtgatgtgtgaaaataatgtgaaatccaaatttcagggcccatcaatggtcacacgattatgtgaatttactaaaaaccattgcatcatatattttaaagggtggactgtatggtttgtgaattatatctcaataaagtagttctt

SEQ ID NO: 199161 - DNA, 502 bp, Homo sapiens
acaacttatccgtgggagctttctggttacttcagaccatcagtgtcagccacgatccaacaaatatgctaattttcagcttcaataaaggacagagagaagtagaggaatctgaaaaagtaggaaggggatcgctctttcttttaacctccaggtcagtaagtctgattcatgaagttctcgccgattgcacaaagcttccagttgggttttagaaccagaatgcggtttggaccttttccctgggatggctcagtgatgatgaagttttatgttggaactgtctccaggcttctcccctgtgctcaccagagacctggctggcatacacttcagggaattgggtatgttcttgggcttgtgaagacagcgcattaggagggattatgatgtagtggggaggaaggaacgagggatttagagcgagacccagttcataccctgatgctgctgcttccatttctcctgatagtagcctcgcttcttggcatcgtaggaattt

SEQ ID NO: 199162 - DNA, 509 bp, Homo sapiens
tcctgtctttcaatgattaaagtgggctcttaagtttgtaacctggcaatcaggaaatatttgttaaatgcctattgcatgcaaggtcctcacagtgcacccttcctaaaggacttaactagcatcaatttctatttgtttattttctggaaacagcatcctgacttattttggtgatccttctttttttcttggtgtgtatcatttggttcatgtcaaagtcccacagtgaaactgactctactttcacttcctcatcatgcaatttagcctgtcaaattggagcctagcctcccctggcctcagtgatgatgggttaaaaataggcaggttacctgatgaggaccaaccagagcttagaatgaccatgaataaagatctctttcccattggagttattgaaaaatgaattgtaggcctggaatggtgtgtccatctatggggataacctgcctgagaatgaagccacctcagagagaagcagaatcaggaagtggagaagggcatac

SEQ ID NO: 199163 - DNA, 283 bp, Homo sapiens
aaagggtaccacggtggactgccaaatcagacagtgaggagcgaggaaaacaggaccaggtgcatttcaaaagggcgtatgaaaccagcaggcagcatggagcgtgcctgcagttccagttactgggcaggaggattgcttgagtccaggaggtggagcctgccgtgagcggagattgcaccactgcactctagcctgggagacagagcaaggccctgtctcaaaaagaatggtttatgtacaaaggtagccattaaaacaaaaacacacatcttcctaatat

SEQ ID NO: 199164 - DNA, 378 bp, Homo sapiens
gggttgcgttacatggaatggatgggaagggagcgtggcaactttaaaagtgcacactctctttgtcataccttgtgtaatttttattgtggggaaaaaaatgtataaataaatgcatgtaagccagctaagaaaatatccacctatttagagtgcagattgcctaaaagaaggaaacagttgggtggaatattaatcattttcagacagaaaacagttatttttaacccttttcacaaaaaaaaaaatcatcatttccatggatggttccagttagagagtttggtcagagagctctcattttaggaaatcagatatcataaaaaggtatgactttagagaaatgaggaaggtacttcccaaccccgagctgttgta

SEQ ID NO: 199165 - DNA, 110 bp, Homo sapiens
tatcttatttaagaatatgttaacttgtttcctgtctgtctggtttaccatcaggtcgcagcatctaaatctggcagacttacttagtgtactataatgcatgcactctt

SEQ ID NO: 199166 - DNA, 130 bp, Homo sapiens
cttgttaaagggattcattctgacccctccgcaaacacaatcacttcagcgtttcaatttctctttcttgggtgctcccccaccattcttacctccctgttgttcattccatcctgaccccatttgtcta

SEQ ID NO: 199167 - DNA, 412 bp, Homo sapiens
aaatattcataggtgaaaagcaaaaggtttcatttttcttccattgagatcctagaagaaaagaaacacaaaagaaaattcaacagctgtatctctaatccccttaggcaaacaattgatctctccaaatctcaattgcttcatccatttaaagtagattcaaacctttcttctgagaaggaagccctgcatcttttatgattgagaaatctgagttacaagtgtatttgtcatccacattactcaaatgattttggtcagatttaggagacacttccaagatttgggagacacttccaagatatttgtttttctagtaatccttttatatttcataataaatacttgattatgagattttgaagtttgtttctgaaattgaggggaagatgaggataaggaagggagtaga

SEQ ID NO: 199168 - DNA, 500 bp, Homo sapiens
ggccttcctaccttccttacatttatgtagcatgtgtttatccaaggcacaccacctgccaggcacagtgctgggctctgtgttgacacacatgaatgtgatcatctttctgtagcccccaggttacatggcaccacagccaagatacagacatgtgtgagagagtaatcagggtattactcaggatttgctggaggaatccctcttcaaaggatattctaaattggtgtgtgtgtgtgtgtgtgtgcgcgcgcgcatgtgtgtgtgtgtgtgtgttgaggtggactgggagaaaatataccctccttgagatcacctcctggctagatagtctctcccttctctgtttgtgatagaatgcaagtggaatttgacaggtgtacttctcaaactagaaactagagagctgctatctcagtcaccgtaagaagaacgaatcacaccaaacctacatcattgtcttctatgacaggatttctacaagggtgagatagtgagat

SEQ ID NO: 199169 - DNA, 250 bp, Homo sapiens
aaaaccagaagacaaggcattcagtcgggacctcactatgccctcacgccctcacaatgtggctgtgacacttggttcctcctctacaaaagaaagacaactgtttctcttttttttttttttttttttttttttaagacagagtctcactctgttgcccaggctggactgcagtagcatgatctcagctcactgcaacctccacctcccaggttcaagagattctcctgcctcagcctcctgagtagct

SEQ ID NO: 199170 - DNA, 412 bp, Homo sapiens
aaacatcctgtgctcccaaaggcaactaatggcacagcttgctatggattttcccaagttttcaagaacagtgacagccctcttcaacaaagccacttaacataacacaaggttaaagtgggaaccgcaaacacttgcttttcttaatttacacctttcatttacttccccagaaatgtcataaaggaaccatagaatttctgatgtactgtcaatagatggttcctttcaagaacagcatttagaaagaaaatgtgaataatcctacaaggtaatctggagctataacttaaaacaaataataattagcattttgggagaagaaagatgattttggtctgggtctctcactttaacaacaacaacaaaaagactagttcaggtgtggtgtttcacgcatgtaatcccagca

SEQ ID NO: 199171 - DNA, 529 bp, Homo sapiens
acaaacggtccatcatgtgtaaaggtaaaataaacacgtttttcatcatatacagtttcaaaaatgtacatttctaatgctctttcttagggagtccctgaagtatgtgccctaccaaaataaaaaagtaaaagcatggaaagagggaggtccaggatccaggaagtaaggctccaagacagggggaacgtgaaggggatacacaaggtggtgaggaatgtggatcccgtgatgaaagctcttcggagccttagagagtaatcagttcagagtggagcagtcatatatctgggaaagaagcctgcagaaagacagaaatgttagagtaatgatagaatgggtggtgcttcaatgtattgaaaggagggctccacttctggtggtgtaaagtaataaaattaacgagggggacataggatcactaagagttggggggaaagataattattaacaaacagaagacaaatatatacaaatggaagggtattcttagtatactgtgaatagcattacatagatcaataagtaa

SEQ ID NO: 199172 - DNA, 699 bp, Homo sapiens
atgagtgcaaattgtagagaaacagatgtcgattcaacataaagaattttccaacataggggctgtctagagggattgggtggctcagccattttggtatgggacaaattctctgtccactgggggctgggtaaccctgtggcaggtatgcgagctctgcatgtaagacaatgaatgacctgcaaggtcttttcccatctgatgtaaaataaggctccaagatgaactggaacttggccagggtgatcctctactgaggggacaaattcacagctcagtcttccctagttatgtccctcagcccagaacccttggtacaacatgctgctttgtactgagggcaaggcaaattgaagacattatcatcaataaaatcacatcgagcccgctctcaaccaaattaaccaatgtggccgggcgcagtggctcatgcctgtaatcccagcactttgaggctgaagcaggcggatcacttcaggtcaggagttcgagaccagcctggccaacatggtgaaaccccgtctctaccaaaaatacaaaaattagccatgtgtagtggtgtgtgcctgtagtcccagctacttgggaggctgaggcaggagaatagcttgagtcccggaggcagaagttgcagtgagatgagatggcgtcactgcactccagcctgggtgacagagcaagacttcatctcaaaaaaaa

SEQ ID NO: 199173 - DNA, 445 bp, Homo sapiens
aaaatgagggatctttgttgtgatggaactgttcagtatcttgactgtggtggtggatacacaaacttaaacatgataaaatacatataactaaatacactgtgcagaaataactagaagtaaatcaggaaatttgagtgagattggtagattgtgtctatgccaatatcctggttctgatattgttctataacttgtgcaaaatggcaccaccgagacaaacagtgagaaaggtacatacgatctctgaattatttcttacaactgcatgtgaatctaccattacctctataaaactttcaatttaaaaatttctagaagtttctagtttgctttgaaagcagcaacaatcaagttttatcaatgcatgtcttttgtaaatactaaacatttccttttgcctggaaatttaggggagttttcagagctgtcaataaaatttaag

SEQ ID NO: 199174 - DNA, 553 bp, Homo sapiens
cagagccatagactgatagaccagaaagtgggttaatcgaaggtctgtccatgaaactcagactcttccccatttttttttcttgcctggcattacctatctggctgtgggtagcaaaaattaaagtagggaaggagtcatgtgctaaaagattagttcaggggacaagggaatctgatgtattttgctctgcagcaagggctgctttattctggcatttcagaactttttacctgatagctggttctcgccctcttcaccctcgagcaaagcgtactgttaaagcagccccgcctgtctgtggagcttcctgtctgctttctgatagtctcttcaatatgggtgggaggcaaggagcaaaagataaagtctccatcatgagagaaggtatctaagacagcagaaaagacagatattcagaggaaccaaatattctttgttttttgagacggagtctcattctgttgctcaggctgtagtgcagtgagccgaggtctagtgccattgcactccagcctgggcaacaagagcgaaactccgtctcaaaaaaaat

SEQ ID NO: 199175 - DNA, 402 bp, Homo sapiens
cgttggtttgtagtctcggaatataaaagggcaatagaatttaccagcaaatgctgaaaacaaacatttgatgaccagggtttaattttcaaatccttaaggccagagtgtttgccttggtattgtgtgctggcaccctcggagtgctcctcctaatctccaaagccacctgcgcccattcccaaggggccacggtgctgtggtgaagccggaatgagaaggtagggccaagcacccaggaactccaccatcaataatgaactctggaatgcagaagtagagggaaaaggacgggggaagcaccacccctgtttaaatgtagaactaagctgggaagcactgaggtttcagaacagaaggtcagtaccgtcagctttgacaaaataaaaataatacaaacaa

SEQ ID NO: 199176 - DNA, 350 bp, Homo sapiens
accaatgaggaaggtattacagtatttcaggcaagaagtaatgacggtctttgggctagggtggtgaaagagggaagtagaccaaccggtttgggagttttttaggggtagaattgaatggagttggtgatagattaaatattgactaagggagcagaaagcaccaaagatgaacctaggcctctgcctaaatatcaggatggtgatattttcttagatagtgaagacatatttgggagagagaaagaccatgagggtggttgctgacaactagaaagccatttatctttatgcaagctatcaatgataactctcaggcatcttgtagataatgtgaaaaaccattggta

SEQ ID NO: 199177 - DNA, 220 bp, Homo sapiens
ttgttttctttttttggtagagatggggtctcactatgttgcccaggttggtcttgaactcctggggtcaagtagttctcctgcgttggcctcccaaagtgctgggattattgacatgagccactgcacctagccaagtattttttttcttttttatttctatgttctcatctttaaaactttccactgttctttctttaaaaggaaaattgtaatcatg

SEQ ID NO: 199178 - DNA, 403 bp, Homo sapiens
aaggtggtactgggcactggaagtgggagaactggtcaaagaatacaaactttcagttataaggtaaatacattctgaggatctactgtacagcatggtgactgtaattaaaaatgccatattatatactagaagtgtgctaagcattggcaccaaaaagaaaaagaaaaaaaaggtaattatgtggagtgatggatgtgttaatcagcctgattgtgataatcatttcataatatatgcatacatcaaatcgttacattgtatactgtaaaaatatgcaattttgtcaattatgccttaataatgctgacaacaaaacacataaacaaaaaactttccctgctttaacgggtggctaagctagccctggtcacattcagtaacagcatacctttccggtaag

SEQ ID NO: 199179 - DNA, 311 bp, Homo sapiens
caaaattgtggcattctcttctaactatcagggaaaaattgacttattctttgttaagttgtagcttgcagtaaagttttttgggcatgagaattttcagcaaggtggtgagtgccaggaaagtgctgactcagcacaatgctgtctgttagccaggaacaaaaatgaggagcaaccataaatttaatcctttagctccttctccctgcaaaattcagaagatgttttatctgtaacaaaagacttgaaagaggattctcactttttcccttaaaagttgttactcaagtctgtaggtaacttcaggattt

SEQ ID NO: 199180 - DNA, 703 bp, Homo sapiens
attttctaatacatgttttctgctatggggcagggatgacaaccgtgtagcatgtgactaccactccccactccaatacccatggcaggcaccgctaagtactgacaagattccttcctgccaagcccagaccacagcttcagaatccatgacacagtgcacaagaaggccactatcaacttatctgttctgttatgtgaaaggaagcctttcttccctctcaaagggtgaacccacagctatacaggtagggaaccagacctcccttgaagccagaaggcaaaacccaacttcaattattaaagaacaccagaacttgatagataggccttagactgaaattgatttctttctctgagtctccctcttttttagtttacgctcttgattgaagcctcctttgggtgagaggaaaaagtcaacccttcatcacctggatacaggtcctatagctgggcatgcaggcatggattgggtcttttgcagatgccagactgaaggtgagctagatttgccagtttcctagtcctgtctgtgcttccctattgctatccctgagcttttagtagtcatgtttcatgtcccagcctggttatgactggtcagcagaatattaatggagaggtcatgagtccaagcttaatttagagccatttatgggagaagcaccaagccaatatggtggtaacaggattgactacag

SEQ ID NO: 199181 - DNA, 354 bp, Homo sapiens
ctctgtgtatacatgctaactaatgacatctggagaacaagctatgtcatgcagcttcctcagtgataactttttaaacacctggttagagatctttatccaagggtgtaactgagttaccgcactcctcagccctaagccaccttgtcagtttaccccagtgtgccatacaaatattactttctatacatgccatgatatggaaaaggttcggaaggcctgaattaatatttatcaaatatcttactttggcaaagcccatattttcatatggtgtctttgaagaataaaaacatgtttgagctggaaagatcccagataactttttcccaaatgggatgtatatacaagtgt

SEQ ID NO: 199182 - DNA, 155 bp, Homo sapiens
gacgaactgagcattgtcagcatataagtggtgcttctaactttgtgaatacataaaatttaaaaggcaaaatgcaaagacagctaaaaatggaaatctggtgagccccgtattttagatagtggaagacagaaaaggagctcacagaagagata

SEQ ID NO: 199183 - DNA, 466 bp, Homo sapiens
ccacacttctgccttgcttgatagctattcaagagacctggccattttcctctcaaaactacaagtagttcccttcagcagagacactattgagtgaacagattcttaacagtgtagaaacttaccttaatcagatgaatatggtgttgagtctgttctctgaaagcaaaattattttaatcatatgatgcttctctttgatgaattgttgcctttatatttgtgcctgatgtcttagaaatagctttcaaatcaaagtcgtggtgggtagacacaatatgagtgaagctggagctagaacagttttaagatagctgacacctttgtctttttatgctttgagctgatgaaaatctgttccatttttgactgccacagtattttaattctggtaaacttttttttgtggggggtgagaatgtgagagtttatatttttatttgcttatatgaaaaggtaattatac

SEQ ID NO: 199184 - DNA, 492 bp, Homo sapiens
tgctataggcctacataacaaagactgagaacaaaccttgaaataatttgctttattcataggtaacttaactgtctaacacaaacacagcccaatactttttaaagatagataatgaaattcaggtactaaacaagataaaatccacaatgtctagtattaataaaaatattacatatttcaagaagcaggaaaatctgatccataaccaggacaaaaaactgtcaatagaaactgactcagaaatgatagtggggatgatattagcagacatgaacattaaaacagctatttaaaaaatatgcatggtgaggaaaggaattgatgatataaaagtaatcatgtggaacttctagtcatgaaaaaatcacaatatctgaaatgaaaaattctctggatggcattattggcagattagacaatgtagaataaaaaagtggtacatttgaagacatagcagtagacttatccaaaatgacatgcagacattta

SEQ ID NO: 199185 - DNA, 113 bp, Homo sapiens
tattgtaatagagtttctctttgtgtttacctggaaatttttttcatgtcttttctgtgttggtttctcttttctgtgtctttctttttcatagtttacgctaatatcttgat

SEQ ID NO: 199186 - DNA, 320 bp, Homo sapiens
caagtcatgttccctttcttcacctctgtttcctcatctgtatattagagataataactgcatatacctacctctaaggctattggagggttcagtgagttaatccacatgaagtcctcccaaaagagcctgtaagagcaactgctcaacacgtatcaaatattatcatcactggccaggcgcggtggctcatgactgtaatcccagcactttgggaggccgaggcgggagaattgcttggacccgggaggcagaggttggagtaagcagagattgcaccactgcactccagcctgagggacagagcaagactccatctc

SEQ ID NO: 199187 - DNA, 216 bp, Homo sapiens
atgcttttggaaatgatgaagacgttacctaaggcatccaaagtgggattacagaggaaaagacagtgttcaggcaatgatttggaagttttgataactagttggaggtaaagaagaataaagaggataaaaagaagagtcatttatgtcatgggtaactaattatatagagattcaatttaattagaaagagaaaatagaaggaatttggataga

SEQ ID NO: 199188 - DNA, 342 bp, Homo sapiens
agggatttctttttatccctagttgcggttccataataaagagaaaacactctcttcaggcctcaccaaacggaaccaagtgcattctattttattttaattaattaattaatttgagacagagtctcgctctgtctagagtacagcggcatgattttgactcactgcaacctctgccttccaggttcaagtgattctcctgcctcagcctctcaagtagctgggattacaggtgttcgccaccacgcctggctaatttttctatttttagtggaggcagggtttcaccatgttggccaggctggtctcgaactactgacctcaactgacccaccctccttg

SEQ ID NO: 199189 - DNA, 353 bp, Homo sapiens
actgagcgtacaagcagccacatgacatgaggggtctatctgccaccataatgccttggcttttactccaagtgagctgggaagcccttggaaaattttgtgcagagaagttcataatccaagttctattttataaagctcactctgaattgcaggtccttcctcttgttcgcccctctgctgtgcctttactccagagagcatcatggctaagatccagatgtctgcatttgcccaagacagtcctggtttgaatttgtgaacccatatgactattaatagtgtccccttccagtctcagaggtgtcctgtattggatgataaatgacatggccacccttcccacagctcgc

SEQ ID NO: 199190 - DNA, 444 bp, Homo sapiens
gacagagcgagaccctgtctcaaaaaaaagaaaaaaaaaaagtaaattttttaaaaatataaaataatgtatactgatcttagtcttttaatgtgtttgagaccttcatatgattattctgatttttatggataattcttataaattttcattttatttcgctgggtaggagattataggaggaagtattactctgtattttaataaaaccatgattctgaaactaaaatgatagtaaaataagaatatattaaagttcttactaaaagagtaaaagtaataattcctttaatctacagcttagggtgagactaaaggaaaaatcagtccattggaaaaatatacatagtgagaggttttgagaaatgcccgttttgttccgtctggttataagctgcccaggagccattgcttaggtggcttcttgtcacttcttctcttctg

SEQ ID NO: 199191 - DNA, 333 bp, Homo sapiens
ttaaaaattttttttgaagtccagtttatcaacttagtccttgttgcttgtgctctcgatatcatatctaagaaatcattgcctgacccaaggtcacaaagatttacatctatgtttttttctaagagttttggagttttagcacttacattaggcctgtcatctatttttgatttttgtgtatgatatcacataagggtccacattcattcttctgcatgtggatatttggtccaatatcatttgttgaaaaggctattccttgttgaaaatcagttgaccataaatgaaaaggtttatttctggacttccaattatattccattaatctct

SEQ ID NO: 199192 - DNA, 253 bp, Homo sapiens
  misc_feature (2)..(2): n is a, c, g, or t
gncgactttagagtatccccggtgaagtacatagcataatagattgatggtaattaagtagtcgtgtttaataagagtcatcagagttaaaggcattgttggaatgagcagcttgggaaagcaatgagaaggcatgaagaaaggaggtgggaaatatgttaaggaataacttttttgttacactaaaggaaagatcagaagaagaccagtgtgtctctgtgtgtgtgtgtgtgtgtgtatgtgtgtgtgtgtg

SEQ ID NO: 199193 - DNA, 429 bp, Homo sapiens
agaggagaggccatgattggccattaggagcttcatcaagcgtcagcttgcccacagctttggtttccagggagactgggaagtaacaatacaatagttcatcttcattatgagtgtaccatgccaagagctttcctaagtgctttacattcattatcctctttaattctcttaagaattgtatgaggtaggtcctattattacctctatcttacaaggaaactgaggatcagacaaggatatctagcttatccatgattaggtagagctgacaatgggattaaataatcaagtcctgctactgccaggttaagaaaacccagctctttgttgttttataacaactgggggaagctggtgtgcatcattggctgataggaagagaaattgaattccacatctatgtcctacttcatgcatggattgctc

SEQ ID NO: 199194 - DNA, 205 bp, Homo sapiens
taaaggaaatttataatcttaaatgtgtattttacaaaagaaagaatgcaatcatctatatttccatcttgagaaattagataaatccaaagaaactagaatcagggtttgtgaaacaaaagatagagaagggctggatgtgatggctcacacctgtaatcccagcactttgggaggccaagtcaggaggatcgcttgagcccag

SEQ ID NO: 199195 - DNA, 407 bp, Homo sapiens
accacccacgccaatccttgagcctagagtaacgaagagaaaggctgcaacgaccacacacaccacgacgtcagcccaaaggccacgtggctccatccacggcaacaaaatgcaagggagctccgagggacacttccgtttcaggacaggcttacggggaggacaccagctcctcccaccctatctgtagactgggtagaagggcttcttttgagcgctctgtcttcccagagaaggacgtcctggaaacaaggcacgtgcagtattaccattaaacaacatgcacatgccagtggcgctaaataaacagcagagacagaggctgcctcacccacttgctccatagtctgcatcgaatcaaggtcactggagacaaggtaaagtccacagagcccccttgcatttca

SEQ ID NO: 199196 - DNA, 417 bp, Homo sapiens
tcctcttaacctattgataggaataccttaagaggaattgaggcaccaaccatggtagagatttttctcatctcagaaatatgtcatccctcccaacagaggcagggggccattttgtgagtctaatctagatgtttatatggtatatttatttgtcctactccatctacctcccaggattttttccccaggggttcattccaggccctgagtttcaagtgtaatccatgacgagattcactcctcatcacctactgcccccacaatgttccaaacctcgtactgatcatgtcattcttcttcttttgaaaggcaagttttgtttttcttaaaaattgtagttctttcttggctcctcactcagcttaactctttctgtaccactagctggaataaattcttccttcgtcatcctgt

SEQ ID NO: 199197 - DNA, 420 bp, Homo sapiens
atttattatttctctttgtcttcattgaattctttttatttaaattctaggagaataggctttcttcttggtgagaatgccttgagttaattgagtttcctgcagtttgtggtctgccatttattgtactggctccactgtatttataaacagggcaacctttccctttgaatcaatttttcctgtcttcaagtattgctttacagaactacctaatcttttattttatgtatgcctatgtatatatacatatatgtgatatatatatctatatatatatatatacactcatgtatataacactctcctgaattacattgaaaatgccaactaaaaacaacatgcaattttagcttttcacattgcaaatttatttctaagaggatattggtatagagttcaaaacttggtccgcttttt

SEQ ID NO: 199198 - DNA, 193 bp, Homo sapiens
tgacaagcccactactaaaaattatatggaaatgtgaaagacctagaatagtcaattttgaaaaagaacaatgttgacggacttacactgtctaagaaacttagtgtaaactataataaccaagactttgtggtattattataaatatagacatatagatcaatggaacagaaagtccagaatagtttatgct

SEQ ID NO: 199199 - DNA, 399 bp, Homo sapiens
acttaaagcttaattagtaataaatggattattagggcaacttcatttatgtttatggtaaataattctcattttaatgttatatgtctggctatttattacatcatgaatgaaatatttagaaaactcctaaaccagagctgctatggctaaactgtatgatgtcacagtaatgtagctcccataaaatggtgttctaaaatagttagaatgaaagcaaacacttatgaaatattatcctgtaaatctagtttaagactagtttaaaatagttaagtctgccaggcacggtggttcatgcctgtaatcacagcactttgggaagccaaggtaagagggttgcttgaggccaggagtttgagacaagcgtaggcaacatagtgagaaactccatctcca

SEQ ID NO: 199200 - DNA, 506 bp, Homo sapiens
aagggccttcacgtacagcagtacaggctgggcactgcattgtttgagagagaaactacattcacacagtgaggtgctccctggagctgtgcagggtcaccagggcttcggggtcaccagagagacagttagaccattgaaataaatgactttgcccattcttctgggaaatttctcatcagaactacccagaatccccatctgtgagtcagctcgtccaaccccagcttagagccttctgaggcagcctcagcaattgggcatccagtcctagcatgcactcctgcctagacagagctccttgctgcccatacctccacccagcatggctctacctggggaaagctcttgctgaaccaggactggcagcccctctgccccgaccctcctggctcccacatctgtcctctgggcctcaggctcctttggcccaggcaagggcctgttgagacttagggttcaggagcctcgacccctcccccagggctcttctctttctcagcagc

SEQ ID NO: 199201 - DNA, 492 bp, Homo sapiens
  misc_feature (56)..(56): n is a, c, g, or t
  misc_feature (65)..(67): n is a, c, g, or t
  misc_feature (117)..(117): n is a, c, g, or t
gcttccaagcgagttttctcaaatcatgaaaattattaatattactgctgttaganaaatgaatnnncctacagatgataggatgtttcatgtggtgtatgcatctcggcagacaangaaccacttgcatgggagcttccttgaggtctgtagaatcagcagaatttgactgttggttataggaagaaatgttgagagccttccttctgtcagatcaagtaacaaatggagtgggttttaccccttaagttgtgttgcattaaaccttataaacatttgggctgttaagaaagcaaagctgtctctttctctgttcccagttgacgtgcgaaagatgccctcagaagcttggttaaataggtctgtgtggggaatgagcctttcagttgggttttcaagtttcttagttatgagtttttttggtagctgtagaaactgccagtctgagaactattgttccttgcctctcttggattagaagtggttccttgt

SEQ ID NO: 199202 - DNA, 450 bp, Homo sapiens
agtggtttcttttgagaatgtaggtaagaataggtgtccttgagactgaaaagaaattcacctaaaattgttcattgtggttgtatcttaaaatctttggggtcgttgaatgaactttggcttagaaatttgtagagatcgtctttttaactgctgtgagtctgcagatgtgattatctatagtaattccagatgttttctcatctattagttttactgagtaggaagataactgagaacaacataaagtaacttcaaagcagtttgctagcatttaatcctgactaatttaattaattattcatccttgtagtttttcctattttattgattatgaaactgagacaaaggttacgagttgcccaagatgcttggggagtattaaagatagcccaaagcttaaactctaacactgttcagacttttagcttgctttttcttaaaaaaaaa

SEQ ID NO: 199203 - DNA, 746 bp, Homo sapiens
tttctttttatttttccgcaccgcacaggccccgggggccaaaaataatcggggctctggagagaggagggtcccggccgcacggatatcgggccccaagcggggatggaggcgtcgggggcggccgatgcaacggattgcgaggcggcggcggcagcccgggtgctgcggccggcagctgaaaaatggctccaggaagctgctgctgacaatgaatgaagggatacggtttacgcgccaaggtcctcccgcgaaactcggatttcccgccggcttttcaaaccatatttgcatatccccgcccctcaacccgccgaggaccgttcccacagcccattgggccgctacctccttacttcagtcccaatcatggagcagggccgcgacttgctggtttccattggctgccgtgcatcatggttaccggggcgacagggaccctatttgcataggcctccttgattggctggcagaagagcagtttttagggggtggggcaaagaatttccttctctcccacggaagaccacgcctggcctaggctccgcccctgtccccgcccgcccgccgggccggcgctactgacctgggcagggactccgcgccccgcagactcagtgtagatctagtctagagcccaagtttcgcttttggaaattgtcaaggtgactaagggaacactctttcctttgaccagtcagtgcaataaacgaacagcgcaggagatttttccagatacgtgccaa

SEQ ID NO: 199204 - DNA, 682 bp, Homo sapiens
ttttattcaatctggaaaggcacaatgatttggtggaaagatagcctgcttctagttccacctcaggaactagcaagttagttgtaaacctgatgagtagagccatccttacgttttttctgtaccttcttccacatcaaacacatcagaacaacgaactctgcttgagtatttgctttgtgccagacactgccctaaataacagatgagggaactgaggcttagaaagttagtaaatggcacaaagatacccagttaatgcaaacccacaatttaaatccaggctattcaagtctactcttaccaactctcttatatcgtgttgccgagaaacgacttctggatttcttcttcctctcattcctactgtgccattgatgtaagaggtaccatcaatttaatttaataacagttttcaggaaataaagtaagcactaccaaatcaagtgtagttatagtgggcctgccttttaaaattctaaccaagtttttttccttcttggtaattccttttttacttcatgtccctgaagctaaaatcctcagggacagctaatcacaaaaaaacaggcagattcttggctattgacttctaaaattgggtcatgcaactcataaaagatagccaggagccagggttggtttttgatttggtttggtttgaattataagacagaatttg

SEQ ID NO: 199205 - DNA, 340 bp, Homo sapiens
aaaaagattgcaaagggaacacaggtaaacatcttcaacctaattcagtctgaagaaaatgatggcctttgttttggtttcaaattcattccatcctccccagaacacttttctggatggggctgtgttcacccctgtgtttctgtctcaactgtgtctcctatcaacagtgagctttcctgtccttggccttctctcctggaatttgtataaatgtctccttggtttacgaggccctctcaatgtggcaccatcatccgtgggaacctctcaacgtggcaccgtcattcatggggtccaagtgtggcacgaggttggcaatgccccatgagatttttgt

SEQ ID NO: 199206 - DNA, 438 bp, Homo sapiens
agtggagatggggttttaccgcattgtccaggctggccttgaactcctgacctcaggtgatctgcccaccttgccttcccaaagtgctaggattacaggcatgagccactgctcccggcccctggtgcagttctgatacaccttacaactaatacagccttgctgcactgtttatctcactgttagggacaggatcctattatttagcctctgactcatttgtgtttaactaagaagatgatttagatttcttgaacaggggactagctgtcaggtcgatcctgagacagttgtgagcagcacagcccttcactgagttgggccaatctctgtcccatatggacattcctgagttagcggaaaacaaagggcctttcactcctcatatttcattatccaaagtcctctccgtaagtcttacaccgcggtaaaagcttg

SEQ ID NO: 199207 - DNA, 243 bp, Homo sapiens
ggtaatatctattgttcagcacttctgatagtttatcttagagaattattgtacatgaacacaagaaaaatttagaaggatattcatttcagcattgtaacagtgaaaaactaaaacaacctgaataccaacagtaaataaatggggaataaattacagtgtaataagatagactgcagagaatatactagtaaaattgaattaattacctccccctccaccttacttagtttgtattatctt

SEQ ID NO: 199208 - DNA, 456 bp, Homo sapiens
ctttccacctcagcctcccggtaactggtagtcttcttgacaaagggtgtgccaccatgcctggctaatttttctaatttttgtagagatggggtcttactgttgcccaggctggtcttgaactcctgagctcaagcaatcctcccaccactgcctcccaaagtgctgagattacaagtgtgaatcactgcgcttagcctacgaaaatttttttaaaacattaaccggacatggtagcatgcacctgtagtccccattactcagaagcctgaggtaggaggatcacttgagcccaataagctgagtttacagtgagctatgattatgccactgtactccagcctgggtgacagagcaaaaccctgtctctagaaaaataaaaataatttttttggaaaaaaggataaaatttggctctctaaagccaccttatttcttaatgattctagataacgt

SEQ ID NO: 199209 - DNA, 432 bp, Homo sapiens
catgacctgggcacatccctctcctctcttggcctcagtttccccatggaaagctgaaatacaccatccaactgtctcattctttatttgtccccaaattacttaactcattctatagaccttagttgcttcatccaaaaagtggggaccataaccctgccctcatcccagatctgtgcagatgaaagagagggagggagagggaaagagagagatgctttggggtgtatttggccagaggccaccaggctggatcccatgaagaaatctgggtgagagggtcttaaagtcataaactgagatccagttgccaggtggctgcatagttgccaacagtgtaatgtgtcaccttttgatcttcatcagaaatctcaggctggtggccacctggccaaatacactgcagagcatgtctgtctgtctgtctgtctg

SEQ ID NO: 199210 - DNA, 572 bp, Homo sapiens
tctgaagttatctgaaaatgtcgtcatgattaaatccagcctaaacattttgccaggaactctgcagcgtccatgctgtagcttcctacctcagtccatctgcaggcagagaaggcccagtgtgtccatccccaatgcggtgatactaggatggtcacttggttaaggaggggtctaggagctctgtcccttgtaaagacatcttatttgtaagtaatttggaaagtggtgtgaaatagtataaatatcctgtattctaatgatcttcttcagaacattttatcaccaattaatcaccccgcctgtgtcagttattatatttatgtttgcacaatgaaaattttctatctcaaaatattaccttatacttgcttttgctggcattcttcgtaaaaaagattattccctgcccaaattttaactttcatccaaaattaattttaatttctttttgctggcattctgttgtgaaaaagaatattctctgccccaattatcactttcatccaaaattaattttagtccatcagttaaaattttaagttttaaatctgtttaattaaaacatttct

SEQ ID NO: 199211 - DNA, 731 bp, Homo sapiens
ccctcccttccctacacatcaagctcgaggatttgcccccacccaggactggcaaattagctttactcaacatgcccgagtcaggaaactaaaatacctcttagtctaaatagacactttcaactgaataagtaaagacctttcctacagggtctgagaaggccaccgcagtcatttcttcccatctgtcagacataattcctcagtttagccttcccacctctatacagtctgataacagaccagcctttattagtcaaatcagccaagcagtttttcaggctcttagtattcagtgaaacctttatatcccttacagtcctccatcttcaagaaaagtagaacggactaaaggtcttttaaaaacacacctcaccaagctcaaccaccaacttaaaaaggactggacaatgcttttatcactttcgcttctcagaattcaggcctgtcctcagaatgttacacaaggtacagtccatttaagctcctgtatagacgctcctttttattaggccccagtctcattcgacaccagaccaacttagactgtgcccccaaaatcttgtcatccctactatcttttgtctagtcatactcctattcaccattctcaactactcatacacaccctgctcttgtttacactgccggtttacactgtttctccaagccatcacagctgatgtctcttggtgctatccccaaactgccactctaagctcttaaagtaa

SEQ ID NO: 199212 - DNA, 485 bp, Homo sapiens
tgctatcactatacaccagacatcttcatccaactagagtcggaaactcaggttctctcagtgaatatgcgcttcgggactcgcgattccgtccccgatggtgcggggaatttctgctccagttatttcttctaatccggccacgacagaagtgcagaggaagaaaccttctgtggccttcaaaaagcctatcttcactcaccctatgccctccccagaagcagtcattcaaacccgatgccctgctcatgccccctccagctccttcaccgtaatggctctggggcctccaaaggtctctccgaagagaggtgtccccaaaacctctcctcgccaaacacttgggaccccacaaagggacataggattacagactcccaggatctctccttcaacccatgagccactggaaatgacgtcctccaaaagtgtatctccagggagaaaaggacaattgaatgatagcgcctccacaccccccaagc

SEQ ID NO: 199213 - DNA, 1615 bp, Homo sapiens
  misc_feature (1079)..(1080): n is a, c, g, or t
  misc_feature (1106)..(1108): n is a, c, g, or t
  misc_feature (1156)..(1156): n is a, c, g, or t
agaggggcccacagggccaaggccatggccgcatggctctcaacctccagctttcagacactgatgacaatgaaacgtttgatgagctgcacatagagagcagtgatgagaaaagtccttcagacgtgtcattggctgccgacaccgataagtccgtggagaacctggatgtccttgtggggtttggaaaatctctatgtgggtctcctgaagaggaggaaaaacaagtgcccatcccttcagagactaggccaaagacttttagtttcattaagcagcaaagagttgtaaaaaggacttcttcagaagaatgtgtgactgtgatatttgatgcggaagacggtgagcccattgaattcagctctcaccagactggggttgtcactgttaccagaaatgagatttccatcaattcaactcctgctggacccaaggcagaacatactgagcttttacctcagggaattgcttgtttacagccaagagctgctgcaagagactatactttctttaaaaggtctgaagaggacactgagaaaaacattccaaaagataatgtagataatgttcccagggtgtccactgaatctttcagctccaggacagtgacacaaaatcctcagcagcaaaagctggtcaaaccaacacacaatatatcatgccagagtaattccaggtcttcggcacccatgggcatctatcaaaagcaaaatctgacaaaaatacctcccaggggcaagtcttcacctcagaaatcaaaactaatggagcccgaagccaccacactactcccttcatctggcctggtgactcttgaaaaatcaccagccttagctcctgggaaactctcacgattcatgaagactgagagctcagggccctctttgaattacgatcagatccacacattccaaaacattccgcccaacttccgcacagctccaggatgcccagcaggagggactgggtccagtgccccaagagtcagactccagggtcacggtcaaggcctgccattgagtctagtgacagtggagagccccccacgagggatgaacactgtggctctgggccggagnnaggggtgaaatcccttcccctccgcnnnctccaggcaggtccgtctccctgctggccaggcccagctatgactatncaccagcaccttcatccaccaagtcgaaaccagggtccccagtgaacagcaaggacccattcaaatccccgctgctgaaaggaatttctgctccagttatttcttctaatccggccacgacagaagtgcagaggaagaaaccttctgtggccttcaaaaagcctatcttcactcaccctatgccctccccagaagcagtcattcaaacccgatgccctgctcatgccccctccagctccttcaccgtaatggctctggggcctccaaaggtctctccgaagagaggtgtccccaaaacctctcctcgccaaacacttgggaccccacaaagggacataggattacagactcccaggatctctccttcaacccatgagccactggaaatgacgtcctccaaaagtgtatctccagggagaaaaggacaattgaatgatagcgcctccacaccccccaagc

SEQ ID NO: 199214 - DNA, 607 bp, Homo sapiens
  misc_feature (523)..(523): n is a, c, g, or t
gagatgaagtctcgctgtgtcgcccaggctggagtgcagtggcgcgatctcttctcactgcaacctccacttcccgggttcaagcgattctcctgcttcagcctcccgagtagctgggactacaggagtgtgccaccacgcccagctaattttttgtatttttagtagagacggggtctctccacgttggcccttcccactccttgtcagaagcagcaactcatctctcaaagaacaggctcagtttgtttcatcaccgaagttaggcggtagctcggaaaccccttctctttgctcacatctctgctgagcctctcttgatggagacctcctgagcctggcttcactctgccggttccacctgggtggaatgcgtgtgtggaaacaggtgacgggttaagcccttaggaaggtttctggtccgtggcctctgtcccccaccagctcacgaggcattctgggcaataacgcatccactctatccgcctcctcctcattacgcctgtctcattgcttactccangctgtagttcccaacatgtcctcaagagtttgggagcgctctgacactgcacgcaaatcccggtcgaccgaatcctcgagagtc

SEQ ID NO: 199215 - DNA, 191 bp, Homo sapiens
ggtggatggataaatggatggaaagatagattggtagacacatggtagatgggtggatggatgaactgcaagtgtaaggatggtagggcttaggctggccatccagggcctcacacctgggcattcagtagcagcttacactaggaaatcgatgagagagtgtggaatcggttgtccagtgtgggagatat

SEQ ID NO: 199216 - DNA, 467 bp, Homo sapiens
tggcccctccctgcatgccatggcttttcaaaatgtgccatggtgaagaggactcctgatcacctgttactcgagcctgtcaccagctggcttcatcacaaagagaacttaccccttacatgcctggaaagtcctagggctgggcgtggggtcagctcacaatgtccccccaaccccacacccatgagctggaaacagatgagggggtgccgcacaggaaagcccccgggagaggaacggatgctgctcaggcaggagcaggtgctccgagctcttcctgctgggttgggctcctccaacccccaggtccactctcctgggactgcgcacatggcctccggaggcccctgattgctctccttcctgtctcccctgaaaggcaaagctttttctgccagcacttagcatttgtagactttacagcttgccacacattttgtactaagtaaaattatttgttgatttat

SEQ ID NO: 199217 - DNA, 331 bp, Homo sapiens
acggctatgttctgatagtatagcctagagttttctatctagggttattatggttttaggtctaacatttaagtctgtaatccatcttgaattaatattagtatacaggtgtaagaaagggatccagtttcatctttctacatattgctagccagttttcccagcaccatttattacattgagttatgtcccttgtatgccagtttttctgagagttttaatcctaaagggatgctggattttgtcaaatgttttttctgtgtccgttgagatggtcatgtgatttttgatcatggtggattttctttttgataagttgttggattcagtt

SEQ ID NO: 199218 - DNA, 348 bp, Homo sapiens
gattgggtgcaggtgatgctgattggatgcaggtgatgctgattgggtgcaggtgatgctggctgattgggtgcgggtgatgctggctgattgggtgcagatgatgctggctgattgggtgcaagtgatgctgattgattgggtgcaggtgatgctggctgattgggtgcagatgatgctggctgattgggtgtgggtgatgctggctgattgggtgcaggtgatgctggctgactgggtgcaggtgatgctgattgcttgggtgcaggtgatgctggctgatcacgtcgatcttgtccaggaagtactgggcacagtcaatcagctggtactcgtagaagcgtacgt

SEQ ID NO: 199219 - DNA, 487 bp, Homo sapiens
taccgcgcccagcctccttgtccattttttaaggccaaatccacatacaattttttatcttgatacatgttttgagagtaattagtggaatagagctgagtgacttgttttatgtccccagatggattcattgtgtgtttcccactcctcaatcatgtacaacatagaagtgcagttggagagttacagaattcttctctttgttctcagtgccctcttgagaagagtagggttctatcagtgacttcttccttttcacttccaattggtcagaaatttgtactattagatgcactagatctttactattctcatttcattttttagtgtctttctgtcttctccaattctccatttatgtgaaaaataccatcattctgctcttgatccagtacctttgtctgggacactgtcttcattcctttttagccccatactgtatagccatgggtcaggctctgttactggagcgtcagtctaggctgac

SEQ ID NO: 199220 - DNA, 1318 bp, Homo sapiens
accctccccatgagttgttgataattttcaaacctatacagatgtggaaaagagtttaaaaaactgtgttcacccatcgtgcagtccagaagccatcccctccaaagcccccttgcctaatctgttctcccctgccccactctctctgctgaagtaccttcaggcaaaccccgggcgctgtggcatggtatttgcgaccctctctgaagccactgcagtgccatcaagtcagagacacatgcacggtgactccgtggggtcatccgatgccaagtctgcgttggggttgtatctcaagtgtgtctttggatagttgtgaatcagattggactgcatcgcatgagggcttagggttcctaggcctctggtaagccgaatagccccttccctccttcagctgctggcttgtagatctctgtagagagatgtccctcagcctcctcctcagtctactgtcagctcccgagccagatgctggctctgcaggcttggatcccacttattggtgagtgtgccttccacgatgtggcacatcaggagacatggcgtccataggtcctgtcctggtggcttaggtactacagccacgccgcccactcagagttcacatttgccatccatcgataggggtaatgcccaagtccccactggccgcccatccacaggggtcacagctgagtccccactggccctcttccatagaggtcttagccgagtccccactggccaagtcttagccaagttcccattggccctctatccatagaggtcttagccaagtccccactggccaagtcttagccaagtccccattggccttctatccacagaggcatggccaaatccctattggccatctgtccatggggatcttggcctgagtttgtttctttggaggtcattgtcatttatgaggttagattcttctataaagagaccgttccttgatcaccctcagctttttgatgacctgaaccacactttggacagaaatgctaacttctttccctttaattgccagctttcagtgtgctcctttcttaacatctcttaaaaatagaaacggtatttgttgtatgattcttccactcccataggtgcttgagcatccccacagtaagtttaaaaatagagcgtgtcactacctctgtttgttttcttgacatttcaagtgtctgtttttaattggatgatttcagggacagtttctgaaagggacattttacctgacatttgatgaggttcctaacactatgagtttctaggtgaagtgtatagtaaataaaataaataaaataagataatgctttcccaattc

SEQ ID NO: 199221 - DNA, 565 bp, Homo sapiens
aagtggtgcatctcaatctctttttttcttgataatggataatgaggcttcttaattcaagtcaattcagtcatatgagtctaaaacgcagccttttttgggtaacaacaacaaaaagtcaataatttgaggattcttcctttaactcttatttccttctctgagggcgtggtctaagtttctgacaggtttgtcacctctcctgtccctcagggaagggagtctcatcccagctgtccttgttctcactggcctcacttgacacgtggccatccccttctggcctggagtgacagcctctattccagctgccgatacccatggctctgccctggcctctgtccagccccctagcctgccatgctctgtcccctgtctgatgatgtccacagctcttgggggtccctatgttcctgggaggctgatcttagggtccccactgccaaccgttgctgtcctattctattactcagacagattgtagtgtcctagctatatcttggatgccatgcaaaaccttttttgttctggaattcccataaacctaataggatcactctgaaaa

SEQ ID NO: 199222 - DNA, 401 bp, Homo sapiens
atgaaaaatactaaatttatttccataaatgacatatttctgtgaaaagtaactattttttgaaacaaggaaagtgagaaaacgtcattgtttcacatttttgaaaatcttttatgtctggcttaatagaagacaatttcttttatctgcttctgcattcagtctattacaacatgttattttggatgaaacatataaagaaactttggcttcatgcagatctttagatggaagcgggagaaaactgtagggtcttaagaaccgtatttggaaaacgcttctgtttaagagctccataagatttatcatggcagaaaaaataaaaattaagaatgcaaaaagaacatgtaacaaattgtgatgtttttctccccaaagtaggctattcattgtgaatttcc

SEQ ID NO: 199223 - DNA, 660 bp, Homo sapiens
  misc_feature (32)..(33): n is a, c, g, or t
  misc_feature (38)..(38): n is a, c, g, or t
  misc_feature (49)..(50): n is a, c, g, or t
  misc_feature (54)..(54): n is a, c, g, or t
  misc_feature (77)..(77): n is a, c, g, or t
aggctggcgggcgcggggaaaatggcggcggnngcggnggcggctgcanntacnaacgggaccggaggaagcagcgngatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagag

SEQ ID NO: 199224 - DNA, 979 bp, Homo sapiens
tcttccccttccccaggggagcttgtcagtaaccacagaaaatcttgctaaatgtcaggaaccagaaatgcagtgctgttactgtaacttcctgaggtcctcggaaaccaggacttggtctcagctcacgtttaacactaagagcgctgatatatcggtcaccgatgtgtgccgaatggtggactaagtgcttgctgtgcattttatcttaatctgtgccgcagccccatttagtggatctgattgtccccattttacagatgaggaaacgggggctccgcaaggttaggcaggttgctcggagtcacatagctagtgagtggaagagctctgacttgatcccagcctgcctgattccagaactcatgtccttagccactctgcaaatctacctctctcaaaagttccagacaggtgaaccctaacaggtgcaactgattgccagggtcagggatgaaaagtctcctgggagagcagaggcagggacccaggtctcctgggacccatcaggatgctttccatcaacgcagactttttctggggggcagcagcagtgaccgtggggctggtggcctgggctggggtgtttgactccagtcagcccatctgccaggcgggcccagtctcaccacgcctattcgctctgattcctgccaaggaccctgcctccctccttgcaggctcaggagcctccatggcccctggatgaatctcccacttgcctagcaatcagagtcctcttccccagcagccaccagaagagaggctgccttgctggtctcagggagggggccggctcaggctgttcatgtgttcattcagcaaacgtttaacatagattcagagccagggagtgtgcaaggtgccaggatccaagcacaccagcaaggcaggcacggtctgttcttcccttgtaaagctcttgtaacgggggctgggaactgtgcatgggactctgggatcacgctggagtatgggg

SEQ ID NO: 199225 - DNA, 406 bp, Homo sapiens
actaaggggttgagccccgatcctatggacagtggaaaccactgtgagttttggtatagggtgtgaggtaggggtcatgtagaggtttggctctcccagcaccaattgttgaaaagactgttccccattgaatgatggtggcccccttgttggaatgaattgaccattaccataaggtatggcaggcttttgagagaggaatcatgtggtcagatatgtattatagaaagatcaggtgagacttgtttggactgggaatggctgggaggaggaggggttggagggaggctcttatgggtggacttgatggcagggggacagaaggggcatctggggagaagagacatccctggatcagcccatggcgggcagcaaggtacagggctatgtcctgagccaaggccag

SEQ ID NO: 199226 - DNA, 445 bp, Homo sapiens
ttccggtgactttgaacaatgtcactctcccgggtcaccatggccggggtggcggtctctccctgcgcaacgctcctcggaagtgaagccatctccccgtccctctgcccttactcacaggccctgctaccgggcctgtccttcccctgcttggaaccctttaggtgtcccctcagccatttggggctgagcccacttggctctcctgccgtctccccaggaggcagcttgttttgaagcgcctgcgtctagtaacctgtcgctgccttgcttctagcgcctcttaggcctttctgatgtcttctctgctgtatctcccctgcctcttagcctttatgttgaaactctcccaggttcaaagggtttttgcaccgggaagccatactcaccactatttgtgttgttttgggctcaatttattaaactcatacatctgataccatct

SEQ ID NO: 199227 - DNA, 302 bp, Homo sapiens
ccgcctcagcctcccaaagtgttgggattacaggcatgagccaccgtgcttggctggttctctctagtttcagtgagaaccgaatggtccctagggtgggtgatggagcagtcttttaaagatgattgtgttaattataatcttggtcctaaattagaaaaatgaaaaaaagtcttcatagaagtcataggcaggccaggcgtggtggcttattcttgtaattccagtactctgggaggctgaggtgggaggatcgcttgaggccaggagagaccagcctgggctctgtctctaaggaaaaa

SEQ ID NO: 199228 - DNA, 463 bp, Homo sapiens
tgtaaagcaaacccaaatcaagatatagaatatttccaacacccccaaaaagttcctgcctgccttctcccttccatcttctctttaatggccatgaaatgcatgtgtgtgcatgtatatgtgcctgtggaggggagggtggcgggcggatgagattactggacagctggcatttctgttccttgcaagcagcaaagtcaacagggagcccccaccagtatgaaactgaaagcatcaagtaattcagaggcatcagcatttctttctgtctaatgatttttatatacaacttaggtaccttatgctctcaaggtagaaaatacagttccgggcaaactgcatttcttttgctggcacacatggagctgtggggcccacctagcagcaaagcataaacccaacagggttgaggcatcaccactcatctttaaggctcctttaagcggtctcgtcaccctggaaa

SEQ ID NO: 199229 - DNA, 445 bp, Homo sapiens
gtctggtgcagtggctcacactttcaagcccagcactttggaaggctgaggcaagaggattgcttgagcttaggagttcaacaccagcctgggcaacatagtgagacctcgcctctatgaaaaataaaaaaattagccaggtgtggtgatgcatacctgtagtcccagctacttaggagactgaggtggatcaaggatcacttgagcctggcagattgaggctgtggcagcctgagttatagagtgagaccctatctcaatgaaaaaaaaaataggctgaacaaactgaattaaataggaaactctcaaatatcttaataactaagacaactatcaaaagactaccggatgacttacatgtgtataaaagggaaactaagaccctcaaaagttcaacatcataacagccatcaccatcaccatcaacagtaaagtctctctctcc

SEQ ID NO: 199230 - DNA, 534 bp, Homo sapiens
tccttctctttctttctctcactcacacactcaccaccaccaccaccagcccccatttaaatacaacaaaatactgctacaggctgctggatattcaaggtggagaggacacctgaactcatctgaaagaccttaggtaagtatttattaccctgtgccttaaatttcttccaaagattgtaattcaggccgggcatggtggctcatgctgtagtcccagctactcgggaggctgaagtgggaagactgcttgaactcaggaggtggtggctgcagtgagctaacttcatgccactgcagtccagcctgagtaacagagtgagaccctgtctccaaaaaataaataaataaaaataattgccgggcttggtggcacacacctgtagtcacagtcgctcaggaggctgaggcccaggagtttgaggctgcagtgagctgttactgaactactgcactgcaagcctgggcaacagagcgattaaaaaaaaaaaaggcgtggagcgtatccttgcgccttccctaaagactttgatt

SEQ ID NO: 199231 - DNA, 465 bp, Homo sapiens
cccaccagggtgtagaagggatcacctgtaagtgactgggaaggtgacccgcaccgtcacattctcactcttggccaaatgtgttggaggttgatggttctctttgcctggtcacaatggattcagtattccagacactcctagcacattgttaatgtttagtaaacatgaactaatggactcagggcctgatccccttcagagtagggtgagtgctttgtctgtatgactgtcctagggtatcaaaagctgtcacagagtagatctcgtgtcctcaatgatagcagcacccattctccaagagctgtgtgttcgtcctgattcacagaaatctctccccttccaattgttcccgtattagtaagaggaaatacatttagtatgagcaagaatgggtgcaggtgatttctgggtggctcttatttacatccatgtgtacctgtaataaaagagtttcctaacttt

SEQ ID NO: 199232 - DNA, 581 bp, Homo sapiens
gtacagagaccaaaggcctgagtgttgtgaggatctgtaaaaatgcagaaccctgagaatattgagacaactgaccatcatttaaagatatatgtgaatatgaacatattctttttttcttttttattgttatagagacagggtcttctattttgcccaggctgctcttgaactcctggcctcaagtgattctccagcctcagcctccccaagtgctgggattacaggcatgagccactgtgcctggcaggacatatttcttaatgtaacatgttaatacttatttagccatgttattgtgggaaaatgaacaccaattaatgtcctcagtagagaagggcaatcagcttcttgtttatccatatacatataactatgatgctgcaaggactaaataaaggcctaataaccacataagccatagaaattcatggggcagcatccagtaggaaaaggaactctcacttgagagttgagaataatagggtttgagttcccaagctgccatgccaaccaagtataaaacacgatggttgaactacttccagaaagttccttccagaaagaatttttttttattc

SEQ ID NO: 199233 - DNA, 219 bp, Homo sapiens
aatcttctcttgctctgtcctcagttgaaaatgaagctgaccatggcacctgtgtcacgctcagcacatgggcttgtttattcaagccattgggagatgctagaactcactccttgtcctacctgtcaaaacctccacaggccttggaaaagagtaagtggtagggccaggcacagtgactcacgcctgtagtcccagcactttgggaggctgaggtgg

SEQ ID NO: 199234 - DNA, 125 bp, Homo sapiens
tattccttaaagtggaactggcctataaaaggattgaaaacgttcatagatctagtggcacattgcctgagtgctcttcagaaagcttgaaacagttaaaagtgccattagcggagactgtctca

SEQ ID NO: 199235 - DNA, 455 bp, Homo sapiens
aacactgagctcctccatgcccttactggcagaacaccagccagacacctagtggcaggtggatgacattggaccacttccatcatggaaggagaatgatttgtcatcactggaattgtcactttttctggatatgtatttgccttccgtctgcactgcttcttccaaacccatcatctgtggtctacagaatgctcaacccattgtccacagtattctacacagcactgcatatggccaggagagctcattttacagtgcattaagtgcagcaacaggcttgtgtttgtggaattaactggtcttttcatctccccatctccctgaagcagctggcctgatggaactgtggaatggttgctttaagactcccaactgcatgacaacaatttgtggggctgaaggaatgtcctacaggatgtggcatgtgctctaacacagtgacaaatatatct

SEQ ID NO: 199236 - DNA, 581 bp, Homo sapiens
ggaaggatggcaggatctgctggtagactagattggaggtggggagtgaaagaaagagaaagtcatggatgactgcaatgcgtggcctgacaaccgggaatgaggaagaattaagtaacagcgagagaagagcaagtgtggtgggcaatggagattaggagtcccatcaggcatgtgcaaagcttgaagtgcctcttacgtaaataaacagagatggtcaagagagcttcatagtaggtcactggatgctggtcttgaatttccagagctgagcataactttggaagttaccagttttgattatttccatattattgtgagaattattttagtcttattatctccattgtatgtggaaaaatctgttttcccactatattaaaaactcggtggagagagaacatcatcggcagagtggtttgcctcgtgacagataaatgcaagtagatagtataaaatgaaggctcaataaatactgatagaacttgtgataatacatttttctttatgggtaatttacttgatataataatttttgttataagaacagttttaaagacttttaaacatgtttaatgttg

SEQ ID NO: 199237 - DNA, 491 bp, Homo sapiens
agggacttccagtcctggctataatagaataacttgtagctcacacagaggacaactgctggtgaatggattgacaaagtatagcatattcatacagtagaacacaattcaacaataaatgccaatgaaacaagaatccatcatgaatgagtgtcacagatactacactgagtgagagaagccagactcaaaagagtacttagggctgggtgcagtggctcacgcttgtaatcctagcactttgggaggccaaggcaggtggatcacttgaggccaggagttcgagaccagcctggccaacattgtgaaaccctgtctccacgaaaaatacaaaaattagcagggcatcgtggtgcacacctgtaatcccagctactagggaggctgaggcaggagaattggttgaatccgggaggcggaggttgcagcgagccaagatcgtaccattgcactccagcctgggtgacagagtgagactccatctcaaaaaa

SEQ ID NO: 199238 - DNA, 451 bp, Homo sapiens
tccctccctccctccctccctccctctccaagatatccagtaactgactgatcagctgggggtgggctctgctggctgccaagatgggccaccagcaaaaagggaaaattggttgtgagtgagaagaagagataagaaattccacagggctgataagaaagaccatgggcttccaggcgcggtgtttcacgcctgtaatcccagcacttgggaggccaggatggtcggatcatgaggtcaggagatcgagaccatcctggctcacatggtgaaaccccatctctactaaaaatacaaaaattagctgggtgtggtggcaggtgcctgtagccccggctaattgggaggctgaggtgggagaatggcgtgaaccccaggaggtggagcttgcagtgagctgagatcgcaccactgcactccagcctgggcgacagagtgagactgcatctca

SEQ ID NO: 199239 - DNA, 218 bp, Homo sapiens
ttttattattcattttataatatttaaagtttatggaccaggtgcagtggcttatgcctgtaatcccagcactttgggtggcttgcttgaggccaggagtttgagaccagcctgggcagcataatgatgtatatgttattaaatgaaaactcatagattttttttcctaaaatacagaatagtttatttcacttttaaattagtgtctcccaaagctc

SEQ ID NO: 199240 - DNA, 486 bp, Homo sapiens
gaatttggacaaatgacttaacctcctcctatcctcagtcttgacatctgaaacatggggataatcaaacccatctttgctgggttgtgaggctaagagatgacacatgtcaaatgtctaccacattgtctgaacacaggagaaactcaacaatggaagctactatattcactaaagtatgtcatatccacctcctgtccttgaaaagaaaaaagaaaggtttaaaaataagcttgctttttaaggtacccatactacagatggaagcaaagcaccatggaagtaaaacaatggatgattctgcctcctggtggtaaagcgcagcagcacaaaacatcacagcaaaaattggtttcatattctattgcttttcttaagaaaaatgcaaaccaagaccagagtttgagttttgcccctaatattttagaagtaaatatattaccacaataacttctgtatttattttaataacattaatacatgtct

SEQ ID NO: 199241 - DNA, 653 bp, Homo sapiens
tttcatagacttctaaaagggtattttactgctttttcaaaaagcctcagatggtttctttgttaagaaaatgttattatgagcattaatctttctatacctggataaacactaatgttaaaagctggtttatattcttaaagtactttctttaaaacctcattaatagatacatcttgaacatttgattactggtactgaaattttatatggttagtattggctaagaaagactataaggtatacatgttataggtaagtgattttcaataaaggtactgttggtatttggggctgggcagttcttttttggggtagaatactgtcccagacattgcagggcatttaaaacttgagacttgtggtgcttggcatggtggctcacatctatcatctcagaactttgggagaccaaggcaggagggtggcttgaggccagaagttcaagaccagcctctgcaacatagtgagagcctatctctacagaaaatttaaaaattagccaggtgtgatggtgtatgcctatagtcctagttattcaggagcctgaggcagaaggatcacttgagctgaggagtttaaggttgcagtgacctgtgattgtgccactgcatttctagcctgggtgacagagtaagactctgtctcaaaaa

SEQ ID NO: 199242 - DNA, 526 bp, Homo sapiens
tctttgatgattggaactatgatcggtaatatattacgtgctaacttttccacctccgtgtctttgttcatgccatttcttctacctggagcccactcccttttcttgagttcatagatttctttcttccatgatttccacttcccacctttcaagctgataagtatctttctttctgaattcccgtaacctattttaacaggaagtataggtagtagtttggcacagttcctctggagtcagatgatctaaattcaaatcccagatctgccacttactatctctgtaacttcggacaagttatttcacctctatgtgtcccagttgccttaactgtgaacatgggaataacaatatccatatcgtgggcttgttgtgaagaccaaatggattaaagcacatggagaaacagcacaatacctgacacaagatgaatgtctatcaaatgttaactattacttacatttactttctgacatttattatatactcccttgtttttaaaactgtacttacataggccata

SEQ ID NO: 199243 - DNA, 631 bp, Homo sapiens
actgagtcttctcaggtgtcaggtgaaagggctgactatatttgggcgaaagatattttcaggtgtaaacttccgtgagttgtgatttggagctgtccatgatcacagcatctgaaagaaaacaaattctagagcctacagtatttccattttgagggaaaaaaattttcacaaaatcagcttaaaaatcaaacatttttcatcatttagagcaaagtaaaaaggactaaaaaaaagaaacaatttagagtatatagcaagtgcaaaaacgctgagagagcaatcggggtgggttgctacaggccaatgtactttcccttatttctttccaaagtctcgggctgcaggcacacagatgtgctgattgtcctgcatacccagctcaatgggccggtcagggtatgggtggcatttcagatatgctttctaagccttttgagaattcaaatgcacagagtcatttctatttttgcagagctacaataaactggagggccgttcaaacactgaatgaaagcgttcattggataaaaaacatcttacttccagacccttagattatattgtgattgaacaggagtctggaaaggcaggcttaaaattaacaatcactcactattctaactcagca

SEQ ID NO: 199244 - DNA, 363 bp, Homo sapiens
aaagaatctattttcttaaaaaaaactactagaagaaatgaatttagcaaagctacatgatataaggtgcatgtaacagttctatgtctacatcctagcagcaaataatgggaaaatgaaattttaaaaatacgatttctaatagcatcaaaaaatacaaaatatttagaaaaatgtttaacagaaaaatgcgtaaaaagagctccatagcaaaatctacaaaaaaaaaggcagaaagaaactaaaaacctaacaaatgaagaaatataccactatcataaattagaatgtgcaatatcactgtgattaatgctcccaaagttggtctacggagtcaatgcaatcctaatcataaaccctagc

SEQ ID NO: 199245 - DNA, 858 bp, Homo sapiens
gagggcggggcaagagggatcactctgagagaacaaaaataggccccaagttgctaagcagtgattgggaaccttcctttccttggcggagatgcatgacattccctaccgatccccagacacagcctgtgggactcttaggagaaatggtgatttactgaataactgacccgttgccgagatgagtacaatgaagtggaggtgatgaactcaaatcgtcttccagggccaggcggctgaccggggtgagcgtagtggcccgctggggaccatggccgccctgacagccacacccacctggagctgacttggttctggctgttgctgccactgtgaaatctgtatctctctccatctctgctctactatccccggccttgccagacagtgttctttttcggaagaagtctagatttttgcatgaaaaaaactcaatctttaaaggtcgactcagaacattttaaggaggcctccacttggtctgatgcagtcttgctaattaagaactaaaggccttctgaccttcttggtgctcatgctgtacggcatctgaatgtctcgaccgagtctgagccgtgcagctgtcctccacctgcgaaagtaatgagaatcctatcacgggacataaggataggtctaaacagggtccatgccaagaaaacagtggggtgctctcccaggcctctcccctgtccactaaccctggccttgccggctgccttccaggctctgggggaagagctcctgcattcttccctggccaccttggctccagggctccccagagagcctcttccctccccaagtacctgagaaagatgagagaggcacgtgctctgctgggaaggtccagtgagc

SEQ ID NO: 199246 - DNA, 489 bp, Homo sapiens
gagggcggggcaagagggatcactctgagagaacaaaaataggccccaagttgctaagcagtgattgggaaccttcctttccttggcggagatgcatgacattccctaccgatccccagacacagcctgtgggactcttaggagaaatggtgatttactgaataactgacccgttgccgagatgagtacaatgaagtggaggtgatgaactcaaatcgtcttccagggccaggcggctgaccggggtgagcgtagtggcccgctggggaccatggccgccctgacagccacacccacctggagctgacttggttctggctgttgctgccactgtgaaatctgtatctctctccatctctgctctactatccccggccgtaccctaagcctggtgcgccgtgaagtggcgctggacggcgagccggtggcgttgacccgcaaggaatacgcgttgctgtcgctgctgcttgcgcaacgcggggcgcgagg

SEQ ID NO: 199247 - DNA, 814 bp, Homo sapiens
gagggcggggcaagagggatcactctgagagaacaaaaataggccccaagttgctaagcagtgattgggaaccttcctttccttggcggagatgcatgacattccctaccgatccccagacacagcctgtgggactcttaggagaaatggtgatttactgaataactgacccgttgccgagatgagtacaatgaagtggaggtgatgaactcaaatcgtcttccagggccaggcggctgacagccacacccacctggagctgacttggttctggctgttgctgccactgtgaaatctgtatctctctccatctctgctctactatccccggccttgccagacagtgttctttttcggaagaagtctagatttttgcatgaaaaaaactcaatctttaaaggtcgactcagaacattttaaggaggcctccacttggtctgatgcagtcttgctaattaagaactaaaggccttctgaccttcttggtgctcatgctgtacggcatctgaatgtctcgaccgagtctgagccgtgcagctgtcctccacctgcgaaagtaatgagaatcctatcacgggacataaggataggtctaaacagggtccatgccaagaaaacagtggggtgctctcccaggcctctcccctgtccactaaccctggccttgccggctgccttccaggctctgggggaagagctcctgcattcttccctggccaccttggctccagggctccccagagagcctcttccctccccaagtacctgagaaagatgagagaggcacgtgctctgctgggaaggtccagtgagc

SEQ ID NO: 199248 - DNA, 489 bp, Homo sapiens
acaaagttcttttcccttcacaatttcacatatagaagatttgttcttactatagatcttagaaacctcaacatatgatttttttctttccttgagtaaagagctttcacttaaaagaacccactttatggcttctctttggcatgtttgaattgccaacattactacttctgggctttggggccattattaagtcacataagggtacttgggcacaagcacaatgatactgcaacagttgataggataaccaagatggctgctagtgactaatgggccaaggttctgggagcatctacagtgtggatatgctggacaaagggatgattcacatcccgggcaggagtgagcaggatgacatgagatttcatcacactactcagaacagcatgcaattttaaatttatgagttgtttacttctggaattttccatttaatattttcagactatggttgacaacaggtagttgaaaccacatgcagaaaga

SEQ ID NO: 199249 - DNA, 470 bp, Homo sapiens
ggagaacagagtcaccctggctgacagccagctcagccaggacattagagacggggtttcaccatgttggccaggctggtctcgaactcttgacctcaggtgatgcaactgccttggcttcctaaagtgctgggattacaggcgtgagtcaccgcgcccggccagtcgaactctttcttctgaggaggcaaggattgagattgctgcagaacataggcattggccgtcagtaatataccgtgtgactcagaacctcccccgcttctccctgcatcaagagctggggagacggcagcgtgggactcgtgggtaatcccctgcagcggcctgccactcctcccccactgcctggtctgggtggggcacaagactcaggcctaagccaatcagagccttccctggctgcagcaatgggtctaagggccctccctctgtgaccctggccttggccaccaggcttgctttggcca

SEQ ID NO: 199250 - DNA, 451 bp, Homo sapiens
gatcctgtgaataaaatggcgcagacgtgcttgtgcggctttcctgctggagtccatgagcgtctcgaggatttggataggttgagcctttattgggctgtcaaggtgtcttcctagacctcatggtgtcactgaattggatccattataaccctccattcatctgcttggctctcgacagactcacaaatgtgctcagaggccaagtcaccctgtgtgctgccagcccggggcatgtgtgttcatgtcatgtcacgatctgttcagagtactgtcatcagcaacagagcatggctcggcacgcgggcaaaactgcaccaaccacgatgcatggacacagcacccatctagccctgacctggtggtttgtttgtgtccccttgctctgccctacccaaggaggatggggggttcagtgtgtaaaaaaataaagtctggactcatagataaa

SEQ ID NO: 199251 - DNA, 290 bp, Homo sapiens
ctagaggaccccaaagatctttgagcatcactcatgatagccaaaaggtgaaagcaggtcgagcacagtagctcttgactgtaatctaaacacttgctgggattacaattgtgagctactgtgcccagccaaatcacagatcttaatgcaaaagctaaaactataaaggttctataagaaaacgtacagaatatcttttttttttttttttttttgagagagagtcttgctctgtcacccaggctggagggcagtggtgtgatctaggcttactgcagtctctgcctccc

SEQ ID NO: 199252 - DNA, 397 bp, Homo sapiens
ttaacctgctttgataatgttaagagaaatggatctatatgcacatccgccattcttaaatggatgtttatggcctcaaacacactggacaaaaaatctaaaagattaaaattttattaaaattgacaggagcatcactcatgatagccaaaaggtgaaagcaggtcgagcacagtagctcttgactgtaatctaaacacttgctgggattacaattgtgagctactgtgcccagccaaatcacagatcttaatgcaaaagctaaaactataaaggttctataagaaaacgtacagaatatcttttttttttttttttttttgagagagagtcttgctctgtcacccaggctggagggcagtggtgtgatctaggcttactgcagtctctgcctccc

SEQ ID NO: 199253 - DNA, 905 bp, Homo sapiens
ctacgaagagagcggtttaaaatgggcaaaaattaaaacactacggtgtaaggtactaaatttttatgcgcaacacagggcgacaggttttaatacaccctatgtttgaatacccctggagatgttgacatcctgaacccagagcaaacatcttggttcagggtcctcaaactttttacttcatgagccttctaaaacaatttcgtaaagctgtgtatgttcttatacagtttagaatgacagctacatttttccggcttataaatatttcatctgtcgcattgtttaaatactgtatagccaatggattctaaataccatagggatttaacacccactaatatccatttttttaaaatacagtttggaaaatacaatttccaaatattgttttctggaactcatattgacgttgcatatctcctctagaattttatcctagtaatatattttatatttgaactattttgatcgtcttacttgtaataaaaatgtgaacataaaaaaaaaagcaaaagacaaaacaaaagagaaaaagagaagaaagaagaagaggagcgagaaaggaagggaggaagagaagaagagagaggagaaagaggagagaggggcagaagacgagtaaaaaaaaaaaaaaagaaagaaaaaaacaaaagaaaggacagagaaaaaagaaaagaaagaagaaggaaaaaaggagaaaaagaagaaaaaaacaaaaaaacaaaaaaagaaaagaacaaagaagaaagaaaagcagagagaagaaggagaaacagaaagaggaaaacagaagcaaacgagagagagaagagagagaagaggagaggaagagaggaggagagagagacagaagacagcaaggagaaagacaagaagagagagagagaagaagaggcagagga

SEQ ID NO: 199254 - DNA, 346 bp, Homo sapiens
aggggaagggcggactggtttggggatgaaactgttccacctcaaatcatcaggcattagttagattctcataaggagcccgcaacctagatccgtcctgtgcacactttactatagggttcgagctcctatgagaatctcaagctgccgctgatctgaccggaggcggagctcaggtggtgatgctcactcgcccactgctcacctcctgctctgcagttcggttccccacaggctgccaaacagtacggtctgtggctccgggttggggatccctgttttagatgatccacttaaaagagacagtatttacttccgactttgtttcctctccctgagagtggtg

SEQ ID NO: 199255 - DNA, 625 bp, Homo sapiens
gtggctcctgcctgtaaccccagcactttgggaggccaagacaggtggatcacctgaggtcaggagttcgagaccagcctggccaacatggtgaaatagccaggcgtggtggcgggcacctgtagtcccagctactccggaggctgaggcaggagaatctcatgaacccaggaggcggtggttacagtgagacgagatcacggcactatactccagcctgggtagcagagcaagactctgtctcaaaaacataaaataataaaaagatagataaattaataaaacttccgagtgctcaggtgttcattggacggtgcacgtagaggacattgcccgtggcagagagttctattggatggtgctgctctggtggttccaggagtgaatggtggccgtgtttgctttactagatttatagcatgaatgagccccagttcgttcccaagttagtgaacaacaggaaagtcaagtaacttataagtggaaaagtatgtttgatttgtattgggtaagttacaaggaagattttttttttcacactggagactaagaaaagagaagaaatagattcttaagagaacttttaagaaaagctttcttaagagaagaaaaagggtttttcttt

SEQ ID NO: 199256 - DNA, 351 bp, Homo sapiens
tatgtatatatatatataaattataggatgcataatactatatttgcaaagatttattcgaactgtgttttacgtttatcagctactagttatatgcagcaagaaaagctagtaaactgttcttggctcttggcctattatttttcagtcttattctgagagagcggaaaactcagagaaaggctgtattccctggatgatgaggggaggagactgttggtgcccagcactgctggtggctttcccgagggtttcacaacttagattttaacctgctctttttatcgttggtaaattcttttagaaaaagtacttagaaagtagaagtgggattcctaccgtcaaagtgca

SEQ ID NO: 199257 - DNA, 536 bp, Homo sapiens
ccgtgcccagctaatttttgcatttttagtagagacagggtttcaccatgttacccaggctggtcttgaactcctgacctcaggtgacccacccgcctcggcctcccaaagtgctgggattacaggtgtgacccaccgcacccagcccaaaccatggcatattattaaaccataaaaagtaatgaagtgctgatacactgcacaatgacatggatggacttagaaaaggagctaagtataagaagccagtcataaaacactatatattgtatgattccatttatatgaaatgtccagaataggcaaattcatagagacagaaagtagattagtggtttccaggggctagaggaagtagcgaatgaggagtgactgctaacaggtatgggttttctttcaagggtgatgaaaattctaaaatcagatcattgctgatggttgctgaagtctgtgaatatactaaaaatgattgatttgtatactttaaaagagtaaatgttatggtgtataaatcatatctcaataaagttgttaca

SEQ ID NO: 199258 - DNA, 208 bp, Homo sapiens
ctaaccccctggagccggaccctgcacgcccagggccttgagggacaccgaggcacttcagccccgggggtgggaggcgtggagctcgtgcgcgagctcagccagatgttccgggcggttgcagatgtgcctcggggccggggacaggactttcctcctccctagcccccagcctggagctcaggtcagtaaacaaactcggttctcc

SEQ ID NO: 199259 - DNA, 522 bp, Homo sapiens
tccccaggaagtaccaaacagagctttaacccccctgctgagttataggctttttttttaggaggtcttaaaaggccaaaattttacctggttttaaggggagggtttgccccaaatgtaaagcccccctaataaatttatcctttcactatttaaaagtagctcaccatcaacacatgaaaaggcaacctatagaactggaaaaatatttgcaaaccatgtatctgataagtggctaatatataaaatatgtaaagaacaactcaatagcaaaacaataaaaaataaaaaacaacaacaacaaataattcagttcaagaaagggcaaaggacccgaacagacatttatccaaagaagacatagaaatggccaaaggtatagaaaaaattgcctagcttcactgacaacagggaaatgcaaattaaatccacaatgagatattacctcacacctgttaaattggctattatcaaaaagacatgagataacaagtgttggcaagggtgtggagaatagggaac

SEQ ID NO: 199260 - DNA, 421 bp, Homo sapiens
aaagcatgctccaaactctccttccagataaccaactttgttcaatctcacaaaggacaactttcctccaagggtccagtagaactggaaagagggacaggagtagaaataatgttagtcacgggcatcgtttatcagaaagagcatctcctgtgtttgagtttcacaagaacaaaccaaggtgaagccgaaggaaacacttgaaataaaggtttcacctcacagagactcaagcactggaagacctgctaaaagctaccgtgaaagagcttgcgaacgaagggaactccacgttggtaaaccagatgttccgggttccaagttacatttttactcccaacccctccatgctttctaacgttattatcttttggacgtgatcaaagtttgtaacatttaacttctgttcctcacaccgtgg

SEQ ID NO: 199261 - DNA, 447 bp, Homo sapiens
tagtagagatgggttttgccatgttggccaggctggtcttgaactcctgaactcaggcaatctgcccacctcggcctcccaaagtgctgggattacaggcatgagccactgtgcctggcccagatgcaatattttaatccgtcttagtaattttatcaagtaatttgcacaccaaacacatccctggcattttcagcaacgagcgattagttgcaggaattttatgcaggaagatatttcttcatgaagccaaatcttctcctgtaaataagacaccagttcagatgaatcactgcacttgagggcagcttagaaactatgctgtagccgttcatctttgtttgaatcaccctgtatgcctttctgaatgtggaggaggaatttaagagaactgactcactatgtcttttattttactttgtaataaaatattttctgtcttgctgt

SEQ ID NO: 199262 - DNA, 342 bp, Homo sapiens
gacttggtttaggaaaaggaagcaaagggatggagaaggaccaagtacagccgtaaaactccacaagtgtgtcaagttccgctttgtgctgatcctacgactacgaaatttaccaaaacagtccaaaaggttctaaagaatgtatgctcagcatatccatactagttttaagaatcctaggaaaagatgtaactaggaggtaagatgtaaggaacaggtcctaccaatccaaagcatcattagcttaaaactttaaagagacaactgggtctcctattttctattttccatttccaaaaacaataaataaaacgaagagtagtgtgcaaagtaaaaaaagtc

SEQ ID NO: 199263 - DNA, 144 bp, Homo sapiens
aaaacaggcattggagctactagacaaagactttacaacaagtgtcttaaatactccaagagtgaaagtaaaacacagagaaagaactagtgaggaaaaggatatatgagcaagatgagagtatcaacaaagagatagaaatta

SEQ ID NO: 199264 - DNA, 243 bp, Homo sapiens
gttgctatgagctactgtattaagaagcacatagaagagcatctttgtagcatgccataaacacttaatgaatgatagctattgctattaagaggaagtattgaggtgttctctagcggttaagaatccaagtcttagcgttacaactttggttaaatgttgattctaccacttactaaaaatgtgaccttaggagtaactaagttttcttatcttgtaaaatggagacaaaataacaggacc

SEQ ID NO: 199265 - DNA, 709 bp, Homo sapiens
ttctttcatcttgtcgcagcggataaggggctgcgcgggggactagggttggtgctcagggggtctcgggggaaccagctgagattaggtgcacacacacggggatgcaagatggcagctccctgttctaagttttttggcatcatgttgcaagttaaaaccacttacactgaaatttctgagatgtctgctcactgctttaggctactcttatcatcatttaaaaaattataggtgtgccttggcagcatataaataggtactgattcattgtttcatccattgaaataattttggcagatttatatacacaatcattaaatcaattcacagataagtttttaaaataggaaatatcaaagataaagttattttcttagtaaaatacctaagtagctacatacaatgtataatttggcttgtaattaatgtatttcactgttaatatttctgatagtattagagattactttaaaaatgaagatgaaagttagttttcttcactgtaaatattaaattattactttataagtgtttaataaatctctacatattgaataataaagggattattattttacatctttaaagagaatttttatttaggaaattaacattcagcctaatgttatatctaacatggtgtccttttgtacaattgtatcaaataaagaatagaaactatattatggtttctagtgatgcccta

SEQ ID NO: 199266 - DNA, 413 bp, Homo sapiens
gtgcagtatatatatatatatatatgacatgcaaaatatatgttgtttatgtaatcaataaggcttccgatcaacagtaggctattagtagttaagttttgggggagtcaaagcttacactcaaattttcaaactcttctcttcacttctttacctatttgaatttcattcaacaattgttggaattaagtttactgtggagcaaaatggtggctgcctgctcgcgcgctctctctctctctctctctgtctctctcacacacacacacacacacgcacacacacacaccatttaataccggtctaagcccaaactggccgggtgcggtggctcacgcctgtaatcccagcacttagggaggccgaggcaggtggatcacctgaggtcaggagttcaagaccagcctggccaa

SEQ ID NO: 199267 - DNA, 249 bp, Homo sapiens
ggacgctcggccggcttatctttgcactaaaattcacatggaattgcagcacgattctttgcactcatggaatttttacactggaagggctcttagaaactgcctaacctagcccccaggtaaacagaatttgagttattcagaagcaacatcttgcagacagaatcatagtttaaatgcaccaggggaggttgctatttaaagtcctattctggaaatcctttgtaaagtcaagaatccttttgtaaa

SEQ ID NO: 199268 - DNA, 306 bp, Homo sapiens
atttttcctcccttacagatatgtctgagtcacagatccactgtgtagggcctttatcccctcctacagtgacatcaattatgctacaagtattctctaaacacttatcatgtacctgtcacagaactaaacccacacctaggctgggatgagacagatggtgtggaagcctctcccatttgtgtaagcatatagcatattcttgggcacacagcctaccccaaaagggcaattgtagtagctttcattgaggctaaaaaataaataaatattcgtgctttaaaaattttacctagcctgtgtttg

SEQ ID NO: 199269 - DNA, 455 bp, Homo sapiens
ataaattactttcctatttgcttcatttgctattgcagactatgcccaacagatgtcacataagaaattcaaattatatcttcaaatggaacataactttagtaatgaataattcaacagaataactaaaaaccagaagaaactaggaaaaaattccgctccaacacaacaaagcaaaaagtaggtcctgccctcaagacacagggtcatggaggccatatgccacgtgtgctgtgtgcgccgcgggtgctgtgtggtgcgtgcactgtgtgtgccacatgtgctctgtgtggtgcgtgcggtgtgtgctgtgtgtgccgcaggtgctctgtgtggtgcacgcgctgtgtgtggtgtgtgtgctgcatgcagtgtgcgcgctacgtgtggtgcatgtgctgtgtgtgctctgtgttgtgcatgcgctgtgtgtggtgtgtgtgccgcgtgtactc

SEQ ID NO: 199270 - DNA, 257 bp, Homo sapiens
aagtccctgttcattctggtttcatttgttttgttctggggaaaattcatgaacatacactagattcctctgatgtggaaggtttatcctggatctctcccttagatctctttgatagtctctgatattctcaacagctggatctattgcaattcattaaatttgaggaaaactaaaatagattacactgacatttacatttgcattgtctataacaaaagaaatagagtgaggaattatcaaaaaataatcagtag

SEQ ID NO: 199271 - DNA, 129 bp, Homo sapiens
gatgtaacaaatactttgcttgtaccccatatatttgtaaaatattttaattcaataaaaataatacgtttttattcttagttaaaaacagacacctacttttttccaaattctgtcatagattactga

SEQ ID NO: 199272 - DNA, 480 bp, Homo sapiens
cttgtattagatattgtaagtaatctaaagatgatttaaagtatataagaggaagtacataggttatatgtgattactataccattttatatcagggacttgagcattgtggattttggtatctataggggtcctggaaccagtcccccaatggatactgaaggatgactactacttgcctctgttcttttgtttatttttagctaactccctctggaacagcattttaagagcaacgtctgatatttttggataaaaatgctaactctgtgatgttgattcataaaatgttcccaagaattggtatattaaaattattctgggccaggtgcggtgctcatgcctgtaatcccaaagttgtgagattacaggcatgagccactgtgcccagccaagaagtttttaattttctctttttttgtttttgttttgagacagggtctccctccagcctgggcaatagaggaagactctctcaaa

SEQ ID NO: 199273 - DNA, 436 bp, Homo sapiens
gggctctctatccagtagtgctcagagcttgtctataaactttaaatagtaggtctaaataagtacattaatcaggaaaaagaggatcaagatccaggtaacaatgacgcttggctctaaataggctggcggtaaaatgagacaggtgttcctggggtgggagagggggctgctaattattattcataagcagatggcatatgatcagtttgtagaatacttttataatattgcgtgtgacattgtaaatccagattcctgaatatgaataggtgatagcaaaatggatagatttttatgtgatgaagcttttgaaagagaatatctcaaaattcaagagaagtataaatttcctcatatatttgaatggaggcacaagttccattttagtggatacatgaggttgacgaccttaaatctgaaatgaatgtaaaag

SEQ ID NO: 199274 - DNA, 442 bp, Homo sapiens
ataattttattcttttcaattgtttagtgagtaattattacttattgcatagactgtggggaagtaatagaaaaatgttcttccctcatcgagcttacattctagtgggagtgaaaacagcaggtagaatttctctgaagaatatatactgtatccatgaatatgtaatcagtctcctgaccagtgacttatatttgatttagatcaaatctactctgacactggccttgtgagattggtttactgggtaacctagtaacccttgtcttttggaatagcttgacagcctgtttgctgttttattcttttattaggtccagtctttttttctcgtgtagtttgatctagtggtgttttgccaagttaaaccaactgcattttttttaagatggtgtctcactctgtcacccagactggagtgcagtggtacgatcttggctta

SEQ ID NO: 199275 - DNA, 402 bp, Homo sapiens
agcctggcctgttccagatactcacgccagggtcacccctagctgcatagacaaccagaatgtgactctcagaagacgcacccagagcagacttgccccagctctcacagccagttagtggcagagcagggacgggaacccaggtatcctgactcccagcctaggagctgccaaatacgcaaatgaacacgggagcctccttttgtgaatctccggctccccttctcccagcaaagcattttccacaacaatcccacgtttgctgcgaaagcctagtaacagcaaatccagcaaagagtcgttaatagaaaaaagaccagaaggatgcacatccgactgctcaccacagatcctcccaggagaggggaggccgggcagccaccttcctacttctacatttga

SEQ ID NO: 199276 - DNA, 660 bp, Homo sapiens
tacattcatgtaaatagatttattataaggaactggctcacatgatggcagaggctgtgtggttccacagatctgctgatctgattttgcagacctgctgtctgcaagctggaggcccaggaaaggtccacagatggtgtagattccagtctgtgtctgaggcctgagaaccagaagtgccaagaggaggaggagatcaatgttcagctcaagcaatcaggcagaggggacaaattctcccttccttcttcttggcttctggtccgggcctcaaaggattggatgatacccaactgcattggtcagggcaatcttgactcagtctatcaattcaaatgctaatctctctggaaacagcctcacagacacacccaaaataatgtttagctaaacatctgggcatcctgtgatccagttaagttaatgcataaaattaaccatcacacccctgtatagtcagaaggaacactacagatctgtttttataggttggctcttatagaacttactatttaaacttcacctcctcgatcttgtaggtttaagtttgcacttatcattcatttcactggcaaaccaatgagaacgtgttttattttcttaccttgggattcccttgatttacaaccgttcatcctgagccagaatcaaaaaaaaaaa

SEQ ID NO: 199277 - DNA, 469 bp, Homo sapiens
tcttaaccctgtccagaaaatctgctgagtcaccgagtatcaatcaagagaaaaataatgcagagctgcaaaatgctaatctccttcctcctgctctccttcctaacagcaagccgactcacagggtactcaaagcccagcggtgcctacctgctgttcttctccacttcgtagaggaaaagctcgctgctgccactgcaaaccctgatgtcaactctactctcacaagctggggaccctatccccagaaatttcacaggaccacacaccagctccacagcctccaccttctcctgctctgcaagccatccttgggtttttttctgcattgcttcaagactaatctaagataaaaatctactctcaaacatcgtagccattagggaactgcaaattaaaaccacaatcagataccaggcacatctataggaatggctaaaataaacattataacattgagtactggcaa

SEQ ID NO: 199278 - DNA, 438 bp, Homo sapiens
tttgtcccctcccccacagtgaggacatcagtgtatttacttgtttgcttcattttatgatacagaccttagaatttcagaattgccaaacccatgccctcccaaacaccaaaattaagtagaatttgacatttctttgtagttcttttatgtctttagactgaaagtatttattcaaaaagtattgtattcaaaagttgggtacatttcttttttcttcctgtgtagttattttaataagataaaatagaattcagtttatttgctttgtgtccaattttagtttttctcctacttctatttgattttactttatttcatgcataatatttaagttcccaaaagtcaaaacctctaaccctataaagaggtatactctgaatctcactccatcgcccaggctggagtgtggtggcacaatctcagctcactgcaagc

SEQ ID NO: 199279 - DNA, 225 bp, Homo sapiens
  misc_feature (111)..(111): n is a, c, g, or t
  misc_feature (211)..(211): n is a, c, g, or t
ccatgagaaaattcctggatatacacttctatctgcccagctaccaggggccgggaagagtcctgtggggcagcccttgggcctctcctggaaggaacagtttactttggngaggaggccagggctgggcggggacccccaagcactcagcctagggggaagtgattgtgtttatttatgtggcaggttggcagggcccaggcctgggggnatgggggaagttgg

SEQ ID NO: 199280 - DNA, 362 bp, Homo sapiens
atgctgccagctaacactagtaagtccttactatgtgccaggtacctcaatccaggcactatacacatcttaacttaatccttacaagaactgcttgaggcaggtccaattattttcctcattttacagatgaagaaaatgtggtcacttgagttgcctgaaggttacgcaatgattagatgctagggctagcatgtgaacctagtccatgacctttgaccactttgccattctacttctattaaaaggttccactttgataatagcagtaatacttagtatccattcaccctgacagtgaaacaagttccagtagaaaacatgttttcagataaaaataaaatgaactttccctaactgat

SEQ ID NO: 199281 - DNA, 684 bp, Homo sapiens
tacacaaaattagcctggtgtggtggcgtgcgcctgtactttcagctactgtggaggatgaggtggaaggatcacttgaccccaaaagattgaggctacaatgagcccagattgcgcccctacactccagcctgggtgacacagtgagacccttgtcaaaaaacccccaaccaacaagtacagtactagagactgtaaggagtaaaactactttggcagattttggggaattagagaaattaactcctaagattaacagtttaggatgtatgcttaaagtgttaaacagcagtatacaacttgatatcatatacctctaagatatttagtgaaaaagtttcatttaacagctgtaggactcaggttacagaatcacaataccttcttcaaatgttgagatagcaatatgatacatttactgaaatttaatagcatagacattcaggtaagctttaggaaggtatctatgtcaaagagcatttttaatactgagagtgcttactgtttactatgatgcctttttttctgttatgaaataatttgtgatctcaaaataattgaaaaaaggtatttatgtttgtttacattttgaaattgtgatggctacaaagctgttaattttattaaatggctttaatgttttctgtttacagatttttctggttacaataatgctagtaagaa

SEQ ID NO: 199282 - DNA, 558 bp, Homo sapiens
gtcgcagtgcaggctctcccgagggccaggacgccctgtctgagcagggctccaggaacaatgaggctggccccggccacacttatgcccagccaacctcagcaccgacagtggcctgccctgtgcctgcccctgcccatggctcctgcctgctctcctcatgggaactgctgcgcactcactgagcatctgcctccttgagaaaaaactttgttttcttcttaaaaacattgtggtcccggcgcagtggctcacgcttgtaatctccacactttggggggctgaggtgggcggacctcaagtgtgaggtcagaagttcgagaccagtttggccaacatggtgaaaccccatctctactaaaaatacagaaattagcccggcatggtggtgggggcctctaatcccagctactcaggaggctgaggcaggagaatcgcttgaacccaggagaaggaggttgccgtgagccaagatcacgccactgcactccagcctgggtgacaaagcaaggctcgaaaaaaaaaaaaaaagtagtaaaataaacgtaacatacaatg

SEQ ID NO: 199283 - DNA, 431 bp, Homo sapiens
gtacactggcgcaatctcggctcactgcaacctctgcctcctgggttcaagcaattctcctgcctcagcctcccaagtaactgggattacaggcgcctgccaccacacccagctaatttttgtatttttagtagaggtggggtttcagtgtgttggccagactagtcttgaattcctaacttcaagtgatccacccacctcggcctcccgaagtgctgggattacagacatcatccaccagcccaacaattcactcctgacccaatgattaaaaaaaaaaaacttgtaggccggttgtggtggctcacaatgtactacatttgtagacattttggtgccttaatgtgagcaagggttgcacaagttttgataggcatgtattccagagatgtatagaaattctagttactggctgggcacggtggctcatg

SEQ ID NO: 199284 - DNA, 374 bp, Homo sapiens
ttaatcacatagccacacaaccataccccttactcacattctccttatccattacaacagataatcaaaagagcagaaaggaaacagtgatatttactgagtgtctaccaggtcagctacaacacctctagagggaatatcctgaaggagaacctccctaatattgacccatcaattaagctctcttctcctcaagagaaacagtagtttttttttctacccccctttcctaattagtgagcttgagaaaaggaagtcagcataaatacttgaaccccttctgcgctttctctttttgcataggatacacacatactctgcttttccagaaaataaaggtctacaccctcagagtggatgcgaggagaatgagt

SEQ ID NO: 199285 - DNA, 251 bp, Homo sapiens
agatgattaatgtttttgctatatacttttatacattattttcttatcaaactagttaacaaatatttttatatgtttgtaagcagatacgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacatat

SEQ ID NO: 199286 - DNA, 348 bp, Homo sapiens
aacagacggccaggattactaaggacgagtcagctagttaaatgacagtacccttgaaaaacgtcgagcagaggtctaaaatgaatgtttttattttagtaatgagtttatgtcaagatttttatggtgtttgctggtgctatttgaatgagcttcttttttccagatgttgaatctgaagttgaatttagatatttctttttaaaacatctagtacagaacacaacacttcctcaactaagaagaagccactgggaaaaaagaactgctgcatgaagaagaaactactgagagggatggtaaaagatgtaaacagtctaaataatatgcaaactgaacagtctaagc

SEQ ID NO: 199287 - DNA, 454 bp, Homo sapiens
taatctttctgaaggaatacaaatatattctgaatcacacgcaaacccctcaatacagaatgtgtggtaggcagtattctaaaatgcccgcataccaccgaccccaccaaatttcctaccctaatacagaggctgtaaatatgatgaaatatcatggcaaggataatgccattaatatattatatggcaaaggaattctgcagatgtgattaaagccaccaatcaactgcctttgaattaatcaaaagggagatttgcctaatctaatcaaataacctctttgaaagcggagttttctccagctagtagcaaaagggaaattcatagcaagggaacatttcaatacactgttgctatctttgaagataaaaagagccacgaggaaaaaccaaagagtggcctctaggaactgagagtgacccaagccaataggcagtaagaaaatggtgagctc

SEQ ID NO: 199288 - DNA, 287 bp, Homo sapiens
taatctttctgaaggaatacaaatatattctgaatcacacgcaaacccctcaatacagaatgtgtggtaggcagtattctaaaatgcccgcataccaccgaccccaccaaatttcctaccctaatacagaggctgtaaatatgatgaaatatcatggcaaggataatgccattaatatattatatggcaaaggaattctgcagatgtgattaaagccaccaatcaactgcctttgaattaatcaaaagggagatttgattggtggcatcgataaacaccgggtaccg

SEQ ID NO: 199289 - DNA, 1073 bp, Homo sapiens
aagatatacagacaatggcattatggtggcctgtgaatctaataacttcatgaaaatacaaagaaaatgaagagagctttacatgtcttattctgtaaaaaacctatgtatttttttacctcacctacaaaaactcaaaatcttcatatttacagaatatcctgagctcctacatgcttgagtagtagaaatcccgtcctttttcaagttcctcctctgtgctgcgtcttcaggtcccatgaaggtctcacagatgaccaggtgttgcctccctctgcatctttgcatttgtgccccagcttgtcctgttgttctcaggtgaatttccacactgccactggcaacttttcttttggatctctgccaccagtacctttttcctcctcagaaagcagaaaaggccaggcatggtggtcatgcctataatcttagcactttgggaggttgaggcatgaggatcacttgagcccagggttttgagaccggcctgggcaacatagtgagaacccatctctaaaaagaaaaataaattagccagacatggtggtacgtgtatctgtagttctagctacatgggaggctgaggcaggaggatcacttgagcccaggaggttgaggctgcagtgagccatgatggtgccacagcactccagcctgggagacaaagtgagaacctgtctcaaaaacaaacacaaacacaaaacaaaaaacaaacacagaaaagggtcaagtgctcctagagaacagttcattcagggagatccactagagaacagctctttcagaggactaccctagagaacagctcatcaagaggaatgtctcaaattagtcttctaggtccctaatcactcagttctttcctttctacttcctggagaacacaaataccctaacatggcgctgggccaggtaaaagtacagtcttgaactgacacacaacccttactccctattgtatttttgccttgttttcagactgatccacattgtcagcctcttccctcaatgtgagtttatttcaggggcacctgtgtctcactacttcattacctcggttaactcaatgtcca

SEQ ID NO: 199290 - DNA, 787 bp, Homo sapiens
tctgccttggccccgcctcgcactttggaagagactggagcaggagcgggcagcgttgccttcgcagcatggtaacttctctcagcgctgtttgtaaagcagaatgggagaggaaactccccagagggaaactgggaccctgttaggtagggctagcaagaggtggttaaaacgtaagcatccgctgcaccagactgtattctccacgactgtatattttttgttgttcataagagccccgaattgcaatgagtacgattttccctggacgctgcagtgtatggagaagctgtcacttgtcacatgacagctcagtcattcgatccctgggtgctgcagagagggaagaattggcctcgcagtggggagtgagtgccagcccgtggcctgtcccctgccacgtgtcaccatactgaacgtttgtgtgtgctctgtgtgttttcaaaacaccttcatgtcacctgccccggactcctccctgtgagcaaggcagggtgggcgttaccatccctctggaccaacaaggacagaacagcttgagacgcacagggtggcttccccatggctgcggaggcatagaaagtgagggcacgggacgtgaatccgtgtgctgggattctggccgcctgtgcctgccgatcaccctcagtgcctccctggatttgattttgtggctcttctgggtgtgcgtgtgagtgtgttgtgggtaagtctgttgtctaggggaaggaacgggaaatcatccggccaggaatctctgtggggtggtcggcttgagttggccata

SEQ ID NO: 199291 - DNA, 473 bp, Homo sapiens
tgctgggattacaggcgtgagccactgagcccagcctagaattgtttttatggaaaatcttgtttccataattgagaactcactatgtgtatccatgtatataaagaagttttatttaaaaaaatatttggaacttatttattaactacatatgtgccaggcacctaaataaacagtttatgtgtatcttatcttttaaatattttaacagtgtaccctatgcagtaggtagtaataatatcctcaatttatgggttaggtaactgaggctgagaggttaggcaacttgcctaaggtcatataggctattatgcacttgacccaagagacaagggttttaattactatgtttaagtgtatcctttaacatcactgtaattttatctgtcacataaaataatcctgacttttaaaatattataattagaatattcatggagaataaagttccaattctgagaactggaaattta

SEQ ID NO: 199292 - DNA, 413 bp, Homo sapiens
cactgctgctgtgactgaatgtggatgtagaaaccccatggactctgcacatagatgatttatcaagattcatatgggattttgtcaggcagttggatataaagttagaaaatgtaaaaaatcaattatagttctatgtgccagcaataaccagaaaatgagattaaagacactatttacgatagtgtgaaaaaaaccaagtacctaagagtaactctaacaaaagatgtgcaaaacttctctgcactcgattctgaaaccttactgaaaatgttaaagtcaactaagtaaatccagaaatatgccaggttcctagattgcacgactcaatatggtaaaggtatcagttttcctcacattgatctgtatagtcaatgcaatcccaataaatatcacaacaggtgtgtgtatac

SEQ ID NO: 199293 - DNA, 526 bp, Homo sapiens
gggattaagttaaggatgttgagatgggaagactgccttcatttttcagatgtgctctaaatgcagtcacaagcatcctaataaaagagaggcagagggagacgtgacacacacggagggaaaggtgatatgaagatagaacacagagagatttgaaggttctgaccttgaaaattggactgatgtggccacaagccaggtaatgctggcagccactagacaccagaaaaggcaagaaaaagattctctcctagagccttggagggagcaccgccttgccaacgccttgatttcagcccagacattctgatgtcagacttctgaacctccagatctatgagaaaatatgttctgttattttaaggcactaaatttgtggtaattagttatgacagccaaaggaaactaattcagcaggttagcaacagccactgtagtcctactggcctctgctaaagtcttcaaaaggcctcagtgttacctccaagactttgcacttgctttttctctacctgtagcactcttt

SEQ ID NO: 199294 - DNA, 355 bp, Homo sapiens
ctcggtccctcttgtatatacatcttttcagaaatccagagaagtacctgtgacaaaggtcctttttctttgtcaaccttaggacctgagtcccgtgaactcagccagcattctcatgatatctctgtgacactttccagcccacaaaaacattctcactcacattctccttgcagtatccttaaaagagccctgggagggatgtattacaaaccccactttatagaaactctatttggctggtgaacgttgaattcaagctagaaattctccatgttttttattcttctgagcgtctggtgaaagcattgggttcgtttatcccagatgaagcacataaatgtatatacaagag

SEQ ID NO: 199295 - DNA, 829 bp, Homo sapiens
aggtggaggttgcagtgagctgagatcatgccattgcactccagcctgggcaacaagagcaaaactctgtctcgaaaaaaaaaaaaaaaagcaaggaggttgaatgaaataggttgatttcaatgctatattagtttcctcttgctgctataacaagttactatgaaaataatgacttgaaacagcacagattgatgctgctacagttcttgaggtcggaaatttgcaatgagctgatggaactaaaatgaagaaggggttgggtcaggagggctgggtcaggaggtctggtccttctgggggctcttgggagatccatgtccttgccttttccagcttccagaagctgcctcctcccttggctcatggctatgtcgcatctccctttctctctggcacccttcatcacgtgaccttttcctcctttgcttccttccttcccacttataaaggcttttgtgattacattctgggaccatacaagaatccaggattatctcccatcttgagatccttaacttaacaacatctgcaaagtcctttatttgggaaaaagtgaaatgggagtgttcccttatcccctttgcggggcatatgacaggggtgtggcttgcttcttcagtgccccactgctcaaacccctagggggatcatgcagatgggtaggttgcggggagcattttggggctccgaccccatggcggtctccaggattgagtgtttacagctcccgaagccccagtgggcatgtgttacagtgtgctctttcatctttgccatctgcagggagcttgtgttaatcagcttacttagaccctctgccttatca

SEQ ID NO: 199296 - DNA, 686 bp, Homo sapiens
tacagcagtccttcactggttggaggttaaaagctgttgaaaaataacccggatgcatttcatgaaagaatcttagacaaatacaattacttggaatatcagctaattgcttgctctataccatgattttcatgtcttacttcctccagcctgacttcctccatgtaccttcttggtctgagtgaaatctatggtaataaccaaatcgtagactaaaattaatcataatggtgagggctaaaaggaggggttaggaaaggacttgaccctggatggtattttcttatttttcttagtacatttaacatgtgtattagtccattttcacgctgctgataaagacatacctgaaactgggcaatttacaaaagaaagaggtttaatggacttacagttccacatggctggggaggcctcataatcatggcataaggcaaggaggagcaagtcacatcttatgtggaatggcagcgggcaaaaagagcttgtgcaggaaaacgccccctcttaataacaactacaacagcatgggaaaatcctgcctccatgattcaattacctcccatcggccccctcccacaacacctgggaattcaaaatgagatttggttggggacacagccaaaccatatcaacatgtaactttacaagttgattgtattgtagaccactaattgaaaatgcta

SEQ ID NO: 199297 - DNA, 588 bp, Homo sapiens
atacctaacgcacagtcaggtctccttaagcttgaacctgcatcgccatgacctctacatcacagggcagaaaggctcacagccagtgtctgagttcccagtgaaaagtggatcccagatcaggctgaacagcaggatccctaggggatacccagccctactgggtcagaatcaccagaggtagagcctgggtatgtatgtatgtgtatgtgtgtgtgtgtgtgtgtgtgtgtgtgtgtgtgtgcatgtatgtaggtatgtatgtataagagacagggtcttgctctgcagtccaggctggagtgcagtgtcacaatcatacttcactgcagcctcaaattactcctggcctcaagccatcctcccacctcagccttcagagtagctgagactacagacgcatgccaccaagccccggtacttttcttttttcttttttctttttggagagagtctcactctgttgcccaggctggagtgcaatggtgcattcttggctcactgcaacctctgtctcccgggttcaagtgattctcgtgcctcagcctcctgagtagctaggattacaggcatgtgccaccacaccag

SEQ ID NO: 199298 - DNA, 423 bp, Homo sapiens
gaaggtaaaaggcatgtctcacatagtgacagacaagagaagagagattgtgcaggaaaactctcccttataataaccatcagatcttgtgagacttactcactatcacgagaatagcacaggaaaaacctgcccccatgattcaattacctcccaccggtccctcccacaacacgtgggaattcaagatgaaatttgggtggggacacagccaaaccatatcagtccccttcttaaaactctcctctctagctcctatgactgtacatttgtagttctcccacctctctgaagaatcctctgtgagggtctctggggactttgttttgatttgttattgtttttatattcagtctttaacctatgtgaagccacctttgtaatactgccttaagtaaagatccagtattatttttctccata

SEQ ID NO: 199299 - DNA, 582 bp, Homo sapiens
cctttcaacatctcatttctgaaacttcaaaaagtgtaaactctgctcagtataaagtgtaaactctgctcagtatagttagattaagaaagcaatgtaacatgcatttagaacactttaaaaagtgatcactttgggaggccaaggcaggcagatcacttgagcctaggagttccagaccagcctgggtaacatggtgaaaccccatctcttctaaaattaccaaaattagccaggtatggtggcatatgcctgtggtcccagctactcaggagcctgaggtgggaagatcacttgagcctgagaggccaagattgtagtgagccaagatcacggcagtgcactccagcctggggaatagagcgagactcaagtctcaaaataaataaataaaaataaataaaataacaatagcttacacttattgagcacttaacatgtttgatcacagtaataaatactttaaataattataaaagctaacatttattgagtactcactatgtgcagagaattaccttttttaatcctcccaattctatgaaactatccacattttacagatgaggaaaccgagggtta

SEQ ID NO: 199300 - DNA, 637 bp, Homo sapiens
cctccataagaaattctgatttcatttgtctgaagtgaggcctgataatccacatcttaacatgcatcccaataatcactttcatttccccacatgaattctttttcttcaccaccatgaaaatacacaattgttcttaaaactgatataatacatttttgagcatttgtctatatttggtgagagagaatagatactaatgaaacaagattcctgctctcaaaaagctcccagacttggagttttctgaaatgtatgacgtaaatccaggctctgtagctatttatgctgtgtgagcctggacaggttgctcaatctctctgatccttggcaattaaactgcaaagggagaaagcaaatatttttcttcataaggttactagaagcattaaatgagataaagtgctcagtagaaagtaatgttgttcctattattcagtatttattatcaatttaatgtgcataacatacaattatatgcgatatatgcagtgcatgtacatatacatagttatgtatacataattgttgtgtgtatgtgtgtatacatacacacatacacattaaatatttgttactttcacacagagaaacatatgtgctggagtgacaagtagatttattccggaaaaaaaag

SEQ ID NO: 199301 - DNA, 507 bp, Homo sapiens
gccctcagcatgtcaccaacttctcactgttatattatatcattaatgctttggggatgagggcagggaaatgaaatgaaaagatcagggaattgagctggggtaacccagggctgcacagccccctttcccacatagtcgtgtacctgggccatgagcctctgtaatggaaactagctgtcctgaatcttccagccaggagcccagagaaatcacccgtggggccccttatcttcatttctcaagctccttaagggtggatccaaaattcaacaggaatgtttgaacagctatgctgtcactttgcctgcatgaccagcccccattaaaggagaaaccagaatgtcagtaataaaccaaactgcctttcttttaaattactgtagttaagcaactaaactactccaggagagaaaaaaaggggtaaagaagttgatttgtaccactgagaacactcccgggaacttaataaatattgtaattttctaaataatacttgatgataga

SEQ ID NO: 199302 - DNA, 1807 bp, Homo sapiens
agcatcatagatgctcctacactaagctggccctgcttcctatgttaaatatgacacatctgaggccctgggagaggaagtgatttgcccagtctcacacaatgagttagagccagagtgaagtcaaaacccagtctctggatgtacaagcaaggtctttttctagtcccaaatggccttttgtggtggtccagggactgccgggagcagtcgtggaactgcatcatttacagaaggtctgatctttgagtcagagtcacagaagaattgagaatagctgttgggccttgggctgctggactgagatgacatgtggacatcaggatgacaaggcttctgaagcagaggctgggggaaccagaactgctggaccagcacctgggggggggttctggtttcaaacagccctcttagtacagagtctggaggccacctctgaccagctaggtcaccttacactgttccctacagtaggggataatgtaacctttgggttttcccttttgggggaaacttaggaaaccttaggaaccttatgcgaggactcaacctgaggctggaatagctgggaaaacagaactttaggtggaggaagtggcataaaaaagttgaaaagtctggctgggcatgatagctcacacctgtaatcccagcactttgggaggctgaggtgggcagatcacctgaggtcaggagttcgagaccagcctggccaacatagcaaaaccccatctctactaaaaatataaaaaaattagcaggcatagtggcaggtacctgtagtcccagctactcaggaagctgaggcaggagaatcccttgaacccgggaggcggaggttgcagtgaaccgagatcacaccactgcactccagcctgggcaacagagggagactccgactcaaaaaaaaaaaaaaaaaaaaaaaagttgaaaagtgcagaggaatttgagaaaggtatgacctgaaaaggacacagagggaagggaaggaaggggagaacagagagggttataagcaggccagagccggattgtgaagtgcctgtatgcaaggtaggcatttggattctgctctggggagctattgaagtattttgacagagattgtgccactgtactccagcccaggcgatggagtgagactgtctcaaaaaaacaaaacaaaaaaataaactagctgaggtctaccagttgcctgggactgaggtagtggaagagttggggtggagtaggccaagaaaatttttcgttttttcgcttttttgaaaagaatttcagaattacaaaaatattaaagaaatagtacagagttcttctatattctatccagcttccccttcttgcataaccatagtacaattatcaaaaccaggacattcacactgatacaaattacttacttattcaaatttttgattattcaaaattcaaaagtagatttaaatttcaccaattgtcccactaatgctgagtgggttctcaacaactgctgtgatgagccctggttcaagctgttctttcttggtctgtctgtgaagtcctatgatgctcccttacgataggtcttgtttttggtgtttttttttagaaagagtatcactctgtcaccaaggctggactgcagtggcgcaatcttggctcactgcaagctccgcgtcctgggttcacgccattcttctgcctcagcctcccagctactcaggaagctgaggcaggagaatcccttgaacccgggaggcggaggttgcagtgaaccgagatcacaccactgcactccagcctgggcaacagagggagactccgactc

SEQ ID NO: 199303 - DNA, 756 bp, Homo sapiens
tgcgacaggagaattacttgaaccggggaggtgaaggttgcagtgagcagagattgtgccactgtactccagcccaggcgatggagtgagactgtctcaaaaaaacaaaacaaaaaaataaactagctgaggtctaccagttgcctgggactgaggtagtggaagagttggggtggagtaggccaagaaaatttttcgttttttcgcttttttgaaaagaatttcagaattacaaaaatattaaagaaatagtacagagttcttctatattctatccagcttccccttcttgcataaccatagtacaattatcaaaaccaggacattcacactgatacaaattacttacttattcaaatttttgattattcaaaattcaaaagtagatttaaatttcaccaattgtcccactaatgctgagtgggttctcaacaactgctgtgatgagccctggttcaagctgttctttcttggtctgtctgtgaagtcctatgatgctcccttacgataggtcttgtttttggtgtttttttttagaaagagtatcactctgtcaccaaggctggactgcagtggcgcaatcttggctcactgcaagctccgcgtcctgggttcacgccattcttctgcctcagcctcccagctactcaggaagctgaggcaggagaatcccttgaacccgggaggcggaggttgcagtgaaccgagatcacaccactgcactccagcctgggcaacagagggagactccgactc

SEQ ID NO: 199304 - DNA, 383 bp, Homo sapiens
tgatccgcccgcctcggactcccaaagtgctgggattacaggtgtgagccaccgtgcccggccagtacgtggatgttttcatgtgttcattctggtgtgtgtgtgcagacttgtgggccatgttgcatacacgtgaacatgtgatattttcctgtgctcatctgtgtttggattaaaacagtcctatcccagctccatttatctgcttgaaaaaacccccagaactgcaggaagctttttatgagcataatcttaattgaactcctgattgcaagactgaggttagctttatcatctccattttgcaaatgagttagataagttcccccaaagccggtcataagtgacttgcttctgcatttcacagctaatgagtgtagagt

SEQ ID NO: 199305 - DNA, 444 bp, Homo sapiens
cagcctgggcaacagagtgagactccatctcaaaaaaagaaaaagaaaaaggataaatacattctaaccaaataatgtttatctcatgattgtagctgattcaacattcaaaaattggcctggtgcagtagctcaggcctgtaatcccaacattttaggaggctgaggcaggaagatctcttgagcccaggatttcaagaccagcctgggcaacatagtcagactggtctttactggggggaaaaaaatcagtctgtgtaattcaccacattaacaaagggaaacataaaaaccctatgatcatttcaacagatgtagcaaaagcagttaatgatattcaacacatatgcatgattacaaaccaaccaacctcctagcaaactagggaaaggaaacttaacctagtttgataacagggcgtccacagtcggagttccactagca

SEQ ID NO: 199306 - DNA, 393 bp, Homo sapiens
ttgtttgtttgtttgttttaacaagttgaaagtttgtggcaactccgcactggggaaatgctcacttaatgttactgtgtcacattttggtaattctcccaatattttcaactttttcattatgattatacctgttttggtgatctgtgatcaatgatctttgatgttactattgtaactgttttgggggttccacgaactatgcccatataagacgatgaacttaataaatgttgcgtgtgttctgactgttccaccaacaactgattaccccatctctctcccattccttggggctccctattccctgaatcacaacaatattgaaattacgtcaattaataatcttaccatggtctcaaatgaaaggaagacttgcatgtctctcactct

SEQ ID NO: 199307 - DNA, 205 bp, Homo sapiens
ttaattcaagaaagggaagttaagtaatcagtgagtgtggttgtgttacatcgtattacatgtttattgtataaggattttacttgtattggtatttctagttttatagaaaaaagtgtgtgtgtgtggtgtgtgtctgtgtgtctgtgtctgtgtgtgtgtgtttaatagagatggggtctcactatgttgcccaagctggtct

SEQ ID NO: 199308 - DNA, 436 bp, Homo sapiens
tctgccccttctttcgtaacaccgttcttccctagtgaagtccacacacatccttacatggcagctgtgggtatatcaactggtctgaccccttttagtcacagagcctgaagtctgctagtacctgctgagcacagtgtcatgggtgagaatgggcaaggctttttctttctctggttcctgaacttcccaggctctctcacttctggatcctgaatacccaaatcccaagcttccttcccagaaccaacacctcctcctcattagaaagatacctttgttctgtgcttactttataaagtcttgctctttccctgtccactgccttgtgtcactatgtgtgtgtcttggggccggtggaaaggtgaacagaagccagtagagagtaacaagcaccagcttcacaggaatggcatgaccttaatacgatagtggc

SEQ ID NO: 199309 - DNA, 502 bp, Homo sapiens
aaagaaaaaaggaaagaaagttagtttataaaatagaaccaagtagaaattttagagttgcaaagtacaaaaatgcaaatgaaagatttacttgagaagtttaaaaaatgtgtgaactggtaaaagaagtaatcagcaaattagaagtcatttgagattatccagtctgtggaacagaaaaaaaaaatcagcaaagaaaaatgatcagtgcttcagacacccgtcagacaccatcaaacataccaacatacacataataggagtcctagaatagataagtgagagagagggaaggggataaaacatatactggaagaaatagtggccaaaacctttcccactttgaggaaaaacattaaagtgaatccaagaagctcaacaaattctaagcaggaaagactcaaagagtccacctcaagacacaccagccactaagtaaataattttaaatatatagtaaaaaatgacaaggaaacagaaatgttacactagaaaatatata

SEQ ID NO: 199310 - DNA, 106 bp, Homo sapiens
actagagattggttgcattttctagaattttatataaatggaataacaacagtgtatactcttgtgtatgttttccagcataaatgattttgaaatgcatcacata

SEQ ID NO: 199311 - DNA, 406 bp, Homo sapiens
atttgtctttctgtgcttggcttatttcacttaacataatgacctccaattccatccatgttgctgcaaataacaggatttcattgtttttttatggctgaataatattccattgtgtatatacaccacattttctttatccattcatctgttgatgagcacctaggttgattccatagtttggctattgggaatcatgctgcaataaacatggagtgcaggtgtcttttcaatatattgatttcctttttttttttttcatatatacccagtagtggaattaccgaatcatatggtagtcctatttttagttttgtgaggaacttctatccttgaaccatgcactgtaaatgggcaaattgtatgacatgtaaattttgtctcaataaagctgttagaagatgca

SEQ ID NO: 199312 - DNA, 283 bp, Homo sapiens
ttgtccaaaatcagtgctcaacagagaataaagacaacattaataccctggcagaatcaaatgcttaaatgccctagtccaaaaattatcagatgagggagggatggataaagccaacaagcaaaggccagaggaaaggctcagatgttttcttgccttctataaaaggatgcattttgaccaccaaaacaaaatattagcaaggaaatgagagaccgttcttcaaaataatctacaataaaacacatgaacatataaacagcaggcttttgcacttgaagaa

SEQ ID NO: 199313 - DNA, 1221 bp, Homo sapiens
gctcaaactcccaaagtgcagggattacaggtctatatctatcatttatttatctaatctctctctctctatccatcctccctctctctctacctatctacctactttgatagacaggttcttgctatgttgtccaggccagtctcaaactcctggctttatgtgatcctctcacctcagcctcccgagtagttgggatcgcagttgtgagtcactgaacctgacctttttgttttattagttaggtaaactatgtaatttttgcttaaaggccaatcctctcaatattaggaaaaatacaatgttaatgaaagcaagatcacttaaatacataaggtttactcttttataacactgtattatgaaaaaactgtagaaaaatggaatttgaattttaaaatttgtagtaatgagttatcacaaaccccaatatttagttttctctgaatttaccaattatgtagagctgagtgattttttcctgttttttaaaaggtcatgatgattatgtgaatgttacagactaatcaattatgacaggagttttggtttttgttttctttagacaattctgtcactgttttcatataaagcctgaaataagctaatctatgtgtcttccattattttgctttgtataaatggaagaaaatcgttatagctgtcttgacttttaaaaatagcaatttttattttcacaagaatataaatattctgaaagactcctgtacacattagaatctttcgtggtataaacggaaaaggtaaatatgcttaaaattatgatttaagaataaattccactgataaacagagataatgaatttaaggaggctgtacattttttttctccaattatgatgcaatgataggttttacaggattgtaagacagatgattcataatatgaaatcttgtatcaaaccaaagaaaaagcaatatagaaatggcactaacctaatttcttatcacatacaaatggtatggcaaaatgttcatgttttacagtttttcgctatgtggcactagattaccgagagtgaaaagggaagaattatggggaagctgtgacatgtactataataacattcctatgctaaaagcgacagattttagaaaactgccaaaggttttattttaaatggcattattaataatgcatattcaaagaaacaccagatataattgtgaccaatacataatatttcaagaccctgactt

SEQ ID NO: 199314 - DNA, 406 bp, Homo sapiens
taaataagtgtttactaataagagaatgattaagtaaattatggcacatagttattagtatggcctatagtttcaaaagagtgtgacagtatttcttgataaaaattttgaatgaaaatagaataagtagaaaaatataaagtgtaattgtctgatcccattgctctttgtaaatatgtgtatatatatgtttgctttatcacgtatatgtgtatttgtaacttgtcagtgtgtttctacgtgttttgtgtttgcatatgaatgcctagaggtagagggatttcttttgagagttgaattgggctgttgataaagaagaggcatttactcttatctatgtgtttgcatttttcccccaagagtgtgtattactttgtaatttaaaaaataaacatcctcaaattta

SEQ ID NO: 199315 - DNA, 235 bp, Homo sapiens
tcagtcatcttggccagcttttcctctcatgctcaaactttagaatgtcagagttacccagggatcagtcctaggccatctactgttttttccctaatcaaccttggaaccactttggaatcacctgaggaatttctttataaaagtattccaaccaatacatgaagaaagtgatagaatatcagtattttgtaaccactaatgaaataaaggttctagacagtgaacatcgatg

SEQ ID NO: 199316 - DNA, 301 bp, Homo sapiens
ttctgaaagacaagggtcatgtctgagttttttctgcatcccccattcttaagacagtacagtgcacagtaggcactcagcacagggagatggggataaaggttgaggggctaagggtgaacagagggtagatggactgatcgatggattaagggctacatggatgaatggatgcatcagtgggcaaagaaatgaagtggacaaagagaggaatggatgaatggatgggtggatgagtgggtagatggatgcgtgagtgtgggtgagtgggtggatggatggatggatggatagatgagta

SEQ ID NO: 199317 - DNA, 467 bp, Homo sapiens
aatttcggattatctccagttaaggatggcgtttgatcctcacaacttgaaggtaattactttcaggggatgtatgttgctcctttccccctgcagaggtagagtgagaaatgctgcttttcaaagacgggtgcttcttaaagaaattgggctcccatcccctttaggtttgaggtccctgagtcttttgagcagttggggtttttaggccacaggtccctgtggaagcttcccaatggccctgcatcctcctgatccctatggggaggcatttcatccattgaccctgcaggtagctgattgagtctgaaatagcagcctcccagcccagcagggaccagagtaaaggaacatttgctgtaatttctttcctcctccctctctgaaagattgttaatcaggaaccttttggaaacaaaaaataaaaggaaagcaagaaaaaagagacctagtttggtgaacccagt

SEQ ID NO: 199318 - DNA, 721 bp, Homo sapiens
acgatgtgttcggtattctccatggtgaaagctttgtctgaaggcattcccagattcattgagggcacgaaacgttgccaatgctggttgacatgctagtaggaaaacaatatgagaaaaaaaatcagaactggacactgcaacatacatcaagttaattaggaaagcgagggaaagaagagtgcagtgactggagactttagaggggtaggatgagaagtaggagtttgtggaggtggagaggcagagaattgtttctccacgtacaagaatgatttaagtgatcaacagtggccattgaatttttttctatttctttaaacttgaaataattatacttgtgattgtaaaaatggctgaatgaaattttaataaccaaaacagaaaagcttaaagaacctaaaaagaatcacgtgaaatcctaagcatggattaaagttttgtttccattaaggccctttaaaatatttctgtgtggtatagcaatttgtgaaagtgattacactttaaatattttcctttgaacatcagaattggggatacttatgagtaaatacacatctgtcttatcaatttgatattgaatgttttactgtgcgacagggtcattattgattgggccgatgctctatttggatatttgagttgtacttatttttgttgttgctaagaacattaagaacaatcttaaatctacatctttgttaatttgaaatatatt

SEQ ID NO: 199319 - DNA, 334 bp, Homo sapiens
gctgtgggggcgctgtcctggacagtgtcagatgtttagcggtgtccctggcttctactcactaagaggctgtgacaaagaaaattgcctccagagattgccagatattcccaagggacaaaatcactcttggactgagaatcactggtttcaactaaatatcaggaaaagcaaaatgttcactgggtaaagatcgccgtcccctgtaaagagcatatagcatttttggcaaatgttgacaaacccaaataacctgccttggcaaaagaatcgtgcctggggtgaaataatatcttattatattttagatttgcatttatccagtgatcactga

SEQ ID NO: 199320 - DNA, 286 bp, Homo sapiens
tagatagatgggactacagatgtgtgctgccatgcccagctaatttttaagatttatctcagagacagggtcttgctatgttgcccaggctaactagtacttttctgaaaggcacagaaaggtcagcaggtataaggacaccaccagaacaagggtttggagtcctgcactggaaatccactctaatgaatgattctatcaaagatttcatgaaaaataatccagtatctatgttgtcctgaaattttcaacaaggaccactgtggagacccatacctacacacat

SEQ ID NO: 199321 - DNA, 450 bp, Homo sapiens
gatgccaaaaatgctttcccaagtggctaacattctgtattcccaccagcaatatatgagagattaagttgcttttcaaacccatttatgctcagtattgtcaggttttgttttgttctgggttctttatttgttggttttcttttttatttcagccatgctaataggtgtgattgtggttttaatttgcaattccctaacttcataaattagggaacacagaacacacatagacacagaaaatgcatttgactgattttacttcctactattaagaaacagataaaattcatatgtccctgaacaccttttttgttgcttatttgtcatacatttatcttttttagtgaaatgtctcttcagatatttttttccattttaaatcaggttgttgacctatacattgttgttttgagagttctatatgtatcctgtattcaaatcttcatt

SEQ ID NO: 199322 - DNA, 653 bp, Homo sapiens
ttagccaggcatgatgtcaagcacctgtaatcccagctacttgggaggctgaggcaggagaattacttgaacccgggaggcggaggttgcagtgagccgagatcacgccattgcactccagcctgggtgacaagagtgaaacttcatctcaaataaataagtaagtaagtaagttatttccctttttctgtatttccaagttgtactttatagatttgttactgtctgagcctccagattcagttcaacaagtatttatgggatcctagggatagaaaaatgacaaagacacaggatcttccctcaagttgtccatagtctaagaaagaaagattttataaacaaacacaatacagtatatgtgcattaatagaattctgcacaaggtagagatgtagtacaaaaaagagagtagttcacatcaaaagatagggaaaatggattggtggtgcagttgagagggaagatgtatttgtatatgagttttccagacagataagaaggggttgggaatctcaggtagagaacatattcaaaagcagaggcatgaaatagggtgatgtcttctaggaacagtttgttattacttcaatgtaacatacaggctagggattagagagatgaaatcagagaggtagccagtggccaggtga

SEQ ID NO: 199323 - DNA, 420 bp, Homo sapiens
gggtggaaggcaacagctacgagcagaacgaacaaagcctgccgaacaacctgcgcgatgcattgcgtgagttggacgacagcgaggtgatggccaagtacatcgatcctaagtacatcgatatcttcgtcgcctgttaggaaagtgagctggaagagtttgaacactccatctccgaccttgagtacaactggtacttgcataccgtgtaagcagttgcagttttaaaagaatgctgatatgccattcttgctgcagcaagcatggcattcaaggttttctaaattctgccccggttaacttttccattcgttggtttcattctagtctagcttttccttctgggccgcccctccccacattagaccgctcctctctggaattccaactcaagcccttgcttttctccatctgtcatga

SEQ ID NO: 199324 - DNA, 595 bp, Homo sapiens
ttcctgctctagccatctcgtacctcgtgcgcatttaggtacaggctaaaacctttgaaaagatcattttcctatttgaaataacatttcacatggattagagaaatgctaaaggaaaaatgtgttattttcacacctccatttgtaattattaacacacataccacccttcccttttgcttcctgctgctcttctgatccttgggtaatcatcataacctcaggagtgattatcttgcctgtcccttcattctgacttctttggtaggaggacctgttccagacccctggaatgcaggaagagctccagcagatcattgattgtctggataccagcattcctgagacaatccgtatcctttgcgaccaaagcttaagaagctggatgagtacttgatcaaactcttcttcgcacctatatttgatttttgtggttctatatttattttctttgtaatatcttttattataagataaccactgactatccacttgtttctcatttcctttcaggaacttttgacctctttccatatccagctcttactaaaaggaagcaaggggtagataacaatgacctaaagcatgggacata

SEQ ID NO: 199325 - DNA, 575 bp, Homo sapiens
ttcctgctctagccatctcgtacctcgtgcgcatttaggtacaggctaaaacctttgaaaagatcattttcctatttgaaataacatttcacatggattagagaaatgctaaaggaaaaatgtgttattttcacacctccatttgtaattattaacacacataccacccttcccttttgcttcctgctgctcttctgatccttgggtaatcatcataacctcaggagtgattatcttgcctgtcccttcattctgacttctttggtaggaggacctgttccagacccctggaatgcaggaagagctccagcagatcattgattgtctggataccagcattcctgagacaatccgtatccctgcgtacaccatgccttgaaagtagctggatagagcaggctagcaacaaaatcacactcgcaccaatattggatttttgtgagtcacgagttatcttcatagtgatatcggtcttgattatagagatacaccgactgcatagactcactttcgctgctctcagctcctctcaggaactggacgaccttcatctatctcagagaccagcctcctta

SEQ ID NO: 199326 - DNA, 5213 bp, Homo sapiens
tcagcctgaacatggatgaagttttttgtttttaagagcttccttagtgattgttataggagcctcctagacaattctcagctcccagctccccgctcccggctcccggcgcccggcgcccggcgcggagctgttcctcaaacgacacgcagccgaggtgggtgggtgtggggacgcgggagccagtgtcgtcggatcggcccgcagtccgctgtcctgctgagcccggaggccgcctggatggagccgccgctcccggtcggagcccagccgcttgccactgtcgagggtatggagatgaagggtcctctccgggagccctgcgccctgaccctagcccagaggaacgggcaatatgagttaataatccagttgcatgagaaggaacagcatgttcaagatatcattcctataaatagccacttcagatgtgttcaagaagcagaagaaactcttttgattgacatagcttctaacagtggctgcaaaattcgggttcagggggactggatcagagagcgccgctttgaaatccctgatgaggaacactgtttgaagttcctctcagctgtccttgctgctcagaaagctcagtcacagcttcttgttccagagcaaaaggactcatctagctggtaccagaaattagacactaaggacaaaccttctgttttttcagggcttcttggatttgaagacaatttttcttctatgaatttggacaagaaaataaattcacaaaatcagcctactgggattcatcgggaacccccacctccacccttttcagtgaataaaatgcttccacgtgaaaaagaagcttctaacaaggagcagcccaaagtgaccaacaccatgcggaagctctttgtaccaaatacccaatctgggcagcgggagggtctcatcaaacatatcctggcaaagcgagagaaagaatatgtcaacattcagactttcagattttttgttggaacttggaatgtgaatggccagtctccagatagcgggttagaaccttggctgaactgtgatcccaatcctcctgatatctactgcattggattccaagaactggacttgagcacagaagccttcttctactttgaatctgtgaaggaacaagaatggtccatggctgtagagagaggtttgcattccaaagccaagtataagaaagttcaactggtgcgccttgttgggatgatgcttcttatatttgccagaaaggatcagtgtcgatacattcgtgatattgctacagaaacagttggaactggaatcatggggaaaatgggaaacaaaggtggggtagctgtgagatttgtatttcacaacaccaccttttgcattgtcaattcccatctggctgcacacgtggaggactttgagagaaggaatcaagattataaggacatttgtgcgagaatgagttttgtggtcccaaatcagaccctcccgcagttgaacatcatgaaacatgaggttgtcatttggttgggagatttgaattatagactttgcatgcctgatgccaatgaggtgaaaagtcttattaataagaaagaccttcagagactcttgaaattcgaccagctaaatattcagcgcacacagaaaaaagcttttgttgacttcaatgaaggggaaatcaagttcatccccacttataagtatgactctaaaacagaccggtgggattccagtgggaaatgccgggttccagcctggtgtgaccgaattctttggagaggaacaaatgttaatcagcttaattatcggagtcacatggaactgaaaaccagcgaccacaagcctgttagcgccctcttccatattggggtgaaggttgtggatgaacgaaggtaccggaaagtctttgaagatagtgtacgcatcatggacagaatggaaaatgacttccttccttccttagaactcagcaggagggagtttgtgtttgaaaatgtgaagtttcggcaactacaaaaggagaagttccagatcagcaacaatggacaggttccctgccatttttctttcatccctaaacttaatgacagccagtactgcaagccatggcttcgggctgaaccttttgagggctacttggagccaaatgagacagtggacatttctcttgatgtgtatgtcagcaaagactctgtaaccatcctgaactcgggagaagataagattgaagatattctcgtccttcacctggatcgaggcaaagattacttcttgactatcagtggaaattacctcccaagttgttttggcacatccttagaggctctgtgccgtatgaaaagaccaatccgagaagttcctgttaccaaactcatagacttggagaaatcccttctgcaaatggttcctttggatgaaggtgccagtgagagaccccttcaggttcccaaggagatctggcttctagtagatcacctattcaaatacgcctgtcaccaggaggacctgttccagacccctggaatgcaggaagagctccagcagatcattgattgtctggataccagcattcctgagacaatccctggcagcaaccactctgtggctgaagcactgctcattttcttggaagccctgccagagccagtcatctgttacgagctgtatcagcgatgtcttgactctgcttatgatccccggatctgccgacaggtgatctcccagcttccgagatgccatagaaatgttttccgttacttgatggcattccttcgagaactcttaaaattctctgaatacaatagcgtcaatgccaacatgatcgctactctcttcactagtcttctcctgaggcctccacccaaccttatggcaagacagactccaagtgaccgccagcgtgctattcagttccttctgggctttctgcttgggagcgaagaagactaaggcttttactgttctctgatattctagaagcagacgatctcgggctccaagtatttcagaatgatttaaaaagtcatgccacaggaagggtctattgcagaatttcaagttctgtttatagtaaaaaggaagagcgtttcctaatccctcctttaccatatcctacacagaaaaatacttttagacttatattgccaagccaaagttaccatattttggtgtttttgtgttttctctttataaggcaaaaagatctgtatttacactccttcacctaaggatgtgtttgttgccctcctacccaattgtcatgattgtccttagtaccctaggcctagattctgagatcttcccattctaggcctacaagcactacttgctgtagctgagacttgtctagagtcctttgttttgcacttttgacccaccccttcctggatcactcctttgcactccactcccctcgttctgtcactttgaacgaagtctgagtgaggctagtgactccttgggtgtcctcaacagtgaattcactgtctgcgtgcagttattacatgcatttgtgcatttctactacaatggcatctttatgtctctgtaacattggccttttcatggctccacactgggtggaaccatattctcttagatcacatttagtagcataactgtagggactattagagatggcatctcatcgatgagagagaatcacaatcagaatggaagcactttgagtatctgaagagtgagagcattcatgtttgacaggtcctgcttcccactatccttttcctgttattattcaaattttacacaaggactaatcctgggtgtctctgagacccatctcctgcctagacatccacctccagagcaacactggccccacagtaaaagaggaagtcttgtacctcaggcaggcccatctagagctattgctccttcccacagcaaaggtattgtggatgacccttagaatccattctctggtcttctgaaataccaagggcagatgtcacctccttcctcagcaggactgactctgggctctacaaccagctccttcacataaagggtttagagactccccttggctcccagtcaccatatccagtgttgtgtaaagagactggccaacaggaccaaccaagcaccttacctctcccatacaagatgaccctctgagcttttcatttattcaagctctgtggtacagcctttttttaaaataaattaatctatattggttgacaaacaagccaccaaccactgactgcaaaactgcctgatgcagttgggttcctcctggttttcttttgttacaaccacccttgcctgtttacattaattgcaaggagcataacgtacaggctgtatgtacaatcctgggcattgactctgtgacatttctagcatatccaaggcaccaccagtgatttctcctgtttcttggtgggggtgggggggaaggtacgtattctgcaatatggctaaaccctttcctgattgagagttaaagcaataggagtcaagttactggtgccacagatctggaggtatgataggtcaggggctaggtgttgaacttagttaatggaagactgagagcagaacaggtttgtcatctccgcaaggccagaaagtgatcacaaaaagaggcagatgatagacactggggtagggtcataccacagggaaatacctttcctgggcttgttttctagcatatcactgacctgggatctttgggtgatcaagggtgtggttagtggaggctctgtgctgcacgtatgcagtatcctatctctttctacatcagatcaaaacactaagttggtgtactgcctcgaccttttttcagctcatcctggaacatatacagagttgagagttttagacaatctctaggtagaggagacaagatgtagacccagacagaagaaatctgcttccctaccatggctattccagcaccccaacctgtaattgccaagtcctctaaggtactaatttgtagctgctctgaagtaaggatttcggattcagctggtagggaaagactctgcacctgctgtcttagggaagaaatggttcaaatccatgtggtgacattgcattagtctccctttcactgttttcttattctgtaattgtttgttatatttcccaaaaacgtcttgatcactaagcaaagctgctagtgggattctatatttcgtgtcatcttttttattataatttattgcaaatttttttctgaataaatatatgttgtgtgaaaaagcaaa

SEQ ID NO: 199327 - DNA, 5243 bp, Homo sapiens
aggtgaactggaggggacgcagaggaggagcaaaggtctgggctttggggaattctccgatttagggcgtggaagaaagaagaggaaaggaaatggttaataatccagttgcatgagaaggaacagcatgttcaagatatcattcctataaatagccacttcagatgtgttcaagaagcagaagaaactcttttgattgacatagcttctaacaaaaggagaaggcaaaaacaacacttaaaaaagcaaaactagaacaaaagcaattccataacaactgacactgctgctgaaataagagatggaaatgtcctgtatttgatgtggagaagtatttgattcaaagctgaaaagttaaactgagctgtgccttttctcttataagcacctaattttcggcattagttttgttgtggccgcttctacattagccatgtgttgctatgtccagagttctagttactggctcatagggggaaaataggtggctgcaaaattcgggttcagggggactggatcagagagcgccgctttgaaatccctgatgaggaacactgtttgaagttcctctcagctgtccttgctgctcagaaagctcagtcacagcttcttgttccagagcaaaaggactcatctagctggtaccagaaattagacactaaggacaaaccttctgttttttcagggcttcttggatttgaagacaatttttcttctatgaatttggacaagaaaataaattcacaaaatcagcctactgggattcatcgggaacccccacctccacccttttcagtgaataaaatgcttccacgtgaaaaagaagcttctaacaaggagcagcccaaagtgaccaacaccatgcggaagctctttgtaccaaatacccaatctgggcagcgggagggtctcatcaaacatatcctggcaaagcgagagaaagaatatgtcaacattcagactttcagattttttgttggaacttggaatgtgaatggccagtctccagatagcgggttagaaccttggctgaactgtgatcccaatcctcctgatatctactgcattggattccaagaactggacttgagcacagaagccttcttctactttgaatctgtgaaggaacaagaatggtccatggctgtagagagaggtttgcattccaaagccaagtataagaaagttcaactggtgcgccttgttgggatgatgcttcttatatttgccagaaaggatcagtgtcgatacattcgtgatattgctacagaaacagttggaactggaatcatggggaaaatgggaaacaaaggtggggtagctgtgagatttgtatttcacaacaccaccttttgcattgtcaattcccatctggctgcacacgtggaggactttgagagaaggaatcaagattataaggacatttgtgcgagaatgagttttgtggtcccaaatcagaccctcccgcagttgaacatcatgaaacatgaggttgtcatttggttgggagatttgaattatagactttgcatgcctgatgccaatgaggtgaaaagtcttattaataagaaagaccttcagagactcttgaaattcgaccagctaaatattcagcgcacacagaaaaaagcttttgttgacttcaatgaaggggaaatcaagttcatccccacttataagtatgactctaaaacagaccggtgggattccagtgggaaatgccgggttccagcctggtgtgaccgaattctttggagaggaacaaatgttaatcagcttaattatcggagtcacatggaactgaaaaccagcgaccacaagcctgttagcgccctcttccatattggggtgaaggttgtggatgaacgaaggtaccggaaagtctttgaagatagtgtacgcatcatggacagaatggaaaatgacttccttccttccttagaactcagcaggagggagtttgtgtttgaaaatgtgaagtttcggcaactacaaaaggagaagttccagatcagcaacaatggacaggttccctgccatttttctttcatccctaaacttaatgacagccagtactgcaagccatggcttcgggctgaaccttttgagggctacttggagccaaatgagacagtggacatttctcttgatgtgtatgtcagcaaagactctgtaaccatcctgaactcgggagaagataagattgaagatattctcgtccttcacctggatcgaggcaaagattacttcttgactatcagtggaaattacctcccaagttgttttggcacatccttagaggctctgtgccgtatgaaaagaccaatccgagaagttcctgttaccaaactcatagacttggaagaagacagcttcctagaaaaggagaaatcccttctgcaaatggttcctttggatgaaggtgccagtgagagaccccttcaggttcccaaggagatctggcttctagtagatcacctattcaaatacgcctgtcaccaggaggacctgttccagacccctggaatgcaggaagagctccagcagatcattgattgtctggataccagcattcctgagacaatccctggcagcaaccactctgtggctgaagcactgctcattttcttggaagccctgccagagccagtcatctgttacgagctgtatcagcgatgtcttgactctgcttatgatccccggatctgccgacaggtgatctcccagcttccgagatgccatagaaatgttttccgttacttgatggcattccttcgagaactcttaaaattctctgaatacaatagcgtcaatgccaacatgatcgctactctcttcactagtcttctcctgaggcctccacccaaccttatggcaagacagactccaagtgaccgccagcgtgctattcagttccttctgggctttctgcttgggagcgaagaagactaaggcttttactgttctctgatattctagaagcagacgatctcgggctccaagtatttcagaatgatttaaaaagtcatgccacaggaagggtctattgcagaatttcaagttctgtttatagtaaaaaggaagagcgtttcctaatccctcctttaccatatcctacacagaaaaatacttttagacttatattgccaagccaaagttaccatattttggtgtttttgtgttttctctttataaggcaaaaagatctgtatttacactccttcacctaaggatgtgtttgttgccctcctacccaattgtcatgattgtccttagtaccctaggcctagattctgagatcttcccattctaggcctacaagcactacttgctgtagctgagacttgtctagagtcctttgttttgcacttttgacccaccccttcctggatcactcctttgcactccactcccctcgttctgtcactttgaacgaagtctgagtgaggctagtgactccttgggtgtcctcaacagtgaattcactgtctgcgtgcagttattacatgcatttgtgcatttctactacaatggcatctttatgtctctgtaacattggccttttcatggctccacactgggtggaaccatattctcttagatcacatttagtagcataactgtagggactattagagatggcatctcatcgatgagagagaatcacaatcagaatggaagcactttgagtatctgaagagtgagagcattcatgtttgacaggtcctgcttcccactatccttttcctgttattattcaaattttacacaaggactaatcctgggtgtctctgagacccatctcctgcctagacatccacctccagagcaacactggccccacagtaaaagaggaagtcttgtacctcaggcaggcccatctagagctattgctccttcccacagcaaaggtattgtggatgacccttagaatccattctctggtcttctgaaataccaagggcagatgtcacctccttcctcagcaggactgactctgggctctacaaccagctccttcacataaagggtttagagactccccttggctcccagtcaccatatccagtgttgtgtaaagagactggccaacaggaccaaccaagcaccttacctctcccatacaagatgaccctctgagcttttcatttattcaagctctgtggtacagcctttttttaaaataaattaatctatattggttgacaaacaagccaccaaccactgactgcaaaactgcctgatgcagttgggttcctcctggttttcttttgttacaaccacccttgcctgtttacattaattgcaaggagcataacgtacaggctgtatgtacaatcctgggcattgactctgtgacatttctagcatatccaaggcaccaccagtgatttctcctgtttcttggtgggggtgggggggaaggtacgtattctgcaatatggctaaaccctttcctgattgagagttaaagcaataggagtcaagttactggtgccacagatctggaggtatgataggtcaggggctaggtgttgaacttagttaatggaagactgagagcagaacaggtttgtcatctccgcaaggccagaaagtgatcacaaaaagaggcagatgatagacactggggtagggtcataccacagggaaatacctttcctgggcttgttttctagcatatcactgacctgggatctttgggtgatcaagggtgtggttagtggaggctctgtgctgcacgtatgcagtatcctatctctttctacatcagatcaaaacactaagttggtgtactgcctcgaccttttttcagctcatcctggaacatatacagagttgagagttttagacaatctctaggtagaggagacaagatgtagacccagacagaagaaatctgcttccctaccatggctattccagcaccccaacctgtaattgccaagtcctctaaggtactaatttgtagctgctctgaagtaaggatttcggattcagctggtagggaaagactctgcacctgctgtcttagggaagaaatggttcaaatccatgtggtgacattgcattagtctccctttcactgttttcttattctgtaattgtttgttatatttcccaaaaacgtcttgatcactaagcaaagctgctagtgggattctatatttcgtgtcatcttttttattataatttattgcaaatttttttctgaataaatatatgttgtgtgaaaaagcaaa

SEQ ID NO: 199328 - DNA, 2791 bp, Homo sapiens
tgaggcagggtgtgcgtatgaatgtgtgatgaccacgtggcctggtcattgagtggacagggaccaaacagcacggccactcttactttgaagttataatttggaaggtattgtgttggccatgaggagataatagaagttagacagatgaaatgggtcctgcaagggttggattatagactactattacagcagctgtaagttcctcttactttcatcttccacctgtttttctcactgcctgcccctatttttaaaaacaggtgatctcccagcttccgagatgccatagaaatgttttccgttacttgatggcattccttcgagaactcttaaaattctctgaatacaatagcgtcaatgccaacatgatcgctactctcttcactagtcttctcctgaggcctccacccaaccttatggcaagacagactccaagtgaccgccagcgtgctattcagttccttctgggctttctgcttgggagcgaagaagactaaggcttttactgttctctgatattctagaagcagacgatctcgggctccaagtatttcagaatgatttaaaaagtcatgccacaggaagggtctattgcagaatttcaagttctgtttatagtaaaaaggaagagcgtttcctaatccctcctttaccatatcctacacagaaaaatacttttagacttatattgccaagccaaagttaccatattttggtgtttttgtgttttctctttataaggcaaaaagatctgtatttacactccttcacctaaggatgtgtttgttgccctcctacccaattgtcatgattgtccttagtaccctaggcctagattctgagatcttcccattctaggcctacaagcactacttgctgtagctgagacttgtctagagtcctttgttttgcacttttgacccaccccttcctggatcactcctttgcactccactcccctcgttctgtcactttgaacgaagtctgagtgaggctagtgactccttgggtgtcctcaacagtgaattcactgtctgcgtgcagttattacatgcatttgtgcatttctactacaatggcatctttatgtctctgtaacattggccttttcatggctccacactgggtggaaccatattctcttagatcacatttagtagcataactgtagggactattagagatggcatctcatcgatgagagagaatcacaatcagaatggaagcactttgagtatctgaagagtgagagcattcatgtttgacaggtcctgcttcccactatccttttcctgttattattcaaattttacacaaggactaatcctgggtgtctctgagacccatctcctgcctagacatccacctccagagcaacactggccccacagtaaaagaggaagtcttgtacctcaggcaggcccatctagagctattgctccttcccacagcaaaggtattgtggatgacccttagaatccattctctggtcttctgaaataccaagggcagatgtcacctccttcctcagcaggactgactctgggctctacaaccagctccttcacataaagggtttagagactccccttggctcccagtcaccatatccagtgttgtgtaaagagactggccaacaggaccaaccaagcaccttacctctcccatacaagatgaccctctgagcttttcatttattcaagctctgtggtacagcctttttttaaaataaattaatctatattggttgacaaacaagccaccaaccactgactgcaaaactgcctgatgcagttgggttcctcctggttttcttttgttacaaccacccttgcctgtttacattaattgcaaggagcataacgtacaggctgtatgtacaatcctgggcattgactctgtgacatttctagcatatccaaggcaccaccagtgatttctcctgtttcttggtgggggtgggggggaaggtacgtattctgcaatatggctaaaccctttcctgattgagagttaaagcaataggagtcaagttactggtgccacagatctggaggtatgataggtcaggggctaggtgttgaacttagttaatggaagactgagagcagaacaggtttgtcatctccgcaaggccagaaagtgatcacaaaaagaggcagatgatagacactggggtagggtcataccacagggaaatacctttcctgggcttgttttctagcatatcactgacctgggatctttgggtgatcaagggtgtggttagtggaggctctgtgctgcacgtatgcagtatcctatctctttctacatcagatcaaaacactaagttggtgtactgcctcgaccttttttcagctcatcctggaacatatacagagttgagagttttagacaatctctaggtagaggagacaagatgtagacccagacagaagaaatctgcttccctaccatggctattccagcaccccaacctgtaattgccaagtcctctaaggtactaatttgtagctgctctgaagtaaggatttcggattcagctggtagggaaagactctgcacctgctgtcttagggaagaaatggttcaaatccatgtggtgacattgcattagtctccctttcactgttttcttattctgtaattgtttgttatatttcccaaaaacgtcttgatcactaagcaaagctgctagtgggattctatatttcgtgtcatcttttttattataatttattgcaaatttttttctgaataaatatatgttgtgtgaaaaagcaaa

SEQ ID NO: 199329 - DNA, 5481 bp, Homo sapiens
tcagcctgaacatggatgaagttttttgtttttaagagcttccttagtgattgttataggagcctcctagacaattctcagctcccagctccccgctcccggctcccggcgcccggcgcccggcgcggagctgttcctcaaacgacacgcagccgaggtgggtgggtgtggggacgcgggagccagtgtcgtcggatcggcccgcagtccgctgtcctgctgagcccggaggccgcctggatggagccgccgctcccggtcggagcccagccgcttgccactgtcgagggtatggagatgaagggtcctctccgggagccctgcgccctgaccctagcccagaggaacgggcaatatgagttaataatccagttgcatgagaaggaacagcatgttcaagatatcattcctataaatagccacttcagatgtgttcaagaagcagaagaaactcttttgattgacatagcttctaacagtggctgcaaaattcgggttcagggggactggatcagagagcgccgctttgaaatccctgatgaggaacactgtttgaagttcctctcagctgtccttgctgctcagaaagctcagtcacagcttcttgttccagagcaaaaggactcatctagctggtaccagaaattagacactaaggacaaaccttctgttttttcagggcttcttggatttgaagacaatttttcttctatgaatttggacaagaaaataaattcacaaaatcagcctactgggattcatcgggaacccccacctccacccttttcagtgaataaaatgcttccacgtgaaaaagaagcttctaacaaggagcagcccaaagtgaccaacaccatgcggaagctctttgtaccaaatacccaatctgggcagcgggagggtctcatcaaacatatcctggcaaagcgagagaaagaatatgtcaacattcagactttcagattttttgttggaacttggaatgtgaatggccagtctccagatagcgggttagaaccttggctgaactgtgatcccaatcctcctgatatctactgcattggattccaagaactggacttgagcacagaagccttcttctactttgaatctgtgaaggaacaagaatggtccatggctgtagagagaggtttgcattccaaagccaagtataagaaagttcaactggtgcgccttgttgggatgatgcttcttatatttgccagaaaggatcagtgtcgatacattcgtgatattgctacagaaacagttggaactggaatcatggggaaaatgggaaacaaaggtggggtagctgtgagatttgtatttcacaacaccaccttttgcattgtcaattcccatctggctgcacacgtggaggactttgagagaaggaatcaagattataaggacatttgtgcgagaatgagttttgtggtcccaaatcagaccctcccgcagttgaacatcatgaaacatgaggttgtcatttggttgggagatttgaattatagactttgcatgcctgatgccaatgaggtgaaaagtcttattaataagaaagaccttcagagactcttgaaattcgaccagctaaatattcagcgcacacagaaaaaagcttttgttgacttcaatgaaggggaaatcaagttcatccccacttataagtatgactctaaaacagaccggtgggattccagtgggaaatgccgggttccagcctggtgtgaccgaattctttggagaggaacaaatgttaatcagcttaattatcggagtcacatggaactgaaaaccagcgaccacaagcctgttagcgccctcttccatattggggtgaaggttgtggatgaacgaaggtaccggaaagtctttgaagatagtgtacgcatcatggacagaatggaaaatgacttccttccttccttagaactcagcaggagggagtttgtgtttgaaaatgtgaagtttcggcaactacaaaaggagaagttccagatcagcaacaatggacaggttccctgccatttttctttcatccctaaacttaatgacagccagtactgcaagccatggcttcgggctgaaccttttgagggctacttggagccaaatgagacagtggacatttctcttgatgtgtatgtcagcaaagactctgtaaccatcctgaactcgggagaagataagattgaagatattctcgtccttcacctggatcgaggcaaagattacttcttgactatcagtggaaattacctcccaagttgttttggcacatccttagaggctctgtgccgtatgaaaagaccaatccgagaagttcctgttaccaaactcatagacttggagaaatcccttctgcaaatggttcctttggatgaaggtgccagtgagagaccccttcaggttcccaaggagatctggcttctagtagatcacctattcaaatacgcctgtcaccaggaggacctgttccagacccctggaatgcaggaagagctccagcagatcattgattgtctggataccagcattcctgagacaatccctggcagcaaccactctgtggctgaagcactgctcattttcttggaagccctgccagagccagtcatctgttacgagctgtatcagcgatgtcttgactctgcttatgatccccggatctgccgacaggtgatctcccagcttccgagatgccatagaaatgttttccgttacttgatggcattccttcgagaactcttaaaattctctgaatacaatagcgtcaatgccaacatgatcgctactctcttcactagtcttctcctgaggcctccacccaaccttatggcaagacagactccaagtgaccgccagcgtgctattcagttccttctgggctttctgcttgggagcgaagaagactaaggcttttactgttctctgatattctagaagcagacgatctcgggctccaagtatttcagaatgatttaaaaagtcatgccacaggaagggtctattgcagaatttcaagttctgtttatagtaaaaaggaagagcgtttcctaatccctcctttaccatatcctacacagaaaaatacttttagacttatattgccaagccaaagttaccatattttggtgtttttgtgttttctctttataaggcaaaaagatctgtatttacactccttcacctaaggatgtgtttgttgccctcctacccaattgtcatgattgtccttagtaccctaggcctagattctgagatcttcccattctaggcctacaagcactacttgctgtagctgagacttgtctagagtcctttgttttgcacttttgacccaccccttcctggatcactcctttgcactccactcccctcgttctgtcactttgaacgaagtctgagtgaggctagtgactccttgggtgtcctcaacagtgaattcactgtctgcgtgcagttattacatgcatttgtgcatttctactacaatggcatctttatgtctctgtaacattggccttttcatggctccacactgggtggaaccatattctcttagatcacatttagtagcataactgtagggactattagagatggcatctcatcgatgagagagaatcacaatcagaatggaagcactttgagtatctgaagagtgagagcattcatgtttgacaggtcctgcttcccactatccttttcctgttattattcaaattttacacaaggactaatcctgggtgtctctgagacccatctcctgcctagacatccacctccagagcaacactggccccacagtaaaagaggaagtcttgtacctcaggcaggcccatctagagctattgctccttcccacagcaaaggtattgtggatgacccttagaatccattctctggtcttctgaaataccaagggcagatgtcacctccttcctcagcaggactgactctgggctctacaaccagctccttcacataaagggtttagagactccccttggctcccagtcaccatatccagtgttgtgtaaagagactggccaacaggaccaaccaagcaccttacctctcccatacaagatgaccctctgagcttttcatttattcaagctctgtggtacagcctttttttaaaataaattaatctatattggttgacaaacaagccaccaaccactgactgcaaaactgcctgatgcagttgggttcctcctggttttcttttgttacaaccacccttgcctgtttacattaattgcaaggagcataacgtacaggctgtatgtacaatcctgggcattgactctgtgacatttctagcatatccaaggcaccaccagtgatttctcctgtttcttggtgggggtgggggggaaggtacgtattctgcaatatggctaaaccctttcctgattgagagttaaagcaataggagtcaagttactggtgccacagatctggaggtatgataggtcaggggctaggtgttgaacttagttaatggaagactgagagcagaacaggtttgtcatctccgcaaggccagaaagtgatcacaaaaagaggcagatgatagacactggggtagggtcataccacagggaaatacctttcctgggcttgttttctagcatatcactgacctgggatctttgggtgatcaagggtgtggttagtggaggctctgtgctgcacgtatgcagtatcctatctctttctacatcagatcaaaacactaagttggtgtactgcctcgaccttttttcagctcatcctggaacatatacagagttgagagttttagacaatctctaggtagaggagacaagatgtagacccagacagaagaaatctgcttccctaccatggctattccagcaccccaacctgtaattgccaagtcctctaaggtactaatttgtagctgctctgaagtaaggatttcggattcagctggtagggaaagactctgcacctgctgtcttagggaagaaatggttcaaatccatgtggtgacattgcattagtctccctttcactgttttcttattctgtaattgtttgttatatttcccaaaaacgtcttgatcactaagcaaagctgctagtgggattctatatttcgtgtcatcttttttattataatttattgcaaatttttttctgaataaatatatgttgtgtgaaaaagcaaaaaaaaaaaaaaaaaatttggggggggttgggcccgaaaaatctactaaaacctttcgtgggggggggggccccagtgggtaggcgacacggtgccaagcaggggtccccgaagaaaaaccggggacagacaacaggtgcgggggttctcccaccatattaaaaaaggcccgggggaacacgaaggtgtctggaaaaactccaagagggaccccgagggcaaaacggggtccctccacaggggtcccagggaagccgatattaaataca

SEQ ID NO: 199330 - DNA, 4592 bp, Homo sapiens
tcagcctgaacatggatgaagttttttgtttttaagagcttccttagtgattgttataggagcctcctagacaattctcagctcccagctccccgctcccggctcccggcgcccggcgcccggcgcggagctgttcctcaaacgacacgcagccgaggtgggtgggtgtggggacgcgggagccagtgtcgtcggatcggcccgcagtccgctgtcctgctgagcccggaggccgcctggatggagccgccgctcccggtcggagcccagccgcttgccactgtcgagggtatggagatgaagggtcctctccgggagccctgcgccctgaccctagcccagaggaacgggcaatatgagttaataatccagttgcatgagaaggaacagcatgttcaagatatcattcctataaatagccacttcagatgtgttcaagaagcagaagaaactcttttgattgacatagcttctaacagtggctgcaaaattcgggttcagggggactggatcagagagcgccgctttgaaatccctgatgaggaacactgtttgaagttcctctcagctgtccttgctgctcagaaagctcagtcacagcttcttgttccagagcaaaaggactcatctagctggtaccagaaattagacactaaggacaaaccttctgttttttcagggcttcttggatttgaagacaatttttcttctatgaatttggacaagaaaataaattcacaaaatcagcctactgggattcatcgggaacccccacctccacccttttcagtgaataaaatgcttccacgtgaaaaagaagcttctaacaaggagcagcccaaagtgaccaacaccatgcggaagctctttgtaccaaatacccaatctgggcagcgggagggtctcatcaaacatatcctggcaaagcgagagaaagaatatgtcaacattcagactttcagattttttgttggaacttggaatgtgaatggccagtctccagatagcgggttagaaccttggctgaactgtgatcccaatcctcctgatatctactgcattggattccaagaactggacttgagcacagaagccttcttctactttgaatctgtgaaggaacaagaatggtccatggctgtagagagaggtttgcattccaaagccaagtataagaaagttcaactggtgcgccttgttgggatgatgcttcttatatttgccagaaaggatcagtgtcgatacattcgtgatattgctacagaaacagttggaactggaatcatggggaaaatgggaaacaaaggtggggtagctgtgagatttgtatttcacaacaccaccttttgcattgtcaattcccatctggctgcacacgtggaggactttgagagaaggaatcaagattataaggacatttgtgcgagaatgagttttgtggtcccaaatcagaccctcccgcagttgaacatcatgaaacatgaggttgtcatttggttgggagatttgaattatagactttgcatgcctgatgccaatgaggtgaaaagtcttattaataagaaagaccttcagagactcttgaaattcgaccagctaaatattcagcgcacacagaaaaaagcttttgttgacttcaatgaaggggaaatcaagttcatccccacttataagtatgactctaaaacagaccggtgggattccagtgggaaatgccgggttccagcctggtgtgaccgaattctttggagaggaacaaatgttaatcagcttaattatcggagtcacatggaactgaaaaccagcgaccacaagcctgttagcgccctcttccatattggggtgaaggttgtggatgaacgaaggtaccggaaagtctttgaagatagtgtacgcatcatggacagaatggaaaatgacttccttccttccttagaactcagcaggagggagtttgtgtttgaaaatgtgaagtttcggcaactacaaaaggagaagttccagatcagcaacaatggacaggttccctgccatttttctttcatccctaaacttaatgacagccagtactgcaagccatggcttcgggctgaaccttttgagggctacttggagccaaatgagacagtggacatttctcttgatgtgtatgtcagcaaagactctgtaaccatcctgaactcgggagaagataagattgaagatattctcgtccttcacctggatcgaggcaaagattacttcttgactatcagtggaaattacctcccaagttgttttggcacatccttagaggctctgtgccgtatgaaaagaccaatccgagaagttcctgttaccaaactcatagacttggaagaagacagcttcctagaaaaggagaaatcccttctgcaaatggttcctttggatgaaggtgccagtgagagaccccttcaggttcccaaggagatctggcttctagtagatcacctattcaaatacgcctgtcaccaggaggacctgttccagacccctggaatgcaggaagagctccagcagatcattgattgtctggataccagcattcctgagacaatccctggcagcaaccactctgtggctgaagcactgctcattttcttggaagccctgccagagccagtcatctgttacgagctgtatcagcgatgtcttgactctgcttatgatccccggatctgccgacaggtgatctcccagcttccgagatgccatagaaatgttttccgttacttgatggcattccttcgagaactcttaaaattctctgaatacaatagcgtcaatgccaacatgatcgctactctcttcactagtcttctcctgaggcctccacccaaccttatggcaagacagactccaagtgaccgccagcgtgctattcagttccttctgggctttctgcttgggagcgaagaagactaaggcttttactgttctctgatattctagaagcagacgatctcgggctccaagtatttcagaatgatttaaaaagtcatgccacaggaagggtctattgcagaatttcaagttctgtttatagtaaaaaggaagagcgtttcctaatccctcctttaccatatcctacacagaaaaatacttttagacttatattgccaagccaaagttaccatattttggtgtttttgtgttttctctttataaggcaaaaagatctgtatttacactccttcacctaaggatgtgtttgttgccctcctacccaattgtcatgattgtccttagtaccctaggcctagattctgagatcttcccattctaggcctacaagcactacttgctgtagctgagacttgtctagagtcctttgttttgcacttttgacccaccccttcctggatcactcctttgcactccactcccctcgttctgtcactttgaacgaagtctgagtgaggctagtgactccttgggtgtcctcaacagtgaattcactgtctgcgtgcagttattacatgcatttgtgcatttctactacaatggcatctttatgtctctgtaacattggccttttcatggctccacactgggtggaaccatattctcttagatcacatttagtagcataactgtagggactattagagatggcatctcatcgatgagagagaatcacaatcagaatggaagcactttgagtatctgaagagtgagagcattcatgtttgacaggtcctgcttcccactatccttttcctgttattattcaaattttacacaaggactaatcctgggtgtctctgagacccatctcctgcctagacatccacctccagagcaacactggccccacagtaaaagaggaagtcttgtacctcaggcaggcccatctagagctattgctccttcccacagcaaaggtattgtggatgacccttagaatccattctctggtcttctgaaataccaagggcagatgtcacctccttcctcagcaggactgactctgggctctacaaccagctccttcacataaagggtttagagactccccttggctcccagtcaccatatccaggtgtggttagtggaggctctgtgctgcacgtatgcagtatcctatctctttctacatcagatcaaaacactaagttggtgtactgcctcgaccttttttcagctcatcctggaacatatacagagttgagagttttagacaatctctaggtagaggagacaagatgtagacccagacagaagaaatctgcttccctaccatggctattccagcaccccaacctgtaattgccaagtcctctaaggtactaatttgtagctgctctgaagtaaggatttcggattcagctggtagggaaagactctgcacctgctgtcttagggaagaaatggttcaaatccatgtggtgacattgcattagtctccctttcactgttttcttattctgtaattgtttgttatatttcccaaaaacgtcttgatcactaagcaaagctgctagtgggattctatatttcgtgtcatcttttttattataatttattgcaaatttttttctgaataaatatatgttgtgtgaaaaagcaaa

SEQ ID NO: 199331 - DNA, 2391 bp, Homo sapiens
tcagcctgaacatggatgaagttttttgtttttaagagcttccttagtgattgttataggagcctcctagacaattctcagctcccagctccccgctcccggctcccggcgcccggcgcccggcgcggagctgttcctcaaacgacacgcagccgaggtgggtgggtgtggggacgcgggagccagtgtcgtcggatcggcccgcagtccgctgtcctgctgagcccggaggccgcctggatggagccgccgctcccggtcggagcccagccgcttgccactgtcgagggtatggagatgaagggtcctctccgggagccctgcgccctgaccctagcccagaggaacgggcaatatgagttaataatccagttgcatgagaaggaacagcatgttcaagatatcattcctataaatagccacttcagatgtgttcaagaagcagaagaaactcttttgattgacatagcttctaacagtggctgcaaaattcgggttcagggggactggatcagagagcgccgctttgaaatccctgatgaggaacactgtttgaagttcctctcagctgtccttgctgctcagaaagctcagtcacagcttcttgttccagagcaaaaggactcatctagctggtaccagaaattagacactaaggacaaaccttctgttttttcagggcttcttggatttgaagacaatttttcttctatgaatttggacaagaaaataaattcacaaaatcagcctactgggattcatcgggaacccccacctccacccttttcagtgaataaaatgcttccacgtgaaaaagaagcttctaacaaggagcagcccaaagtgaccaacaccatgcggaagctctttgtaccaaatacccaatctgggcagcgggagggtctcatcaaacatatcctggcaaagcgagagaaagaatatgtcaacattcagactttcagattttttgttggaacttggaatgtgaatggccagtctccagatagcgggttagaaccttggctgaactgtgatcccaatcctcctgatatctactgcattggattccaagaactggacttgagcacagaagccttcttctactttgaatctgtgaaggaacaagaatggtccatggctgtagagagaggtttgcattccaaagccaagtataagaaagttcaactggtgcgccttgttgggatgatgcttcttatatttgccagaaaggatcagtgtcgatacattcgtgatattgctacagaaacagttggaactggaatcatggggaaaatgggaaacaaaggtggggtagctgtgagatttgtatttcacaacaccaccttttgcattgtcaattcccatctggctgcacacgtggaggactttgagagaaggaatcaagattataaggacatttgtgcgagaatgagttttgtggtcccaaatcagaccctcccgcagttgaacatcatgaaacatgaggttgtcatttggttgggagatttgaattatagactttgcatgcctgatgccaatgaggtgaaaagtcttattaataagaaagaccttcagagactcttgaaattcgaccagctaaatattcagcgcacacagaaaaaagcttttgttgacttcaatgaaggggaaatcaagttcatccccacttataagtatgactctaaaacagaccggtgggattccagtgggaaatgccgggttccagcctggtgtgaccgaattctttggagaggaacaaatgttaatcagcttaattatcggagtcacatggaactgaaaaccagcgaccacaagcctgttagcgccctcttccatattggggtgaaggttgtggatgaacgaaggtaccggaaagtctttgaagatagtgtacgcatcatggacagaatggaaaatgacttccttccttccttagaactcagcaggagggagtttgtgtttgaaaatgtgaagtttcggcaactacaaaaggagaagttccagatcagcaacaatggacaggttccctgccatttttctttcatccctaaacttaatgacagccagtactgcaagccatggcttcgggctgaaccttttgagggctacttggagccaaatgagacagtggacatttctcttgatgtgtatgtcagcaaagaactctgcacctgctgtcttagggaagaaatggttcaaatccatgtggtgacattgcattagtctccctttcactgttttcttattctgtaattgtttgttatatttcccaaaaacgtcttgatcactaagcaaagctgctagtgggattctatatttcgtgtcatcttttttattataatttattgcaaatttttttctgaataaatatatgttgtgtgaaaaagcaaa

SEQ ID NO: 199332 - DNA, 5237 bp, Homo sapiens
tcagcctgaacatggatgaagttttttgtttttaagagcttccttagtgattgttataggagcctcctagacaattctcagctcccagctccccgctcccggctcccggcgcccggcgcccggcgcggagctgttcctcaaacgacacgcagccgaggtgggtgggtgtggggacgcgggagccagtgtcgtcggatcggcccgcagtccgctgtcctgctgagcccggaggccgcctggatggagccgccgctcccggtcggagcccagccgcttgccactgtcgagggtatggagatgaagggtcctctccgggagccctgcgccctgaccctagcccagaggaacgggcaatatgagttaataatccagttgcatgagaaggaacagcatgttcaagatatcattcctataaatagccacttcagatgtgttcaagaagcagaagaaactcttttgattgacatagcttctaacagtggctgcaaaattcgggttcagggggactggatcagagagcgccgctttgaaatccctgatgaggaacactgtttgaagttcctctcagctgtccttgctgctcagaaagctcagtcacagcttcttgttccagagcaaaaggactcatctagctggtaccagaaattagacactaaggacaaaccttctgttttttcagggcttcttggatttgaagacaatttttcttctatgaatttggacaagaaaataaattcacaaaatcagcctactgggattcatcgggaacccccacctccacccttttcagtgaataaaatgcttccacgtgaaaaagaagcttctaacaaggagcagcccaaagtgaccaacaccatgcggaagctctttgtaccaaatacccaatctgggcagcgggagggtctcatcaaacatatcctggcaaagcgagagaaagaatatgtcaacattcagactttcagattttttgttggaacttggaatgtgaatggccagtctccagatagcgggttagaaccttggctgaactgtgatcccaatcctcctgatatctactgcattggattccaagaactggacttgagcacagaagccttcttctactttgaatctgtgaaggaacaagaatggtccatggctgtagagagaggtttgcattccaaagccaagtataagaaagttcaactggtgcgccttgttgggatgatgcttcttatatttgccagaaaggatcagtgtcgatacattcgtgatattgctacagaaacagttggaactggaatcatggggaaaatgggaaacaaaggtggggtagctgtgagatttgtatttcacaacaccaccttttgcattgtcaattcccatctggctgcacacgtggaggactttgagagaaggaatcaagattataaggacatttgtgcgagaatgagttttgtggtcccaaatcagaccctcccgcagttgaacatcatgaaacatgaggttgtcatttggttgggagatttgaattatagactttgcatgcctgatgccaatgaggtgaaaagtcttattaataagaaagaccttcagagactcttgaaattcgaccagctaaatattcagcgcacacagaaaaaagcttttgttgacttcaatgaaggggaaatcaagttcatccccacttataagtatgactctaaaacagaccggtgggattccagtgggaaatgccgggttccagcctggtgtgaccgaattctttggagaggaacaaatgttaatcagcttaattatcggagtcacatggaactgaaaaccagcgaccacaagcctgttagcgccctcttccatattggggtgaaggttgtggatgaacgaaggtaccggaaagtctttgaagatagtgtacgcatcatggacagaatggaaaatgacttccttccttccttagaactcagcaggagggagtttgtgtttgaaaatgtgaagtttcggcaactacaaaaggagaagttccagatcagcaacaatggacaggttccctgccatttttctttcatccctaaacttaatgacagccagtactgcaagccatggcttcgggctgaaccttttgagggctacttggagccaaatgagacagtggacatttctcttgatgtgtatgtcagcaaagactctgtaaccatcctgaactcgggagaagataagattgaagatattctcgtccttcacctggatcgaggcaaagattacttcttgactatcagtggaaattacctcccaagttgttttggcacatccttagaggctctgtgccgtatgaaaagaccaatccgagaagttcctgttaccaaactcatagacttggaagaagacagcttcctagaaaaggagaaatcccttctgcaaatggttcctttggatgaaggtgccagtgagagaccccttcaggttcccaaggagatctggcttctagtagatcacctattcaaatacgcctgtcaccaggaggacctgttccagacccctggaatgcaggaagagctccagcagatcattgattgtctggataccagcattcctgagacaatccctggcagcaaccactctgtggctgaagcactgctcattttcttggaagccctgccagagccagtcatctgttacgagctgtatcagcgatgtcttgactctgcttatgatccccggatctgccgacaggtgatctcccagcttccgagatgccatagaaatgttttccgttacttgatggcattccttcgagaactcttaaaattctctgaatacaatagcgtcaatgccaacatgatcgctactctcttcactagtcttctcctgaggcctccacccaaccttatggcaagacagactccaagtgaccgccagcgtgctattcagttccttctgggctttctgcttgggagcgaagaagactaaggcttttactgttctctgatattctagaagcagacgatctcgggctccaagtatttcagaatgatttaaaaagtcatgccacaggaagggtctattgcagaatttcaagttctgtttatagtaaaaaggaagagcgtttcctaatccctcctttaccatatcctacacagaaaaatacttttagacttatattgccaagccaaagttaccatattttggtgtttttgtgttttctctttataaggcaaaaagatctgtatttacactccttcacctaaggatgtgtttgttgccctcctacccaattgtcatgattgtccttagtaccctaggcctagattctgagatcttcccattctaggcctacaagcactacttgctgtagctgagacttgtctagagtcctttgttttgcacttttgacccaccccttcctggatcactcctttgcactccactcccctcgttctgtcactttgaacgaagtctgagtgaggctagtgactccttgggtgtcctcaacagtgaattcactgtctgcgtgcagttattacatgcatttgtgcatttctactacaatggcatctttatgtctctgtaacattggccttttcatggctccacactgggtggaaccatattctcttagatcacatttagtagcataactgtagggactattagagatggcatctcatcgatgagagagaatcacaatcagaatggaagcactttgagtatctgaagagtgagagcattcatgtttgacaggtcctgcttcccactatccttttcctgttattattcaaattttacacaaggactaatcctgggtgtctctgagacccatctcctgcctagacatccacctccagagcaacactggccccacagtaaaagaggaagtcttgtacctcaggcaggcccatctagagctattgctccttcccacagcaaaggtattgtggatgacccttagaatccattctctggtcttctgaaataccaagggcagatgtcacctccttcctcagcaggactgactctgggctctacaaccagctccttcacataaagggtttagagactccccttggctcccagtcaccatatccagtgttgtgtaaagagactggccaacaggaccaaccaagcaccttacctctcccatacaagatgaccctctgagcttttcatttattcaagctctgtggtacagcctttttttaaaataaattaatctatattggttgacaaacaagccaccaaccactgactgcaaaactgcctgatgcagttgggttcctcctggttttcttttgttacaaccacccttgcctgtttacattaattgcaaggagcataacgtacaggctgtatgtacaatcctgggcattgactctgtgacatttctagcatatccaaggcaccaccagtgatttctcctgtttcttggtgggggtgggggggaaggtacgtattctgcaatatggctaaaccctttcctgattgagagttaaagcaataggagtcaagttactggtgccacagatctggaggtatgataggtcaggggctaggtgttgaacttagttaatggaagactgagagcagaacaggtttgtcatctccgcaaggccagaaagtgatcacaaaaagaggcagatgatagacactggggtagggtcataccacagggaaatacctttcctgggcttgttttctagcatatcactgacctgggatctttgggtgatcaagggtgtggttagtggaggctctgtgctgcacgtatgcagtatcctatctctttctacatcagatcaaaacactaagttggtgtactgcctcgaccttttttcagctcatcctggaacatatacagagttgagagttttagacaatctctaggtagaggagacaagatgtagacccagacagaagaaatctgcttccctaccatggctattccagcaccccaacctgtaattgccaagtcctctaaggtactaatttgtagctgctctgaagtaaggatttcggattcagctggtagggaaagactctgcacctgctgtcttagggaagaaatggttcaaatccatgtggtgacattgcattagtctccctttcactgttttcttattctgtaattgtttgttatatttcccaaaaacgtcttgatcactaagcaaagctgctagtgggattctatatttcgtgtcatcttttttattataatttattgcaaatttttttctgaataaatatatgttgtgtgaaaaagcaaa

SEQ ID NO: 199333 - DNA, 2683 bp, Homo sapiens
gcctcgtgccgaatcggcacgtgggtgggtgtggggacgcgggagccagtgtcgtcggatcggcccgcagtccgctgtcctgctgagcccggaggccgcctggatggagccgccgctcccggtcggagcccagccgcttgccactgtcgagggtatggagatgaagggtcctctccgggagccctgcgccctgaccctagcccagaggaacgggcaatatgagttaataatccagttgcatgagaaggaacagcatgttcaagatatcattcctataaatagccacttcagatgtgttcaagaagcagaagaaactcttttgattgacatagcttctaacacgtgctattcagttccttctgggctttctgcttgggagcgaagaagactaaggcttttactgttctctgatattctagaagcagacgatctcgggctccaagtatttcagaatgatttaaaaagtcatgccacaggaagggtctattgcagaatttcaagttctgtttatagtaaaaaggaagagcgtttcctaatccctcctttaccatatcctacacagaaaaatacttttagacttatattgccaagccaaagttaccatattttggtgtttttgtgttttctctttataaggcaaaaagatctgtatttacactccttcacctaaggatgtgtttgttgccctcctacccaattgtcatgattgtccttagtaccctaggcctagattctgagatcttcccattctaggcctacaagcactacttgctgtagctgagacttgtctagagtcctttgttttgcacttttgacccaccccttcctggatcactcctttgcactccactcccctcgttctgtcactttgaacgaagtctgagtgaggctagtgactccttgggtgtcctcaacagtgaattcactgtctgcgtgcagttattacatgcatttgtgcatttctactacaatggcatctttatgtctctgtaacattggccttttcatggctccacactgggtggaaccatattctcttagatcacatttagtagcataactgtagggactattagagatggcatctcatcgatgagagagaatcacaatcagaatggaagcactttgagtatctgaagagtgagagcattcatgtttgacaggtcctgcttcccactatccttttcctgttattattcaaattttacacaaggactaatcctgggtgtctctgagacccatctcctgcctagacatccacctccagagcaacactggccccacagtaaaagaggaagtcttgtacctcaggcaggcccatctagagctattgctccttcccacagcaaaggtattgtggatgacccttagaatccattctctggtcttctgaaataccaagggcagatgtcacctccttcctcagcaggactgactctgggctctacaaccagctccttcacataaagggtttagagactccccttggctcccagtcaccatatccagtgttgtgtaaagagactggccaacaggaccaaccaagcaccttacctctcccatacaagatgaccctctgagcttttcatttattcaagctctgtggtacagcctttttttaaaataaattaatctatattggttgacaaacaagccaccaaccactgactgcaaaactgcctgatgcagttgggttcctcctggttttcttttgttacaaccacccttgcctgtttacattaattgcaaggagcataacgtacaggctgtatgtacaatcctgggcattgactctgtgacatttctagcatatccaaggcaccaccagtgatttctcctgtttcttggtgggggtgggggggaaggtacgtattctgcaatatggctaaaccctttcctgattgagagttaaagcaataggagtcaagttactggtgccacagatctggaggtatgataggtcaggggctaggtgttgaacttagttaatggaagactgagagcagaacaggtttgtcatctccgcaaggccagaaagtgatcacaaaaagaggcagatgatagacactggggtagggtcataccacagggaaatacctttcctgggcttgttttctagcatatcactgacctgggatctttgggtgatcaagggtgtggttagtggaggctctgtgctgcacgtatgcagtatcctatctctttctacatcagatcaaaacactaagttggtgtactgcctcgaccttttttcagctcatcctggaacatatacagagttgagagttttagacaatctctaggtagaggagacaagatgtagacccagacagaagaaatctgcttccctaccatggctattccagcaccccaacctgtaattgccaagtcctctaaggtactaatttgtagctgctctgaagtaaggatttcggattcagctggtagggaaagactctgcacctgctgtcttagggaagaaatggttcaaatccatgtggtgacattgcattagtctccctttcactgttttcttattctgtaattgtttgttatatttcccaaaaacgtcttgatcactaagcaaagctgctagtgggattctatatttcgtgtcatcttttttattataatttattgcaaatttttttctgaataaatatatgttgtgtgaaaaagcaaa

SEQ ID NO: 199334 - DNA, 2864 bp, Homo sapiens
tcagcctgaacatggatgaagttttttgtttttaagagcttccttagtgattgttataggagcctcctagacaattctcagctcccagctccccgctcccggctcccggcgcccggcgcccggcgcggagctgttcctcaaacgacacgcagccgaggtgggtgggtgtggggacgcgggagccagtgtcgtcggatcggcccgcagtccgctgtcctgctgagcccggaggccgcctggatggagccgccgctcccggtcggagcccagccgcttgccactgtcgagggtatggagatgaagggtcctctccgggagccctgcgccctgaccctagcccagaggaacgggcaatatgagttaataatccagttgcatgagaaggaacagcatgttcaagatatcattcctataaatagccacttcagatgtgttcaagaagcagaagaaactcttttgattgacatagcttctaacagtggctgcaaaattcgggttcagggggactggatcagagagcgccgctttgaaatccctgatgaggaacactgtttgaagttcctctcagctgtccttgctgctcagaaagctcagtcacagcttcttgttccagagcaaaaggactcatctagctggtaccagaaattagacactaaggacaaaccttctgttttttcagggcttcttggatttgaagacaatttttcttctatgaatttggacaagaaaataaattcacaaaatcagcctactgggattcatcgggaacccccacctccacccttttcagtgaataaaatgcttccacgtgaaaaagaagcttctaacaaggagcagcccaaagtgaccaacaccatgcggaagctctttgtaccaaatacccaatctgggcagcgggagggtctcatcaaacatatcctggcaaagcgagagaaagaatatgtcaacattcagactttcagattttttgttggaacttggaatgtgaatggccagtctccagatagcgggttagaaccttggctgaactgtgatcccaatcctcctgatatctactgcattggattccaagaactggacttgagcacagaagccttcttctactttgaatctgtgaaggaacaagaatggtccatggctgtagagagaggtttgcattccaaagccaagtataagaaagttcaactggtgcgccttgttgggatgatgcttcttatatttgccagaaaggatcagtgtcgatacattcgtgatattgctacagaaacagttggaactggaatcatggggaaaatgggaaacaaaggtggggtagctgtgagatttgtatttcacaacaccaccttttgcattgtcaattcccatctggctgcacacgtggaggactttgagagaaggaatcaagattataaggacatttgtgcgagaatgagttttgtggtcccaaatcagaccctcccgcagttgaacatcatgaaacatgaggttgtcatttggttgggagatttgaattatagactttgcatgcctgatgccaatgaggtgaaaagtcttattaataagaaagaccttcagagactcttgaaattcgaccagctaaatattcagcgcacacagaaaaaagcttttgttgacttcaatgaaggggaaatcaagttcatccccacttataagtatgactctaaaacagaccggtgggattccagtgggaaatgccgggttccagcctggtgtgaccgaattctttggagaggaacaaatgttaatcagcttaattatcggagtcacatggaactgaaaaccagcgaccacaagcctgttagcgccctcttccatattggggtgaaggttgtggatgaacgaaggtaccggaaagtctttgaagatagtgtacgcatcatggacagaatggaaaatgacttccttccttccttagaactcagcaggagggagtttgtgtttgaaaatgtgaagtttcggcaactacaaaaggagaagttccagatcagcaacaatggacaggttccctgccatttttctttcatccctaaacttaatgacagccagtactgcaagccatggcttcgggctgaaccttttgagggctacttggagccaaatgagacagtggacatttctcttgatgtgtatgtcagcaaagactctgtaaccatcctgaactcgggagaagataagattgaagatattctcgtccttcacctggatcgaggcaaagattacttcttgactatcagtggaaattacctcccaagttgttttggcacatccttagaggctctgtgccgtatgaaaagaccaatccgagaagttcctgttaccaaactcatagacttggaagaagacagcttcctagaaaaggagaaatcccttctgcaaatggttcctttggatgaaggtgccagtgagagaccccttcaggttcccaaggagatctggcttctagtagatcacctattcaaatacgcctgtcaccaggaggacctgttccagacccctggaatgcaggaagagctccagcagatcattgattgtctggataccagcattcctgagacaatccctggcagcaaccactctgtggctgaagcactgctcattttcttggaagccctgccagagccagtcatctgttacgagctgtatcagcgatgtcttgactctgcttatgatccccggatctgccgacaggtgatctcccagcttccgagatgccatagaaatgttttccgttacttgatggcattccttcgagaactcttaaaattctctgaatacaatagcgtcaatgccaacatgatcgtactctcttcactgtctcctccttgtcctctgggggatcctct

SEQ ID NO: 199335 - DNA, 1620 bp, Homo sapiens
tcagcctgaacatggatgaagttttttgtttttaagagcttccttagtgattgttataggagcctcctagacaattctcagctcccagctccccgctcccggctcccggcgcccggcgcccggcgcggagctgttcctcaaacgacacgcagccgaggtgggtgggtgtggggacgcgggagccagtgtcgtcggatcggcccgcagtccgctgtcctgctgagcccggaggccgcctggatggagccgccgctcccggtcggagcccagccgcttgccactgtcgagggtatggagatgaagggtcctctccgggagccctgcgccctgaccctagcccagaggaacgggcaatatgagttaataatccagttgcatgagaaggaacagcatgttcaagatatcattcctataaatagccacttcagatgtgttcaagaagcagaagaaactcttttgattgacatagcttctaacagtggctgcaaaattcgggttcagggggactggatcagagagcgccgctttgaaatccctgatgaggaacactgtttgaagttcctctcagctgtccttgctgctcagaaagctcagtcacagcttcttgttccagagcaaaaggactcatctagctggtaccagaaattagacactaaggacaaaccttctgttttttcagggcttcttggatttgaagacaatttttcttctatgaatttggacaagaaaataaattcacaaaatcagcctactgggattcatcgggaacccccacctccacccttttcagtgaataaaatgcttccacgtgaaaaagaagcttctaacaaggagcagcccaaagtgaccaacaccatgcggaagctctttgtaccaaatacccaatctgggcagcgggagggtctcatcaaacatatcctggcaaagcgagagaaagaatatgtcaacattcagactttcagattttttgttggaacttggaatgtgaatggccagtctccagatagcgggttagaaccttggctgaactgtgatcccaatcctcctgatatctactgcattggattccaagaactggacttgagcacagaagccttcttctactttgaatctgtgaaggaacaagaatggtccatggctgtagagagaggtttgcattccaaagccaagtataagaaagttcaactggtgcgccttgttgggatgatgcttcttatatttgccagaaaggatcagtgtcgatacattcgtgatattgctacagaaacagttggaactggaatcatggggaaaatgggaaacaaaggtggggtagctgtgagatttgtatttcacaacaccaccttttgcattgtcaattcccatctggctgcacacgtggaggactttgagagaaggaatcaagattataaggacatttgtgcgagaatgagttttgtggtcccaaatcagaccctcccgcagttgaacatcatgaaacatgagtaagtggttaactcacctgtagcctttgagtagtggctacaggagtttggatagtgtagagattaaatgtgagatactgtagagctgtgaagagtgaaagattaccagtgagggattggggtcacaaaggagagg

SEQ ID NO: 199336 - DNA, 490 bp, Homo sapiens
atccgcctgcctcggcctcctaaagtgctgggattacaggcgtgagccaccgcgcctggctggtaaaactctttattggaccaaagttgatataaaaaaaatagttctggttgtcagctgacatgagtcagcagtattctgtgactcaagttgcattcattcattcattcatccagtacttactgaagtcctgcttaccatgtgccaagcactattctagaggcttgagatacattacttaacaaaccaaataagcaaaaatctctgccctctcagtcagcattctgggggagatgggatgtcagacaataaagaaaaaccataactaatatatcgtatgttattcagtgatgagtgctctgaaaaaatatctcaaggtatttttaaggagataaggggcatattaggaggaagttcagattcttcaaggtgataaatgagcaaaaggaagcaagggactcagtcctgtggttatctagggggagagtgt

SEQ ID NO: 199337 - DNA, 374 bp, Homo sapiens
gtgaacctatgtatatagacatcaggtatggaggatagggcaggtgacatgtgaattcttgtcaacttgtgggtacagtcaggagtgattcagaaggagcaagagaaaactgggtgtaattaatagaaattaaaaccactaacttcaaaatgtacaacatgtataccttctgctctatcaatctcctttctagaatatatcaatatgaagaaatgtgtgatcaggtgttcattataccgtggagagctggataacacacaaacagaatacctatggcaggtaactttcgggattggaatttggaatttcacgatttttttttctttgtatgtattacttggcacttttttttttttttttttttttgagatgga

SEQ ID NO: 199338 - DNA, 347 bp, Homo sapiens
ctctccaacccttttttctaggaggaatgtatcagcaaagtcttacttcatcagactcagccttcttagtcctccagttgtcatcaagtttacaaatacaaattaaaaccactaacttcaaaatgtacaacatgtataccttctgctctatcaatctcctttctagaatatatcaatatgaagaaatgtgtgatcaggtgttcattataccgtggagagctggataacacacaaacagaatacctatggcaggtaactttcgggattggaatttggaatttcacgatttttttttctttgtatgtattacttggcacttttttttttttttttttttttgagatgga

SEQ ID NO: 199339 - DNA, 613 bp, Homo sapiens
aaggggctgacagtcatctcatctgacctgcatgatctcaggacatggccatgtgcctctatctcagccattctgatttcttttctggtattttctacgtggagtcagagtttaactttctatgggtggtttgcctgggatgatgggagactggggctccaaattactcttactcctttaatcttcctttgattagtaagcttctttcacatctctccatttaatctcattttaagtttaacatactttgagtttcagtctcctgtagatgttactaataggtaattttgacgaatacataatcttggctagagaagagatgcctcttttaagatgaaaatatccttcgttaatagcacaataaactgcagctgtcatgatttaacacagatacttcttttgtcttaataggtgaagtaggaaccccctctatttactcataatcatatttcataaggttgctgagaggatttaagtgagattatccatgtgtgtacctgcctagtctttaagtaccattagaacacttatgtgctagacgctgggctatcttgtgtagacatggggactatgtcatttaattctcacaaccagcatatcaggtaaattctgt

SEQ ID NO: 199340 - DNA, 338 bp, Homo sapiens
acatagccttttctctgcaaatgcatcccaaatgtctatccttttttctataaggacaccagcccatattggattagggtcacacccaagttgtaacttaacttttaattctaactgcctaattttaacttaatcacctctattaaaaatcttatctccaaaatacagctgcattttaagattttagaggttgggacttcaatgtatgaattttaggagagcatgattcagtctgtaacacttacataatgagagagcagagcaagtaaggtctctattgttcattcgttttgcttttatttaaagaggtaattccttgatttatcacaaagggtgat

SEQ ID NO: 199341 - DNA, 485 bp, Homo sapiens
aatatcttatttgtcaaagtaaagtatgtatgtatttctgtcttccttgttttcctcatgtattccttagcattctgatattgtgtcataggatgttgagttgtaaagcctatctgggttcatattttacatactagcttgtcttaagtcatataaccagtaaatagaaggcctggaagttgagtacatctctgtcaggttccagatcccatgccattgattatcatctataatgtcttgatgaagcttttaactagctgggtggtggaatgataatctagtttcctcatatgtaaaatggggatggaactatgcaaaccaagcactgttgtgaggaataaatgagatattttttgtgaaagtggtttgtaaatcaatttgatcttctgtttactctttgcaaagagaaccaagtatgtgtttaaatatattgcaattaataattactgagataaaatgtaactatacatttgaaatgatcagtt

SEQ ID NO: 199342 - DNA, 3289 bp, Homo sapiens
cccccgcctcccatggcttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactttcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaagctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaatagggaggcgagctgctgataacttgagaagacatcaccaataccaagaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaaggtaatagcaaggacaagaaaaagaatttcagcctttttgatttaaccaccctgattcatccgagatcagcagcaattgcctctgaaagacataacataagcaatggctctgccctggtggttcaggagccgcccagggagaagcagagaaaagtgaattttgtgaccgatatcaaaaactttgggttatttcatagacgatcaaaacaaaatgctgctgagcaaaatgcaaaccaaatcttctctgtttcagaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcttttaccatacacatacgtatgtgtatggtaaaagcttcctccttcaagtattacaatcttgtggtcacgtaatcttcgtgggtgac

SEQ ID NO: 199343 - DNA, 2870 bp, Homo sapiens
cccccgcctcccatggcttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactttcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaagctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaatagggaggcgagctgctgataacttgagaagacatcaccaataccaagaagttatgaggaacctggtgaagcgatacgttgctgcaatgattagagatgctaaaactgaagaaggaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcttttaccatacacatacgtatgtgtatggtaaaagcttcctccttcaagtattacaatcttgtggtcacgtaatcttcgtgggtgac

SEQ ID NO: 199344 - DNA, 2840 bp, Homo sapiens
cccccgcctcccatggcttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactttcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaagctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctaggcgagctgctgataacttgagaagacatcaccaataccaagaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaaggaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcttttaccatacacatacgtatgtgtatggtaaaagcttcctccttcaagtattacaatcttgtggtcacgtaatcttcgtgggtgac

SEQ ID NO: 199345 - DNA, 1542 bp, Homo sapiens
cccccgcctcccatggcttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactttcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggtaaatgtgttactatagaaaatataataaaaacatgttactgccacggaatttcgt

SEQ ID NO: 199346 - DNA, 3431 bp, Homo sapiens
cccccgcctcccatggcttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactttcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaagctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaatagggaggcgagctgctgataacttgagaagacatcaccaataccaagaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaaggtaatagcaaggacaagaaaaagaatttcagcctttttgatttaaccaccctgattcatccgagatcagcagcaattgcctctgaaagacataacataagcaatggctctgccctggtggttcaggagccgcccagggagaagcagagaaaagtgaattttgtgaccgatatcaaaaactttgggttatttcatagacgatcaaaacaaaatgctgctgagcaaaatgcaaaccaaatcttctctgtttcagaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcttttaccatacacatacgtattttccgtagtgctctgggtgggggaaaatgtttaaattgtattagcaaatgctaacttacactttatagcgtttatcagctgtggcatattacctgtaacatgtttaaataaggcaaaggcaatcaaaaacctttttgttttgtagcctgcttttgctttcacaatttgtcttacaattgtttttgttaataaataaatgcaccttgt

SEQ ID NO: 199347 - DNA, 3035 bp, Homo sapiens
cccccgcctcccatggcttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactttcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaagctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaatagggaggcgagctgctgataacttgagaagacatcaccaataccaagaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaaggaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcttttaccatacacatacgtatgtgtatggtaaaagcttcctccttcaagtattacaatcttgtggtcacgtaatcttcgtgggtgac

SEQ ID NO: 199348 - DNA, 272 bp, Homo sapiens
cccccgcctcccatggcttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcaggtaaagaggatgtcgcctctgggctccgttcgaccggagctacacctc

SEQ ID NO: 199349 - DNA, 86 bp, Homo sapiens
ttctttattttaacttttggaaagaaaacacaactaaggaaaaatctctgtggctcttatatcccctgatatccctgggggattgg

SEQ ID NO: 199350 - DNA, 649 bp, Homo sapiens
ctgaagtcccaagaaagattaaaacctagaaggataatgagaataaaatctcgctcactcttcttctacaaaaatgtagacagataccacggagttctcacctcctagaataaaagatgcctgcaagggtgaggcaagtatggaaaaggtttatggacaaaaggaatcagaaaaacaaagactgggggcctggaaaagcaattgaggcttgtcttagggagtcacaggatataaagagtacagttatctggaggacggaaaaaaaacgaaagataattgagcacatgaaaaaacagattcatttggtttcatttttattaacaggtaaggcttaaggatttaaaatggaacagaccttccacaatatctcataagtaaaacaatatataattaaagttgccagattacaagatagaagcttctgaactccatgaattaggtgcaaaattactaatctttctgctccctgccactcagtaaatggcacaattattttaactccaaaagtaatacaatcacctcagtaggactactttaaactgatccacactttacatgttacatggcatgaagcagacagggagtccagtttagcatgcggggattaaggctaaacacagttggaagcactcttatcagagatgacaag

SEQ ID NO: 199351 - DNA, 667 bp, Homo sapiens
tgggactataggtactagtccaaccatacctggctaatttttaatagtttttctgtagagatgggatctcactatgttgcccaggctgatcttgaactcctgagctcgagtgatcctccctcttggctcccaaaatgctgggattacaggcctgagccaccatgcccagccgtgactcactcttaaaggagctcaagtcttttgtgttggaactccaggaggttgacgaccacactcatctattcagtcagcatttgctaggtacctagcacacgcccagctctggggaggtatggggatataaaaatgaaggtgatttgattcttcccccgtggaggttaggacctggaaaggatggtgtgtgaagtgaatgctaggtttgctggtggctgaaaggaaggaacgttgtcatctttgtcatatgttagggattgccagacccaccagttgactatatccaaataaaggaacacagaatttggagtgatcacagggcagtgagatttgtctgggaagatatcttaggactcgtgaattttttgcagatcttaataattatagagaaaatgagtaggtggttaggaagaccaggtaactataacttacagaggtgagagaatgagaattgtatgcgtgggactagtcgggtccgagtcgatcgaatctg

SEQ ID NO: 199352 - DNA, 103 bp, Homo sapiens
tgctgggattacaggcctgagccactgcgcccagccaggccttttcttttataaaccttaggtttttccctgaggaccagactaggtcctcatttaaacaaaa

SEQ ID NO: 199353 - DNA, 780 bp, Homo sapiens
cccagaggggactcaagagggtaggaggaggagtcgtcagccagaaggaggtagaattcacttttttacaagcttctaaagtctcttcatagatgattgctggaattgtttgtttgtttgtgttttacgaatgatgtttaataaagaactgccaaaactgcagttagcattttttgaaaaataaataacttagtaaagaagcagccatatggtatctgtttagaactggaagtgcagaatctgttttcaaaaatagacctacaaaaagactgaacacaaaccaaaaacccttccaccttaataaaaataattcatggttaatttttttaaagatgtatgaatttaaaacttttacagctagtacattaaatttggcaagtagaaattctgaggaagaatgaatttgattccgtcaggtggttctcaaagattcttttattgtgaactttctaagtagaagaaagaattgtaaggccggtgcggtggctcacaccctacaatcccagcactttgggaggttgaggtgggaagatcactgaaggtctgggttttccatccaaatatcccacttcaggaactgcaggagtttgagaccagcctgggcaacatggtggaaccctgtctctacaaataatacaaaaaaaaaaaaaaatcaaatctgggcgtggtgggatgtgcctgtagtccctcccagctactcgggaggcgaggtatgaggatcacccaagcccatagatcgaggctgcagtgagtcactccagcctgggtgaccctgtctcc

SEQ ID NO: 199354 - DNA, 589 bp, Homo sapiens
  misc_feature (88)..(88): n is a, c, g, or t
cgatcatttcaaaatacaaccttccctctacattatcatcttcacaattccaattctactgactatccttgaaatggtcgccaatccncggatggcgacatttcaagtgcttaatagccatatgtggctagtggctgctgtgattgtatagcacagctccagagttttctttatagtaatttagaaccattccatttgattggtgatatgttgtctctcaggggaagagcagaacatttgttcatgaatttggattgccgtgttcacccaaaagattttttgggctgggagcattaccctgtgcttgttgtatccagctacttgagaggctgaggtgggaggttcacttgaggccaggagtttgagatcagcttggaaaacattgtaagaccttggctctaaaaaaattttttttaactaaaaacaaacaaacaaaaaatttagtgaggcatggtggtgtgtgcctgtagtctcagctactgaagaggctgaggtgggaggattgcttgtgcccaggagttggaggctgttgtgagctatgattgccactgcactccagcctaggcaacagagtgagaacctgtctctt

SEQ ID NO: 199355 - DNA, 594 bp, Homo sapiens
aacagtaataataataaatgttaaaagtgcataaaacatctcagtaatcccaaggactacagaaactctcttaaaaggactctttcacacaggtgaaagttacaaggtgcaagagcaacttcggaaaatgcctggcggccatccctgttctccagcatgtgttagctggtcacagggctgcccccttaaacaccacatttcccagtcccagcatggctagatgtgatcttgtaatgagagaatggaatgtgaatgggcttgatgtgtccagctcccattttctgcctggcaggagcttggacatgagggcagcaatgaactcttgtcagagcacacatgctgaggatggcagagaaattggagggatggagagtgggtcccacagattttgaaatcacctcgggacgtttacgtttggactcttacaagagaagcaaactgctctctgagttatgccactattatattgattttttaaaagaaaccagtatcctaactaacataaaaaggttaaagatgcttaaatagttgactccaaggtacatattgttaaatgaacaaaaaattcacacaaaatgaaactcaagtgactgt

SEQ ID NO: 199356 - DNA, 617 bp, Homo sapiens
ttattttccccacttacgcactcacactacttaccagttcccacccccacttacgcactcacattacttaccagttcccacctccactttccaaatgaccttatttcatgattttatttaaggatgcctatataaaaagtcccatttattccatacaaaaactgaaaaacagatttgttcaggcaatattaaatagatgagaggtttaaaatctggtgctcaaaccaacctagtcgcctctcctgattctatttaagagcatcttgtattgatttattgttactgattccaatgtgggaggtaacagtacattctatatgcaccagtctcatgggaacttctatcctgttttttacactgagccttgctctgactagttactaataattagaggatctcttttataacagtcttgtctgagtagcccagagtgtttcaaaggcataattaacttatactaatccaatgaaaaagatgatgaatatccttccttattttattttagagatggtgtcttgctctgttgctcaggctggagtacagtggcacaatctcagctcactgcaacctctacctcccaagttcaagcaattctcctgcctcagcctccctagtag

SEQ ID NO: 199357 - DNA, 458 bp, Homo sapiens
gaatcgtaaaacgaaggctatacatttcctcatcccccgaagaatattcagtgtttcttgctgacttttatgtccctgtctttcattttgtttttgttttttggttgagattttttgagtctgtcttctatgaaaggtggtttcttctaagtgaaagtacttaataataagagagtgctcagtttgcagtcaagactgcaaggtgactagacactgacattctgttgtgagagttgagctccatgactaaacagctcctctttctctagaccaaataaaagtcttatcatctcatgtatgtatctttaatcggacaccaatcatacatggaacattagggagaataggtaaagttatctttggtttgccagaagtgtttcacactcaaaggctcaatactttcacctgtgaatcattttgtgtgtgtatgtgagaggtaggaataatcaggtgacatc

SEQ ID NO: 199358 - DNA, 731 bp, Homo sapiens
gaataaaatcatcatggtcaggcgacccaagcagagcacagctgactatggtatgaggaccagtggccctgtggaaagcggtctcagtgctgactcgctgcagcttctttgtagctatgcagcaatcaagaatagtgctgagctcttgatggtggggccccaaggtatgaggccagccacaggccaagacttgctgtgtaggccttgcctgtcacatgatccgccaggccctcttcatcctccccgtggcctctcaggatcttcttccctgctgatctctcccaggctccaggatgtgtccctgcagttggttcatcccaccccagaggagtctttctaaactgtggctcggaacttgtcagttgcttaggcaccacctcctcacacttccaaggccttcctttcccagcctcgttagccactgggctgctctttctcacacactcaggtatccgccatgccacctgcccttaaccctccttcactcagcatttgcttgatgctgggtcctgggtaagacaactctcaacctattgcaggatctggccagcagtctgcaatgcaacggtgctctctctttgttcccaggcagatcggcaggtcgagaaataatagacacacgcaagatagcaaaatctgggtccaggggggtcaccgccttctgctcccacggtgccaacaacgcactggatataccggcatttattattaagtttggtgagagggcaggg

SEQ ID NO: 199359 - DNA, 613 bp, Homo sapiens
agaaccttcaccctatggaaacatccagagcattcactcactcaccattcattcattcattcactcactccacaaatccacggtgagccccttctgcgctccaggtagtgttctctgtgcaggggcattagtggtaagggcctgtctcctggagctcacggtctatggcagagactgacagtgaccagccagacatcaacacacagtggcatgtggtgatgcagaagtgcacacacagagaacctacacacaacagggatacgccttaaaaggagggaaattctgacatcctacaacatggatgagcctggaggacatgatgccaagtgaaagaagccagtctcaaaggacaagcactgtctgattccacttgcatgaggttcctggggtagtcagactcagagatggaaggtaggatggtgggtgccagggaaagggtgccaggctgggaaaggagggaatggggagttactatttaatgggtgtacagggttgcagttttacaggataaaaagagttttagagctggatggtcacacattatgaatgtatttaataccattgaactgtacatttaaaatggtaaattttatattatatgtattttaccata

SEQ ID NO: 199360 - DNA, 449 bp, Homo sapiens
taagaggaaacggataatgattgattctcacctaacaacctttgcagtccccattggagggtttagggaacttgtcaagttactctgcagcacatccacagtaagaaaataagcaaaactagcactcttaaaaagatatctaatcttttttaaaacataaaaatgtgttttgaagctaaggtgattcgcatagtgtgtaagaatataagaatcaacacacacaagttaaggggacatgcgccactgcagaaaggataaattattaaagaaattaggatgggaagattggatgtttggggtaaagtcactgtttgtgacacaatacagtaaaatacattccagctgggttaaaatataaataatcaaaataaaattgtgcagaaatagaagaaaatatatgcaattaatagaataaatcacaagaaaaataaatttgaccaataatatgc

SEQ ID NO: 199361 - DNA, 795 bp, Homo sapiens
cagacgcaggaatgaggagcgaggatgataaggaaagagagaagggacagaggagcaaggaggaggctccaaaagagaaaaagaaacagtgagaaaaacacagggttggggaagacacagttcaggccaaaaatacagacaacgagttgggaaacagcagtgtgagagggtgaagggcagatacagaaactgagagaaaccaagggaaaaaggaagagggtaaaaggacagagagaatgaaagggcagaggggagaacagtgacaaacaaggtgagccgaaaatacacaggatgagaaagaaaagacagaaacatagagaaacagacatgggccagagaaagagagagagaagaacaaaaccaggcagaaagtgagaaacagatgaatgagaaagggaagcaggaagtcaaaggaagaatgagaaccaagtagagaggaatccgggggatgataaagtgtgggagagaaaagggagagagactttggagctgagtggggaccgccggggaggggaggcctcagagtggctcagctgtagatgcggctttggcgtgggtttccaagtgggtaggtagcctggcctgcaggcccaaggttgtatcctccacttcgctccccagggtcctttcccccataccctgttttccttcccccttctccttcctcctccctcaattgcccctcccagctccagctggaaccagcccttctctgtgtctcccaagagtggagggatgtcctggagaaggaatggagtgagaggggccctctcataccctcatacccacacacat

SEQ ID NO: 199362 - DNA, 467 bp, Homo sapiens
agatggggcaggggaggataagggagactccaaagggaagaaaaagaaacagtgagaaaagcacaggggtcggggagatatagtcgtggtgaaatacagacagtgagttagaaaacaggagtgtgatcatgtgagagagaaaagggagagagactttggagctgagtggggaccgccggggaggggaggcctcagagtggctcagctgtagatgcggctttggcgtgggtttccaagtgggtaggtagcctggcctgcaggcccaaggttgtatcctccacttcgctccccagggtcctttcccccataccctgttttccttcccccttctccttcctcctccctcaattgcccctcccagctccagctggaaccagcccttctctgtgtctcccaagagtggagggatgtcctggagaaggaatggagtgagaggggccctctcataccctcatacccacacacat

SEQ ID NO: 199363 - DNA, 463 bp, Homo sapiens
agacaagtgacacaccagggaaaaatattggtaactcatcaaaactgaagactggttttactgatataaaagtgcaccagaggccaggtgcagtggctcacgcctgtaatcccagcgctttgggaggccgaggcaggcggatcacctgaagtcgggagtttgagaccatcctggctaacatggtgaaaccccgtctctactaaaaatagaaaaaattagccaggcatggtggtatgcgcctgtaatcccagctactcaggaggctgaggcagaagaatcgcttgatcccgggaggcagaggttgtagtgagccgagatcgcgccactgcactccagcctgggcgacaaagcaagactgcctctcaaaaaaaagtgcaccaggccaggcatggtggctcacgcctgtaatcccagcactttgggaggctgaggcaggtggatcacctgaggtcaggagttcgag

SEQ ID NO: 199364 - DNA, 432 bp, Homo sapiens
tcagcctcctgagtagctgggattacaggcacacgccaccacacccggctaatttttgtatttttagtagagatggggtttcaccatgttggccaggatggtctcaatctcctgacctcgtgatcctcccacctcggcctcccaaagtgccgggattacaggcgtgagccaagtataataatttttaaatcaccaagaaaatatctaataatgatcccagagtactaaagactcaagtgttccagtggtcaaagttctttcaggttgggaggcttttggttttacttccagtctctgtaatctttgccttaaaagcaggagaagggggtgatacaaagaacacagacatgatatttctaaatttgttttatttgaagaaaagtatgcttataatgtaataaggctcatcatagacagtatgcaaaacgtggg

SEQ ID NO: 199365 - DNA, 706 bp, Homo sapiens
gggacaactgtatatgaaagcatctttgtagaacctgttatgtaggataacccaacagaggtttcccttcccgaagaatattttgctataggtttctcggaaaacctagaacatcaaatctgtgagggcaggttacatggaaagtttatttaattgaattagacatgtaggaattcatagattaaagtattactggcgttgtttatgattgtaaacacaaagaaatttattgttggtagtatttcatgttggcaaggaaattattacacgtaagtgaaagtgctaggggagattccaagaaacttagggccttttcaaaggggaaaaagacagtgtttcagtagtctttccctgataccctttgtcgtatcagctttgtcatttgtaatccagctgccttattggctgtgataatatgccttgctagtggcaggttttactttttcttcacctttgtgagggattttattatattatcctcttgaaactactgagttttgtttacgttaacatacttttgaaactcaattggcacattaagattatctgactttagtgtaaaactttttaaaaaagttttgttttaaagtaaattgaggctgggtgtggtggctcacgcctgtaatcccagcactttgggaggccgaggcgggtggatcacatgaggtcgggagttcgagaccagcctggccaacatggtgaaacc

SEQ ID NO: 199366 - DNA, 315 bp, Homo sapiens
tgctaccaaatccagacattaaaagaaaaccataggccaatatcctatatgaatataaatacaaaaatcctcaacaaaatactagcaaaacgaacccagcaatatataagaggaatcatacatcatggccaaataagatttatcccaggactgcaaggttggtttaacatctgaaaatcaattaatgcaatataccatatcaatagaagacaaaattcacttgatcatctcaacagacatggaaaaagcatttgacaaaatccaacaccatttcctaataaaaaccattcaataggggctgggtgcggtggctca

SEQ ID NO: 199367 - DNA, 752 bp, Homo sapiens
ccgtgttagccaggatggtcttgatctcctgaccttgtgatccgccctcctcagcctccccaaagtgctgggattacaggcgtgagacaccgcgcctggtgaccgctctccttttaaaaacagaatgccaaagctaagccctgccatgtcctggtttgggacagactggctgagctgtttggcttcctgggtgtcttttaattgccagtttgtagccccttgagtactctcttcagtgcatccattttccttgagaagctggcaccgccttcccagagtactggtgggatctgaggaacgagctggggttgcccagtagatgcaagtatcctgcttcagtttcctaaagaggagctcctacagtgttcttagaatgaaagctaagaactggcacaggatctatttgataaacagctgtcatttgtagccatcctcccagatgtatgacagcagagtgttctctgatggaaagatcagcacccagattcccagccccagcgggttcctttccctgagcccctaggttactgccctgtaaaacccttgtttctttccagatcactgaagaacaaatagttgaattcactagtccttgtgcatcttctccctgccttcatgaagccacccttgtttttttttatctgacaaaccactgacagagacagcctggtccagataacatcttggtttcaccttctcaggtggagccatttttcctctacagctcataaccttaccactattatttcccc

SEQ ID NO: 199368 - DNA, 319 bp, Homo sapiens
tagccggacctctctccacactggctataatgacaccgtcccttacaaaaactacctctggaattagttccagtaaacagagtgtatgggaggagggagagtaaatgtgaccaggaattcctcattgcttttccaggcaaaaaagttcccctttgattcacctcagatctcaaatggtttttcacattcaaaaacgtgattttaaagcaatgcctatatctctaagatgataattggcttatactgcagttccttattatggtcctaattagtgtgcaagtttctgggtatcaaatcttagtactcaattcctattaag

SEQ ID NO: 199369 - DNA, 452 bp, Homo sapiens
acacatggttctgccaaagccggaagccggagcgagaggagggaagcactgctcatagaatatttggttgttccaggccagtctgaggtaaagttagccccctcccagggcccgtacacaggcaaacctagaaaaaggcacaggatgaggaaacgaagacccagggaaatggaagctgagattttaagagtcagccacaaagttgtcctttcattttgagtaggaatgttgtgtggtgctgcgggggttgggtggggccagccaaaaaaaatcaaaacatcttgtgcttatcactgaaatgctttgtttaaataattctatttgcctccaaaatgtaagttccaggttagacagatcaaaagcaaccagtcttgaaaatgaagctttttaaattccagccgcgctgttggaacagagaataaaggctttgtttaaacatgcattcccagcag

SEQ ID NO: 199370 - DNA, 674 bp, Homo sapiens
taccaaataaaaaaacttatggtttgtttttacttaaaaaaaaaaccgccaaaacaactagattgttttactgataagtgcaaccactttacattaaaaaacaattaaaataatgtatgcagtaatatggttctaataagaatcttattgaatttcaatgtacgtccctttagcgctctacctcttgtattaacaaaagcacaggaagtcaactctccctacctctttcttctctacacctaagcatccaacagtttcataaggtctctttatatttcatgttgcaggacacagttttcaacacaaccttcactcacagctaattccagtgtattaaagtactctcaatccttagaacaggctttaaaaaaagccaggtgaggaagcacgcatctgtagtcttggctactagggaggccaaggttggaggattgcttgagcctaggatttcaagaccaacctgggtaacacaggagactccatctcataaaaaacaaacgactgagctttaattatcaagtcttaaggaatctaaagggaggatgggagacaaaaagagattttcagggggagtgcgaggcaactggcactttaaaggagtactggatttgcaaaataaatagtgcacaatatcctaaatgtcctacataactttcaagtgttcaagaattact

SEQ ID NO: 199371 - DNA, 292 bp, Homo sapiens
ccctttggtcatgatagtgagtaagttctcatgagatctggtagtttacaagtggatggcacctcccactcttgctctccctctgcccccatcatgggagacacctctcttcccttttgccttcttccatgattgtaagtttcctgatgccttcccaaaagtggagcagatgctgccatgcttcctgtatagtctgaaagcaccatgagctaattaaatgtttttttctttataaattacctagttttgggtatttcattatagcaatgggagactaaactagtacagatgc

SEQ ID NO: 199372 - DNA, 393 bp, Homo sapiens
tttcctttccaatctgaatgccttttctttctcctgctgtggatagaccctcaagtataatattgagtagagtggtaacagcagaactacctctatttgtagatagcggtgagggcgtactgccctcaccgctaccgtccagtctcgactgccgcgtaatttcactttctccatgctgatccaggtctctaccctctcacccttaattcatctgataacataatctgctactctcaatagaaaattatatgaaaagcatgaaacatctttttcacattcttctacctaaaaaattgcctacacccacatgcatcctttatcttctatccttcttcatgtgcaaggctaatttcttgcaattatgctcatccctcagatgaattgggtaccgag

SEQ ID NO: 199373 - DNA, 141 bp, Homo sapiens
tactgggattactttccattaaggtatataattttagaatatctcacaaatagcccatgcaaaatcctgcggaaaggcaaccataaatatagagagaatatgtaaaaaagtggcatggtctagtatatgccaaacaaggca

SEQ ID NO: 199374 - DNA, 439 bp, Homo sapiens
caggctccccatctcccaggaggcagaggatcaaagggctgcacagtcatcccttttcctgtgaggcttgaccagttcatctttttatagccctctgtgggacccgttttctacctggttattggctgaggccaccagtgactgatctattcttcctgttctggccaattcttagctttatttaaaatgatgtggctggctgacagtacctacccatgtactcttacctacataaagaaaactgtgtctatacatcacagacaggtcactgtctaatcaaacacaggacatcagttaggttcatgcatgattataagaagccctggtcccttccccaacatcagactgtcacctttctatagccgtacgcaggggagtttgttcctgtagaaggcttggtaattacaaaggtcaatgattgtcttatccttgcactatg

SEQ ID NO: 199375 - DNA, 383 bp, Homo sapiens
taactaaggtaatcaggttccttagttcagaacacactgtcatcctggatccatgggaggcgcccttagttttccccactatcctggcctgctccccaattctcagacacccagcctcatgtgcctgatatgtaaccttgtcaagtagatagtgttcttctgtgtgggtgttttgtttacataagtgatgatatgctataaatcttagttctgtttcttgtcactccacataacatttttagaatctggccttgctggtggttgcacatgtgtttgttgcttctcaataataccgaatattctatagtgcacattcccctagtatcagatagctaaggttgccctcaacttctcccatgaaattagcaccacaaccaagcaac

SEQ ID NO: 199376 - DNA, 314 bp, Homo sapiens
  misc_feature (314)..(314): n is a, c, g, or t
tcataagaaatgctgatggggacagagcgccatgtgccaggctctctgccgagaacctgacatgtcctcagtcctcagaacgagcctatcaggccggcaatgtttttacatccatctcacagatgaggacacaaaggtcccgagaaaagtcatcaaacttactgatggctgtgaggacagaagagtaggacaccatctgggaactaatggcatacttcaggtaggacaagatgagaggattgggggatggtccaatcatggcctgccctagtaacgcatctgccaggttgagaatatcccaggtggctcctttn

SEQ ID NO: 199377 - DNA, 592 bp, Homo sapiens
ctcaaaaaaaagaaaaaacaaaatacaaacttgccaaataataccattaagaaattaacaggaagccatacaatagaagatatttgcaataaatataacaaataaagatcctgtatctataatatataaagaactcttccagacaagccatttgaaaaattgacaaaaacacaggacaccttattaaaatggagatctaaatgaactaaaggtctaaatgaacaagtactcaatatcattaattgtcaagtaaatgcaagataaaaatataccactttgaaattagaactcttgtgtactgctgctgggattataaaatggtgaaactactatagaaaacaatatgaagaggttcctcttaattaaaaatagaactaccagatgacaaaaaaattaaaaatagaattaccccagaactcctgcttccaggtatatatcaaaaaaaaaaaaatggaaagcagggtcttgagatatttgcagactcatgttcatagcagcagtattcacaataacaaagaggtggaagcaacccacatgtccactgatggaaggataaatgtggcgtgtacatacaatggaatattattcagcc

SEQ ID NO: 199378 - DNA, 274 bp, Homo sapiens
cttatctgccatgctcaaatctgagagataagtagatatcaagaaacttccagccaaatgtctcatctttatcctgggagcatagaccaaaaactactcacactagctaaaatagaaaagaaggtgttttgaacagacacaagaggcaatctcttgaggcaccaaagtgcagggttcagcatagctagggagcaaaatcaccaaaaagacacaaaaatgatcaaaaacgtggcactaaatagactgcgataagattcttgtctacagtataaca

SEQ ID NO: 199379 - DNA, 585 bp, Homo sapiens
aatataagaactgttactagtaaattgagtaaagcaggaaaattaaatttggtctcttactgatcaaccattattagattgttgataacaacggttataatgttgatcaaccgttatattgttgatacaattatatttgatgtatttaaccagattttatatattatattctatattttataacatgtatatgtatcatataacatacacatatacatacacacacacagccaatataatttcactctcagtttcttgttaatcaactattatattgttgatacaacaaatataagaactgttactagtaaattgaataaagcaggaaaattacatttgggagccttaaagatgtaggttttcttcaagaaatttatgttatagttatatcccctgttgcatgtgaagacatacattcaaggatacttactgcagctcacacaatttgctgataggttggatgtgggtgtgagagaagagatgctgttttccttttgggcgatggcaactggatagtaatcagttactaagatggagaagaatgagaaagaagtctttttttgtttgtttgttggagtgatatgg

SEQ ID NO: 199380 - DNA, 194 bp, Homo sapiens
gtcgagtacgtaacatgttctttgctgcgttcattacactagcatatgaaatacatcataaaatgttttactggttgcactatttcctataaagcttatatgccacaatttcttttcttttcgtttttttttttttttttttttgggaaaggggtccccccttggtgcccagggtggagtgccggggcgggatt

SEQ ID NO: 199381 - DNA, 265 bp, Homo sapiens
cattattcaacctgaaaatggtcagcatatttaactaagtgtgaataattaattttattaaactatggacaattagttgatctggttctattatagatgagatatatatgactataatatggctcttcattgaaatagatattatataacattaaatgttgaaaatccagttatatttttatatagaaagtaggcccccacacactcacttcaaactttttaaaatcaacattggaggtacaatttataaataataacactcatc

SEQ ID NO: 199382 - DNA, 693 bp, Homo sapiens
tccaggtgttctcattgttcaattcccacctatgagtgagaaacacctatgcggtgtttgggtttctgtccttgcgatagtttgctcagaatgatggtttccagcttcatccatgtccctgcaaaggacatgaactcatccttttttatggctgcatagtattccatggtgtatatgtgccacattttcttaatccagtctatcattttatggtgttctcagtttacatatttaaatcactaaactgactatttgacttaaaaggctcaaaaaaagtcatctcaaaaatacaacacactgcataaccttttataagtatttgtgtagcttcttgaatttatatttttaaatcattctcatttaacttgtcagggccttttcctgaaagccagcagagtgaaatcttaacctgcagttaagccaataaaatttgtcagcttataaccaattttattattttagattttctggactctctccaactatagtaattctcatgaaatcacattcctgccatccccttggggaaaattttatttcttaaaattgcatgggaaatgagagcttttttaaaagaaaaaaatttttatattcaaatgagatgtagtggctttgtgccatttcttatttgtcacaaggggtaagatgtttaaaattgctatatcttatatataaaaatgtacctttgaataa

SEQ ID NO: 199383 - DNA, 320 bp, Homo sapiens
ctactatgtatgtgcaagaccctgtgctaagacaaataaaacataatcccagcttttaagagagcggctctcaagttttcggggttgtctgcacaccttcgtaccctagaccttaaactgactccacacttatcccacctttacacggtataagtagcactgcttcctgctcttcttcctgaacattgtcttctatgcccgggaggcaacatgcctcggttgttccttagtgctggcttgactttatagtatcttcctccctctttctctaagcaagttgtcccactaggtacttagctcattgtttcttctagtagaca

SEQ ID NO: 199384 - DNA, 341 bp, Homo sapiens
tgtgctggtctgaggagagggagttccctgtgtgcttcctaacgccagtattttcatcaaatgagtttgacctgagagtgatgttgaaagggcagacatgagcatggggtcagcgtgggggattgggagccagtgtgaaggggcggtacttccgtggtgggttgttcggggccattgagtgtatgtgcctattaggtttaggggggcacctgccccctccttcctggctggtgtaactgtgtttgccacagtgagagttgggcttgtgggtgcagcagggctgggatgtcagggactggttccaaagatggtttttgctatgtggccagggaaaaaactag

SEQ ID NO: 199385 - DNA, 655 bp, Homo sapiens
agctgaagtcatctggaagcttcacgagggaaagacctgcttccaggctcactgtgtgactgtcaacatgtaggcctctcagatacagcaattggcttcctccagagacagcaatcgcagagagagcgagagtgtacccaacccggaagccacagactttttataacctggaatcatcagatgcaagtcactccatgctcaagtggaggaaagcttagctccacttcctgaatgtagaaatatcaaatgaatggccaggcacaatggctcacacctgtaattccagcactttgggaggccaaggcaggagaggatcacttgagctcaggagttcaagaccagcctgggcaacatagtgaaacctcttctctataaataatttaaaaattagccaggcacagtggtgcatgcctgtattgccagctactcaggaggctgaggtgagaggatcacccgagcctgggaggtggaagctgccaacaggttgagtgaaccatgattgtgccactgcactccagcctgggagacagagcaagtccctgtctgaaaaaaatccaaaaacaaacaaacaaaaaatattctgtaggggccagtggaaaatttcttctttgcctctaaggagccctgaatcattgacaaagcaaataatggagaa

SEQ ID NO: 199386 - DNA, 447 bp, Homo sapiens
taccccttccccacagtgagcctaagctttcctgcactccccttcatttgacagctttaataagttttagtcttatatgaggccagctagtgtcagagcatttctgtccatctgtcagtctccctggtgtactctttgctactttccctgaacatcgtaacctcttttcagctatttttaaccctgtacttgggagaaacagccaactatctagtggaaatctttaggccaccaagtttcttttttttaagttttattttacttttaattgactcataataattgtacatatttatagggtatagtgtgatgttttgatacacgtatatattttgtgatgatcaaatcagggtatttagcatatttttcacctcaaacatttatcatccctttgtggtaagaacattcaaaatcctcactgtgggggagggggatctctagaacgag

SEQ ID NO: 199387 - DNA, 200 bp, Homo sapiens
tttttgaggatgtatgccctgtgcctgcctctgttttttgaggacttatgccaacccaaacagttgtgatcaactaccttagaccccagtttaacatagttgttcggactgttctcagcaaaataatcatttggccagttgtcattcagcaaactgacctaaaaccatcaaataccccaagagagctgccaggacattat

SEQ ID NO: 199388 - DNA, 518 bp, Homo sapiens
tacatatgtgtgtgtgtgtatatacatatgtgtgtttgtgtatatatatatataactttacaataatcatcttgtatcatttttgcaataaggatttgtatatataaattaatagaaatactgcagaaatatatagaactccttctcaggtctgtactggaagtcgttgcttattcttgtattcccagtgagaaaacccagaaaagcagatttctttaactgactctttgcatgtatggaggctttattcccctatctgtgctttcttatcaggaatattaccctcattcatttatgcatttaatcagcatccattagttgattgccagaaatgtgccggaatacaagatgaccaagatcatccctctctgagccttcgctctgttggctgtaaagtagaaatgataaaaatacttcctcataatgttgctgtcagtagaaaattacgtcaagtgtgtacagcacttaacagggcttggcacataataagcactcaataaatggtagctttaatcatc

SEQ ID NO: 199389 - DNA, 417 bp, Homo sapiens
ccttccaggggaggaaaataagttctgggagatctgctggtatagaaaagtgggacagtgtgctgggccctcgtcttccaccccgggaggctgacagtatggaccacatccgtgggatctctggattctggttgagtctgccagagagagtcaggctccctccctgattctccctgtggaaaatcacatcggactggctctggcccttgaccaaaagtcattgtgtttctcaaaacagcctgctttatacagctttctccagggttccagtaactgcatccttcccctgccctcccggttcagggtggtaagggctctgctatttctcctgagttgcagtgtcatctcctatagttccctgcacctcattctctcttgtgtaaaatgtcactaattaaatatccttcgatgccccta

SEQ ID NO: 199390 - DNA, 273 bp, Homo sapiens
aggctgtaaggtgaaggagaaaactgcagaaatctccgaaagaagacttcccagcaagctgtgagcacgtctacctggcttactgaaggaacggttatggtggtcattttgtcatgggccatttcatcagagggtcttctgctaggagtactgggagccgggtcctgcagcacccagtgccccggacagtctcggtccagaacggcgttgaaaaaatgtgtgttaaagggagctgggatccgaggcttcttgccctgtgtaccctgagccaag

SEQ ID NO: 199391 - DNA, 684 bp, Homo sapiens
gcaagagctcactcattaccatggggaaagcaccaatccattcatgagggatctgccctcatgacccaaacacctcccactagcctccaccttcaacactggggattctatttcatcatgagatttggagaggacaaatattcaaaccatatcaagcaggtctctagaacttatcatcttgtataataaatattatatccattgagcaacaattcctacttctcccttgctccagcccctggtaatcacaattctattctttgcttccatgcatttgactattttagatatcagatgtaagtggaatcatgtagcgattgtccttctgtgacacgtagcataatgtcctccaggtccatccatgttgtcacaaatggaaataaatgttgtgaaaaatgtaaaagagggtaatggcatataaaatggtgagaagtgagtgatgtttagataagcgtgattaaaaatggcctctgagaaagtcatccttgatcagagacattaattaagtatgggaaataaatgcatgaagatctggggtagagttttcaaggaaaatgaaacaacgtgcaagacatctcaggctggaaagaatttggcacatttaagaaattgctagaagggtgatgtgtttagtgtggcatgaatgtgggagaaagggacagaaagtctaccacttctgaaaat

SEQ ID NO: 199392 - DNA, 325 bp, Homo sapiens
cctattttataattcctttttaataaaatattcagaaaaagcaaaactgtggttgcctgaggctgaagctaggaagattgactacagacaagcatgagggaaattttgggggtgatgagagttttctaaaactggattgtggggttggttgcattactgtataaatttattaaaaatccctgcatcgtataggggcactatattgtatgtagaaagctgtgaaaagattttaaaaatgattgacatgtctgtggttatatcaatgagtactattattattcccattttatacataaagaaaataaaagagaagttaaaaataaaa

SEQ ID NO: 199393 - DNA, 385 bp, Homo sapiens
cactctagagtatcccctccccgtacgcccaatgttgggcatcaagatctagcctttgaaccttctatgagccctgttgtcagtacctctggggttctgccagttacgcttaattttgacatattggtcagactggtgctggatgaacttcttggttctttttttgacaatcttgggctccacaaggagtctgaagttggccctgatgccaaggaggagatggcccctctttctttctttcttttctatcacagtttgccctgaattgtagggaagctggcagttcttttactcttgtggggtcacgaaatgaactgttcctaggaaatgcattgcgctaacatcctggagtggggttgctgcaggtaatggaggttgggcgtac

SEQ ID NO: 199394 - DNA, 552 bp, Homo sapiens
tcttgagattatcatcggctgatggtggaagcggaatccgcagacgctcagcaggtatcttgatattatcatctgctgagggtggagctgagggtggaaggggagtgagctgacgctcccggaaggtgtcttgagattatcatccgctgagggtggaaggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcagcaggtgtcttgata

SEQ ID NO: 199395 - DNA, 298 bp, Homo sapiens
ctggaatagacatgttgtctgtccagcctaggcacctgcttctcataatgactaatgccagatgttttaaggaaagatacaagcttctattacacatccgctttatgcaattatgcaatgatatatcacaagggagttttctttctctgaccctgggttagccatcagttgcagcctagtatttcaagataccagcccttgaattcattaccccagcatcctttactaaactatttcataacacacacacacacgcacacacatatacacacacagtatttgtccaaaatgctccctt

SEQ ID NO: 199396 - DNA, 470 bp, Homo sapiens
atctaagaataaggaattaaaccaaatacacaggtgccaacattggttttacagttatactaaagctcacatacataggtcataatagttctacaagtcctgactgtaggcccttagtctattttggattaagttctatagcagaattgtttggtttaccaaaaataaagtcagtcatggacagttgcaacaaataataaactggtctgatagcgaaggaagagatgttaaaaactacctaagagaccatgtgggccccatttgcctctgtgatgtggtatgctataattatggggccattatgaaaaggtcaaatatctttagttaggggcccctgcttaagatggcagggaaagtggaaggaccacttctttctggattattgtcagtatatcagccttaccagatgtacctccagtatcttgtcacctagggcattttatagcttattattttagatacaagttaaa

SEQ ID NO: 199397 - DNA, 365 bp, Homo sapiens
aggtcaggagatcaggaccatcctggctaacatggtgaaatcccctttctactaaaaatacaaaaaattagccagacgtggtggtgggcgcctgcagtcccagctacttggaaggctgaggcaggagaatggcgtgaactcgggaggcaagagcttgcagtgagctgagatcacgccactgtactccagtctgggcaacagagcgagactctgtcacaaaaacaaaaacaaacaaacaaacaaaaaaacttaaaataaggctgggcctggtagctctcgcctgtaatcccagcattttagaaggctgaggcgagaggactacttgagcccaggagcttgggcaacatgggagaccctgtctatac

SEQ ID NO: 199398 - DNA, 511 bp, Homo sapiens
gatgattatgaagataatatttatagaaactatgcaaaacaagatataaaaaataattgaagcacatcactacacaattaaaatgaaatttaaggcaataaaccaacatataaaaaataccactgaggaacacataaaacaatcacaataaaagtagtaacttcatttttaataaataattttaaatataaattaaactacttaatagaaaaaaatataatctcaggactttgagaggttaagatgggctgatcactggatctcagaagtttgagaccagccttggcaacgcggcaaaactgtctcaaccataaatacaaaaaaaactagctaggtgtgatgctacacacttgtaacccagctacctgagaggctgaaatgagagaatcttctgagtttgagaaactgaggctgctgtgagccatgatcacaacactgcaaaccagcctggttgacagagtgagacctatctcaaaaataaatgaataaacaagtaaataaatgaaattat

SEQ ID NO: 199399 - DNA, 515 bp, Homo sapiens
ctgacagaggagctgggacatgactaaacagcaggcaaatgttgatcccctgctcagcctagtgattgagagcatgtggtttaggactagggaggcctggattctgttcccagctctgcctcttacagactaagcttacctggatcttctaacttctgtgagcccaatttcctcacctgtgaaatggaggttaggatacttacctctcgaggggttgtgaggattaaatgaaatgatattatatgagatatgacttagtacggtgagtaatctcttctaatgtattggttacataaatccagatttctatggatcagatgttattaaagcaaaatataattatactcctgggactcatgcagcacagttctgttcaagtcagtaagcacttttgagggcctactatacgggaagtcctgtgctaggtgtagttgctacgaaagtgagaggcagtacctgcccttacattgctcactgcctagtgacaatatacacagcagaacgccagttctaca

SEQ ID NO: 199400 - DNA, 351 bp, Homo sapiens
ttggcatataagaatacttttgccctcactttccaatatgtttatctcctgtatttcctttccttcttattggccagtgtttgttctgattggttgatacataaactctactgtttaaataacttgtgcatcacccctgtgctatatgacatgtttctactcctctttggagtaagaagaaggtaaatgtgattcataatgaacctatgtgatttataagtgtgcttcatatcaaaaattagcatatatttctttagttttcatcagctgcctccaagtcgattgctccttcaccctgacattctctccaccggcttcctccaaacatggctcatctgaaggccttttccc

SEQ ID NO: 199401 - DNA, 692 bp, Homo sapiens
taaatagagacggggttttgcccggttagcctggatggtctcgatctcctgaccttgtgatccacccgtcgtggcctccccaaagtgctgggatcacaggtgtgagccagtgcatcccgcccccttcttttcattcttatttaacaaataatgagtaattataatgggttcaagttttcatcatgaaaaaaaaaaaaagaaataagcaaggacgttttgtatgtgatgacttgggactctctcccaagtgctttatgtacattgattcattaacattttcattgtaattctacaagtcaggtactgttactgtctttctcttattagagatttaaagcacagagacatggcataccttgttcaagttcacattagtaaatgatgaggattgctgtcctatatgtgatattgaatgcttatagtgagtagactgggtaaatgaacatgacaatacacactgtatagacaattttaataaaagtatgtagatcatctgttgagaatgtattcctgcaaatctattgtttccatcatgattcctcaatctgtaatatacatacaggatttggctcctaattataagttctgtgggccttcattatgtattttcctgaactccacatgctgggacatttaactagaatttgttctacataaccttctgccatttttgagtttaacaggcttagaag

SEQ ID NO: 199402 - DNA, 458 bp, Homo sapiens
acatcagatgcataatgtactctatctgggatattagcttctcggtcttgcagtgttgcctaacacacacagtgatcagcacattttttgagactgcaataatcagaggaatgtaacagtgatgtgggaacaagaggaaataacatggaataataatgtacccatcattgttctgttgtcatccctcctagccagtttggtttcccttagagcctaacaaaagcttcacgaattcaatggaataaaacatggaactgggtgcaaaattaatacatctattcccaagctccatattcatagaaaaaaggaaaatattgactacatagggaacagactttccctgaaagctttgtggatctatgcatatgcttatgtaatcttcaaacaagttgtgcagccttttacaaatgtgtctagcctcatttaatctcaagtaagcctgtggataccacaaagga

SEQ ID NO: 199403 - DNA, 294 bp, Homo sapiens
agctctaagtgatgctacacggaaatcaggtgagaaaggctatggttgatcaagaacaagaatgagcagccacatttcaaagcacagagctcttctaaaattgtccccgagcgggagtctctgagccaacaaacccagtgggtttcttaaccctttttttcttttattttcacctatttccatgcagtgtaagaaaatcctcgctctaggttaagctatatttttaatcaccgttaaagcagtaggttgttcccttaggatagctcctccacccactccaaactcaccccacag

SEQ ID NO: 199404 - DNA, 481 bp, Homo sapiens
agaaaccaggtgcagggcttgccctcttgacttggggttttatatgctggcatacttccgggatcttgtgttacttttccccactcctgagatctttttgagaagctgatgatcagtctcaggtgttttctattgcggggggggggggcgggcgggggagctgcctgtccctggcaccacctgtgaccaattattactttacagaaacatttaacaaccgcctgaccatcacctgatggttgcccaacactcttggtgtgtgtcgggggagccctctcctgccttgctcagacctgaatgtacccattgtaacaaaccccttctttgtatactttgatatggtgacatttcttgtcacttgcctcattgtgaatttttatagatgtggctaagtcatatgcttccttctgaaaaattatgtcaaatactagcagtttctcactgttttttgccctagaaacaacaaactaaccttgaagtg

SEQ ID NO: 199405 - DNA, 463 bp, Homo sapiens
ggaactttttaagcttggcagacattttagttaagaacacttaatttaatgtttttagatttcctttttattaaaacagctcagtaatctgttctcaggtttaaagcacagattttaaatactataaggaataattgaccattaactttcttatacataccctaggtttaaagcttttggtaattgaagcaattcttgaattttgttattgtcctcatccctgatgcgaagtgaaacctggcttcatttggattcttcctccttattgacttgataatatggtgggaggctagagggtgttctaggcaaagacacaggactgttccagcaggcacagaatgttagtttcattcctaatcctgtgtaatccgtattatcctcaattttatgtggatgccgtttccattacaggaagggtttaccaagccttaactacaaatttttgtgggataaagctctgtgc

SEQ ID NO: 199406 - DNA, 567 bp, Homo sapiens
gaatgcatgatgggagccctcaaataatagaagctaggaggtcacaattaccacagtaactggcatggttagtcagacagccaccgggactagagccacagggagttgtggagatggttaatggagaatgatgtccttagaggcaaaatagacaggcagccaataagaatgttacttaacatccataacccacgaagagcaataataaaggagcaggaagctatgggtgattgcccccagtaaaaagccacaacttcttgtttagttctcaaactcaagtcaatttgcagatctggaacccactggctgaagtgatgggtccccaggaggaagaatcttacaatgccatggcaaatgtatgccatgacaattcctccagctcttccccaaaggtacctatgggcatttactcatgtgaccatatgctggggaaaggaaataaccagacatttcaaggtctgttgaatatgggatgtgagttaacactgatacccagaaacctgaaatatcatcatagtgcctgttacaatgggacaaggtaatgaatggagttctgtctgaaatctg

SEQ ID NO: 199407 - DNA, 231 bp, Homo sapiens
agttactgttattgacaattccctagagtattgtccagtagatgggtgaggggagttcactaagtattcttagtgtctagtttgtaattagtttatgagacttaaaaccccaccacacattattctgaacctgctgtaaatattatgagaggcagtatgtatagttgcctctggagctggagtgcctggatttgttttccagctttaccatttgctagctgtatgaccttg

SEQ ID NO: 199408 - DNA, 386 bp, Homo sapiens
gaaaggcacataggcccagtaagtataattagctgcagctgctcctgcagacatagtgagacttaccaccattgatacaatcattaaagctgcaagcagcatattctctggagtttgtgttacccttgtgtactttaggcttttttcagctaactgtgtcagcttctttagctgggcccaggtcggcggcttcgcttttttggtggatggcaactttttctgtaagttgtaggtacccaaactggaagctgattttctcctggtgaaacacgagcaaaacctctcccccacgttatcaccttctctattttttatgttttatttttgttgtctttttaccaaatcagtttttcctcatgtgggctgttctttttaccagtaaaatg

SEQ ID NO: 199409 - DNA, 212 bp, Homo sapiens
gcacaggtttaaatcctgggccctccacttaatatctgcgttaccttgggcaatggtttagacctctctaagcctcagtttcttcttctacaaaataggctctaacagtagtttctacttcatggacttgccatgaggactgaatgagacaatgagtggacggtacttggcatgacacccagcagagaaactacttgccatctggcttctga

SEQ ID NO: 199410 - DNA, 427 bp, Homo sapiens
tagcttatttgcaagccatctgtgacggcggggggcaggtggtgcccgctgtggcaccgtgctgtgtgtgttccctttgcatccacttgctgactcacccaaggtcacaggtagctagtggtggtaggaccacagggtcacgtccaggaactttcccaggatttcccaagaaatcaatttatcaacaaaagtaatcttgccagtgttagaccactgatcagcttaagtctgtggtcttgttgttattttcttctttttttaatccagtccctgtttgagtcaatatcaaaaggaaaccaagtgtctgctgtatgcacggtgcccatctaggtctgtggttttgtcctttgacataacttgtcttcttatgtggttctttcatggagaccaggaatgctagtaataaaatttgataccacctaaaacc

SEQ ID NO: 199411 - DNA, 442 bp, Homo sapiens
acaagaattttcttttcttcatatcctcaccagccatttttatcttttgtttttgacttaacaggattcttatttgctaaaggcaggccagcatgataaataatgtgaattgggggtggggagtgaggaatttgatcagatattgagagtaatcaactaccaaggtggggcacttccactaaactgactcagcaggatcttgctggactaagtggcccaaagacagaggctaaggtagggacctagtcaagaagaagggccagaggagcctgactcaggtttggtcgaggacagaatctttgttacagatagcagcaaatgcggccaggacctggatggatttggggaactcccagctataaacacttgtcctggccaggtgcagtgggtcatggctgtaatctcagcactttgggaagctgaagcgggaggatcaccactt

SEQ ID NO: 199412 - DNA, 900 bp, Homo sapiens
gcacggagttgcgtcccggggacttggggccgcagggagctgtgagtacccaggaagctgcaccgtgtggcctggagctgtctatctgtccttccagccacctgtctgtccagccacccttccacagactgaggcttgacaccggagcatctgtacagagcaaggagaagacaagaacatgctctaaagcccttcacagcaagacccaggaagccgcgggcaaactcagactcgaagccctcccgcctcctgcccacaatggcctctgctgacaagaatggcgggagcgtgtcctctgtgtccagcagccgcctgcagagccggaagccacccaacctctccatcaccatcccgccacccgagaaagagacccaggcccctggcgagcaggacagcatgctgcctgagggttttcagaataggaggctaaagaaaagccagcccaggacctgggctgcacacaccaccgcctgccctccctccttcctccccaagaggaagaacccagcctacttgaagagcgtcagcctccaggagccacgcagccgatggcaggagagttcagagaagcgcctggcttccgccgccaggcctcactgtcccagagcatccgcaagggcgcagcccagtggtttggagtcagcggcgactgggaggggcagcggcagcagtggcagcgccgcagcctgcaccactgcagcatgcgctacggccgcctgaaggcctcgtgccagcgtgacctggagctccccagccaggaggcaccgtccttccagggcactgagtccccaaagccctgcaagatgcccaagattgtggatccgctggcccggggccgggccttccgccacccggaggagatggacaggccccacgccccgcacccaccgctgacccccg

SEQ ID NO: 199413 - DNA, 813 bp, Homo sapiens
gcacggagttgcgtcccggggacttggggccgcagggagctgtgagtacccaggaagctgcaccgtgtggcctggagctgtctatctgtccttccagccacctgtctgtccagccacccttccacagactgaggcttgacaccggagcatctgtacagagcaaggagaagacaagaacatgctctaaagcccttcacagcaagacccaggaagccgcgggcaaactcagactcgaagccctcccgcctcctgcccacaatggcctctgctgacaagaatggcgggagcgtgtcctctgtgtccagcagccgcctgcagagccggaagccacccaacctctccatcaccatcccgccacccgagaaagagacccaggcccctggcgagcaggacagcatgctgcctgagaggaagaacccagcctacttgaagagcgtcagcctccaggagccacgcagccgatggcaggagagttcagagaagcgcctggcttccgccgccaggcctcactgtcccagagcatccgcaagggcgcagcccagtggtttggagtcagcggcgactgggaggggcagcggcagcagtggcagcgccgcagcctgcaccactgcagcatgcgctacggccgcctgaaggcctcgtgccagcgtgacctggagctccccagccaggaggcaccgtccttccagggcactgagtccccaaagccctgcaagatgcccaagattgtggatccgctggcccggggccgggccttccgccacccggaggagatggacaggccccacgccccgcacccaccgctgacccccg

SEQ ID NO: 199414 - DNA, 829 bp, Homo sapiens
gcacggagttgcgtcccggggacttggggccgcagggagctgtgagtacccaggaagctgcaccgtgtggcctggagctgtctatctgtccttccagccacctgtctgtccagccacccttccacagactgaggcttgacaccggagcatctgtacagagcaaggagaagacaagaacatgctctaaagcccttcacagcaagacccaggaagccgcgggcaaactcagactcgaagccctcccgcctcctgcccacaatggcctctgctgacaagaatggcgggagcgtgtcctctgtgtccagcagccgcctgcagagccggaagccacccaacctctccatcaccatcccgccacccgagaaagagacccaggcccctggcgagcaggacagcatgctgcctgagggttttcagaataggaggctaaagaaaagccagcccaggacctgggctgcacacaccaccgcctgccctccctccttcctccccaagaggaagaacccagcctacttgaagagcgtcagcctccaggagccacgcagccgatggcaggagagttcagagaagcgcctggcttccgccgccaggcctcactgtcccagagcatccgcaagtgagcccccctacacccaagcccagcaccccccacccagcaacctgtggattctcggggcctggacatgattgggcctggtccctgcgtcccctctctggaaggaggaggccggcattaatgagcatgtctccctgtggcctattatcatggtatagatggggaaatggtatgtgctttgcgaaagtcacgatgtgtcggaggctggggggc

SEQ ID NO: 199415 - DNA, 443 bp, Homo sapiens
agaaatgtcatcagtgaataacatttaagtaatgtgctttctgatttttttccctttttttttttgagacggagtctcgcactgtcacccagactggagtgcagtggcgcaatctcggctcactgcaacctcctcctcctaggttcaagtgattctcctgcctcagcgtcccgagtagctgggactataggtgtgcaccaccagggccagctaatttttgtatttttagtagagatggggtttcacaatattggccaggatggtctcaatctcttgacctcgtgatccgcctgcctgggcttcccaaagtgctgggattacaggcgtgagccactggtgcccggcctgtgctttctgattttgtgcaggattgataaaaagatgcctactactgaagaatcacccccaaagtatttttccattatcttaatgtgtctttgaga

SEQ ID NO: 199416 - DNA, 851 bp, Homo sapiens
atctcaaaaaaaaaaaaaaagacataaatagagcagtggaatagaatacagagcccacaaataaaccctcacatagatagtcaaatgatcctcaacaagggtgccaagatgaccactcgacgaagaatagtttcttcaacaaatggtgttgagaaagctgggtactcacatgcaaaacataaaggtgcatctctgccaaaaaattaactcaaaatggattaaagacttcaatgtaagacccaaaactgtccagtgtctagaagaaaatacaggagaaaacatagggtgatgagacaagatggtgggtccttgcaccatcatccccagacccatggtttttattccacaggggaaggatggtttgtattctacaggtgaagtatgatcacatcaaggttgtttgactccagggcaggatttatgatacgtacctgctcttacacaagaacgatagatcaactggaaatcttagaggccttcccagaactggggttaatcagaagctgccatggcagattagcttccaagatggagttgccttagcctccacaatattaaaagtagaactaccatatgatccaacaatctcacttctgggcatctatccaaccaattgaaagcagggtcaggaagaggtgtttgcacaccgatgtttgtagtagcattactcaaaataccccaaacgtagaatcaactgaaatgtccatcaaacaaaatacggtgtctgtagtccaagctactcgggaagctgaggttaggagaatgacctgagcccaggaggttgagggtgtagtgaactatgattgtgccactgcactccatcctgggtgacagtataagatcctgtctat

SEQ ID NO: 199417 - DNA, 127 bp, Homo sapiens
ttggccttatgcataggaaaagaaaggcaggtggctggtgtttcttcacctgttctctttgatatcatctactgctgcttctgctcttttctcgtttggttgctgctatggtttggctgtgtccccg

SEQ ID NO: 199418 - DNA, 273 bp, Homo sapiens
ccagaagaaaacatctctacattgagccctgtttctaccttttctttgaactcaagagatgaagacttcatggtagaattctctgagacgtccctgaaagcaagaactttacctgatgatcttcattttctcaacttggagggtagtcgttaccacattgctctaatatctgtctattcatttaagatgaagttttttatttgagagattattacactaaatatatcttagaaccagattcagtgtcatatcccttgaagcctttccataacc

SEQ ID NO: 199419 - DNA, 647 bp, Homo sapiens
accagtataccagctcaaagagtttgaacctcagctgcagatggtgagctcacaccttcttccttccctccttttcggtgccttcctctgcggttattcccgtgtgctgaagttctgttttaaccctcctgggattgccaggttggagcccagggcaagggaaccgaccaggcaggcagtgttgaatgccagccctcctgttcttgcccaagatgttgtcgttccacttgattcatgagcctgcctgcatgcagcctcctcatggagacattgaagctgtgccagtgcaacttggatctctcttgattcacctggaaaactttcacttgtgtggacttaaacttaattctagagtttggtagcctctttggtgaggttatgctggttgagatatgaggccactacatcaaaaacattggtgtgtttttcttttgacaatagacttaaagctttaaagaaagtggccattaggctggtgatatttattacttgggaaagtaacataacacagagaagtagatgggtgattaggtctgcactctttatccactttttgggagaagaataacaactcatttgaatggaaatggtatccttagctcgtgctgctttgggacttggaactttatcacttttaatctcaaatg

SEQ ID NO: 199420 - DNA, 437 bp, Homo sapiens
tagaaagctgcttgggtgtggaatgtaagttgaaagtgagactttcacactaggggcaaactttgcaacagaggaaacaattgtagaaaaaccaatttagttaattgtctttgtttcacctgctgttcatgtgtacctggagcttgctgctcccctgaagcctagtcttgctccagtttgagtggccctgtggggtaggtcttgctgcttctgcatggatttccacatgtctcagaggttagggttaatgaaaaagtggtatttgcaaagggtttgaggagtggctctaggacagtgatgtttgttgccatggaaatgaatacagtctccaattcatcactatcatctcagcaggacttgggagaggaatagccaagccagagaccttacaagtttggtcacagatgcacccatgaactagcaagagaagtggagga

SEQ ID NO: 199421 - DNA, 502 bp, Homo sapiens
tatacacagagaaaaccaagtcccaagtctagatgggtgtggcaatgcgcctcatgatccattaacttatcattaagagcataggctctagagtgagcttcctgagttcaaatcccagctctgctatatctaggcagttctcatagcctctcatctataaaatggggataagagtgttttggcatagacctgctgtgaagattaagcgagagcatcttcaaagagcttttaggagcagtatctggcatatagcaagagctcaatgaatattcatgattattatattagagacagtatcagtacagtggtgtgttataaaagtttgcttttctcttaattatgaattacctatattttggactctgagttacgactttctggaccttaagagcaagggttggttcatcttcatctttgtattttcagtgcctggaatatggcaagtgagcttaataaataaataatgacacactgaatgaaaatgggagccatctgcatatcc

SEQ ID NO: 199422 - DNA, 325 bp, Homo sapiens
cctgaagttatcaaaaaaagaagaggcttagggaaaactgagcatagttacttcttaggtcggggtctccaaagtgctctgcagatgccaaaatggcttcactttcaccccagacaacaatcatgaagcccctgagagccaagtgtatgagaccctccaaaggtgcctgtaactaccaaatcagacaccaaaggagctactttcagaaagatagcaaagacctcatcttacacagaaatactaactggctttttaaaaaacatcttcaaatctgttttgtttttttttttttttttttttttagatggagtcttgctctgtcacc

SEQ ID NO: 199423 - DNA, 254 bp, Homo sapiens
gcacaaccttcttacacatatggagggtgaacttctctgtccttccctccagacgccttgagaaagggagtccaaagccccggaggcagagagttcagccagctgcagggggtgatggtgtcaccaccactatctgctgaactcctctgtgccaaggagcattgcatcagggtgctggtggcacacctggggatcatcatctcttccttctaaagcagctgtctgtctccactttgtcactgagaaaacagtaa

SEQ ID NO: 199424 - DNA, 2177 bp, Homo sapiens
aacaattcatttaaaaaaatacacatacacacacacacacacacacacacacacacacacacgtcatctaatttagcaatgtatgagaatagtggatgccattttaaaattatattaatgcctagatttgtttctagggggaaaatatggccgtgtttgcttctgatgtatataaaatctcagacatttatagtgctctaagccatagtaagagaaatatgagtgctatcaatacatgaatatttccaaactcagttctcccaactgcctcaaaactaaacactaattcaggaaatgcaagcaataacatttaaaatgtgttcaaatgcttttagcttttaattcttttatgtttttgcttcactaaagacactctcatttgttttgtcatccattgatgtaatttacactttggtaaaacatatctcaaaggactttgcagatattgataaatactcttaacctatagtctctaagataggcatatgttttagataaatgcaatataagtaataactaaccattgctgtaaataattcagctaatgtgtttttttctgagagttatcctttttttaagattttttaaaaaaattttaaaaattcaaagcaaactgtcaagaattgcaccctgaaactacatccatttgacaccactttttttaaaaaagcaagaaagacggccgggcacggcggatcatgcctgtaatcccagcactttgggaggccgaggcgggcggatcacgaggtcaggagatcgagaccatcctggctaacatggtgaaaccccgtctctactaaaaatacaaaaaattagccgagcgttgtggcaggcgactgtagtccccgctactccggaggctgagtcaggagaatggcgtgagcccgggagacggagcttgcagtgagtggggagatctcgccgctgcactccagcctggatgacagagcaagactccgtctcaaaaaaaaaaaaaaaaaaagaacaaaaaagcagaaagacaatgaaatttggtatttattacaataattaaaagtaaagacaaaatccgcaaatacttttgcaccaaccgaataatacatctgggcagttttctatattctaatttaagttagagagctcatttcttcttccactgacattaaatgtgaaaaacaataaataaatagaagctcaaaaccaaaaattattcttcattaaaaacttaccactattggccatttagcaatgagtagatttttcaatagtgtctaccttcacttgacctaataagcattcttactcatctccaactcagttagcaaggtttaccatggctttaaattgtgcaatacacatgctaccttacttcagtttgaataattttcttttgccattatgctgtatctagaatcaatgtacaattgctttttcattggccacaaatcatattaaggaagcattgaaaagtcaaatgacgtcattgaaaaactgcacagcttctataatctgcattcccgatttctgcattgctatgaccttcctgccattaagataaatttgttccatatatgtgtattttatatctagtgatgttgtgtgtgtgtatatatgtatgtatatatagtgtatgtgtatattatacagatagacacacacctccatacacatacaaaaaatatatacagaaatatatgtgtgtatagtgaaaagcaacaatatagtagagagttgaaccggtccactgatttgacattttaactgattttaacagggatctcaggttgatttttctacaactgaaattgaaatcccaagtcaaaaattttgtggaaaaatacacctttttatcctatatttctatatacatatactgcattaggccattactgcattgctataaagaaatacctgagattggccgggggcagtggctcatgcctgtaatcccagcactttgggaggccaaggcgggcggctcatgagatcaggagattgagaccatcctggctaacactgtgaaaccctgtctctactaaaattacaaaaaattagcctggcgtggtggcaggcacctgtagtcccagctacttgggaggctgagacaggagaatggcgtgaacccaggaggcagagcttgcagtgtgccgagatcgtgccactgcactccagcctgggtgatagagtgagactctgtc

SEQ ID NO: 199425 - DNA, 474 bp, Homo sapiens
acactccctgtcccgcgcccgcaccctaaccctgggcgcctatgtgtgcgtgggacctcccgcctctccccaggccccaccgcagactccctcacctgctcagaagccgccacccagggccggtccctcctcacacacatgctgggaccctgggggccagccgagcgctctcccccacaaccctgcctctctccctcacctctttctcttgccacctccctctctccctcgttttctccatttctccctccacgctttgcctctccctggctccctctcccttctcctgtcgttctttctctctggctctggctggttctctgttcgtagacccgcaggcccgggaggattcgcccaggcctctaagtattcagcgctcgactcctgcccggctcacaagcgctccgcgccctgctctggcgctatctcccatcgcccggccgctgctaatccgtgattgcttcccgcggccgc

SEQ ID NO: 199426 - DNA, 274 bp, Homo sapiens
cagatattaagagaaaatattaagatattgaaatattaagaaatattgttaaaagatattattaagagttttgaagaacaagtagggtagtctataagaaaagcgtagaggaagtgagggagaagaaacactggaaatgataatagctagaccttttccaaaatttttttaaagatataaatgcctagataaaagcagcactccaaatcatgaacagtataaatacaaattatgttacaatgatctgcagaataccaaagataaaaagtgacca

SEQ ID NO: 199427 - DNA, 515 bp, Homo sapiens
ttaagccaatttgagttgaaattttttgtcatttgcaacggaatgagacatgttcctctcccccaagagctagcgtgtggtatagtgataccaggttgtgtttgatatatggggcgatagagacacatgtggggtggaagctgtccctgtgagtatggagtgtctgaaggcttcacatcgtcaaggatgtggaattccagccaagccttggagtatgacgatggtttgggaagccagagagggtcctcatgtgaatatctgtgcctcgttccactcctttcagatggattcggtctcctctgggtgtcttctctctctgtttatccattcttgcatccttttctcgggatttcgtccttggatgactttctattctattctcaagctgttgtttcaatccacgccatatgcaaataattctgaatgcaaataattcacactctgtctcaaaaaaaagaaagaaagaaaaaatgaggcattctcatgaccactatcccttctgcactggggaatca

SEQ ID NO: 199428 - DNA, 480 bp, Homo sapiens
tgtaattattatgtttattcctatgagaataattgtgatgttggatcatgaaaatgatgctgtaatgataaataattctccgattagattgatgtggggtggaagctgtccctgtgagtatggagtgtctgaaggcttcacatcgtcaaggatgtggaattccagccaagccttggagtatgacgatggtttgggaagccagagagggtcctcatgtgaatatctgtgcctcgttccactcctttcagatggattcggtctcctctgggtgtcttctctctctgtttatccattcttgcatccttttctcgggatttcgtccttggatgactttctattctattctcaagctgttgtttcaatccacgccatatgcaaataattctgaatgcaaataattcacactctgtctcaaaaaaaagaaagaaagaaaaaatgaggcattctcatgaccactatcccttctgcactggggaatca

SEQ ID NO: 199429 - DNA, 175 bp, Homo sapiens
gtatagagagccagcaaaagctcgactcttccatctaacaagcaccacaaacctagagtcatgctctacttttttggagaaaacatgttggcttcccactgagcctgccatcatgaggcacaatagtgggcatcttggtggttggctaataataacaggtgatatttatagaagg

SEQ ID NO: 199430 - DNA, 490 bp, Homo sapiens
acctatataatctcaaggaaataccaaacacatattaaatgatattctacaaaatacttattctgtaatctagaaagtattaaggttaagaaaataaagtaaaaatggagaagaaacttgtctaaagtgaagtaagaagacttgacaaccaaatgcagtgcttagttaagaactagatccttttggcataacattattaggttaatcgacaaaacttgaatgtggtttgaggagtatgtagtagtaatgtattagtgtgttgatttccagtaataatgtatcaatgttaattcccagatgattgtatttctgtaggagaatgtctttgtaggaagtataaaagtattcaggggtgatgatgggtcatcagctcagcagcttactctcaaagattaagggaagaagttacttatactgtgcttaaattttcctgtaaatttgtatttaaataggtatatagtatccatgatgttatggccatgataataga

SEQ ID NO: 199431 - DNA, 372 bp, Homo sapiens
aatgaataaacagctctgtaaggcaatttctttaaaggacttagaaaactaaacttctagcaaaacagggtctcaatgaagagggaagagaaggaaaaaaaatcacaattattgagcagtttctatatgctagacattgtggtacattatctcatttaatcctttaaaccaccatgaattgtaggaatcattatccctcctacttgaaggaaaacaaaaacaaaaacaaaaacaaaaaaccttagaaacacagcttgcactcagataaagaaataccagtccagaggcccccagtcggttgatctgtcttggtggctactaccaaactgccctccccaggtctaatcagtgtttcaagcttctggctgaatg

SEQ ID NO: 199432 - DNA, 439 bp, Homo sapiens
actttgagttctatgtatattgtatgttcattccgttcaccaattttaacttatagtacattccactagaagaacttatattttaaattttttttcttctagtgacgagcatgtaggtttcttccaatttctaaatgacacaaaaaaacctacaataaactgcctttggtgtatctgctcagtaatctgtgtgagaatttcttctggacataactaggtttgggtccttgaattataagctgtctgtatacattatgtctctaaataactaccaaatttatttccaaaatagctgtaacagagcccttgttggtttttaatgttgttaatatcttctttgtcaatattgtctatgatgtactacattaaacttatatccttaaatttgctatatttataccaattaactttaaactcaataaatgtggattttaagtaa

SEQ ID NO: 199433 - DNA, 327 bp, Homo sapiens
ggggacacatggactctgggcccatcagtccaaccccagaactgatgcttgaccccttcccagcatctctgccaactgatgggctggcttcaccttgcatgcctacagccatggggagttcctccctcctgtggcagtctgttccatctctgggcagctggactagccccaacccttctatttgcatttctgctccttgtagtgacatgcaatgggtctgggaactggggaaggagccctgattctgcctttggagacttagcagggactcagggaggtaacgagtagaggagggcatgaggtgaactctgggcccacttgagtgac

SEQ ID NO: 199434 - DNA, 461 bp, Homo sapiens
  misc_feature (18)..(18): n is a, c, g, or t
tcatagctgttctagagnatcactcatgctgcacgacggtcaaacaattctcctgcctcaacctcccaagtagctgggactacaggcgtgtgccaccatgcctggctaatttttgtatttttggtagagacggggtttcaccatgctggcaaggctggtctggaactcctgacctcgtgatctgccaaagtgctgggattacaggcgtgagccactgtgcccggctattgtggtatgtttgtgtgttggtctttaattatttgtgtagagatggggtcttgctatgttgcccaggcttgtctcaaactcctggcctcaagcgatcctcccgcctcagccttccaaagtgttgggattataggcgtgagccattgcatccagcctggtgtatatacctagcccaaactagatagatacatagaaagtacttaaaatgtttttctttccattgtaaaaattca

SEQ ID NO: 199435 - DNA, 338 bp, Homo sapiens
ccgtgttcaaaatcacggattttgtccatgttattgacatcaaaaattactaattgaatttttataacaattatgatttgaatatttgtatacatgtaaggctcagagataatgctagatgttaagaaagagaaaactgtttataagttactataatcttttatggactatggccatctgtgttcatcttacacaaccatcctctcaccaggactaacatgaaaaaacttaaagttttaaggtgtccaaagatcattctagaaatccatccctgagttaagaaccatggatctgagcataaatttcttccctgagtgactcattgattagaaaaatgc

SEQ ID NO: 199436 - DNA, 761 bp, Homo sapiens
cccgcgttccggaagcccgctcccggggccatgggggcacaggtgaggctgccgcccggagagccctgccgagaaggatatgtgctgtctctggtctgtccaaactcctcccaggcttggtgtgagatcacaaatgtgtcacagctgctggcttctcctgtgctctacacggacctgaattacagcataaacaacttgagcatttcagcaaatgtagaaaacaaatacagtctttatgtgggcttggtactggcagtaagctcaagtatttttattggctccagcttcatactgaaaaagaagggcctcttgcaactggccagcaagggctttactagagctggacaaggtggacattcttacctgaaggaatggctctggtgggtaggattgctgtcaatgcaatattatcttcctactttttaaacgagcacttgaacattcatgggaaaataggctgcatattaagtatattggggtcaactgtgatggttatccatgccccacaagaagaggaagtcacatctttgcatgaaatggaaatgaaattgagagacccagggtttatttcctttgctgtgatcataactgtgatctccttggtgctgattttgattgtggctcccaagaaaggacagaccaatatattggtttatatttcaatctgttccttgattggagcgttttcagtttcttctgtgaaaggcctgggaattgccattaaggagctgatagaatggaagccagtttacaaacatccg

SEQ ID NO: 199437 - DNA, 318 bp, Homo sapiens
cagggctgacaggaaaagaggaaagcgaggcagtagttaataggcagttgaggacagagctttgtcatggaaatctcactactttgtgacatggatgaggcctttagaaaaatcatgtggactcttcattcatgcagcaaccattaattgagcacctactatgtgccaggcactgaactgccaggcaatggggatattgaagtgaatgaagctgtacatgaatatttatagtagcactgtaaatatgttgcataatatattgcacaattatgaatttagcaattcataattgctaaaaagtagaaacaacccagatgt

SEQ ID NO: 199438 - DNA, 794 bp, Homo sapiens
gaagagagcatccccaacccccgaccatgctggctccctgatctcaggctttcagcctccagaacaatgagaaaatcaatgcctgttgtttaagccccagtctgtggtctgtagttacagcagccctagctggctgagacagcaggtctggggtgagcctggggatctgtggttgctggcaagaccccaggagacactgatgctgatgcgattggcccatggactgaccacactgcgaaacacggatccagactccccaaatagggaccctcgtcttgagttggctgctgtgtgcctgagacattaggccaaggggaggagccttccaggtggaatctgaagagctcgcagactttggagtgtgacagacctgggccgaatgctgccctgtgacttcccagcagtcacttaccatgctgcctttcccatctgttaaaggggcatgaagacacctccctccaaggctggcaccggatgggatattgcatgggcacagtgcctcgtgcagtgacgacactgtttcagggtaggtttgcttgtctgttgttttggggctgagaggagggagacgggagaaggtggtcttcaggagcttggggccatattgcctaggtgcttccatcacccgcttcctgatcctggaagccctacagtccccacacgtcatcccttacatcagttcttcagtggaaccatccagaggcacaggcacctgccccttctgcagagtctcccctgaccacccagcaactgggagacaggcacaaagcatggggaagggggtgtgaactgca

SEQ ID NO: 199439 - DNA, 578 bp, Homo sapiens
cccttaagcttacgtgagagaagtattatactatttatgttctctgtattgccacaagggtaagacagcctttaagactaaaaatgatacaacatcagatagacaccatatgaaagaaataaagggaacttttgttggaactaccatgtatatgtattgtgaccatttttgtgtttagttatattatgagagaatacttctagaagtggggatattttgcaatttatagtttaaaaagaggcatttacattaaaccattttttagagactatatctttcaaaagcgttattcatttaacagatattctgtgtttactatttcccacacatgattgtaggtgctgggaatatggtaacaagcaatatatcaagattaagacctcacgatttgaagttcttttatacgaagtgtaaatacaagcctaaaagaaatactttttcccccaaaagaattgactctttaatttggtaggacaatcaactgcatttttcctatgtcaacagcaaaatataagatgataatatgacttatactgaatgcttacttttaggaatttcacatatatcttcaagtatca

SEQ ID NO: 199440 - DNA, 320 bp, Homo sapiens
taagaggaaagattaaagtgtaaatcaccaaccttaaaatgttagaaagatctcaaattaatgatctaaagtcacacctacaggaactagaaaaaaacagaacaatgtaaccccaaaggtagcagaaaaaaatcactaaaatcagagcagaactgaatgaaattgagacccaaaatttaatacaaaggtcagtgaaaccaaaggttggttctttgaaagaataaacaagatcaatagactaataactagataaacacaaaagagaaaagtttaaaataagcaaaatcagaaacaacaaaggtggcattacaacctatctc

SEQ ID NO: 199441 - DNA, 400 bp, Homo sapiens
ggttaatggcatcacttttatctcagtggctagacctaagatctgtcctaagtcctgtcttttcactcccatatctaatcaggtgacaataactggattctgcttccagcatgattgtatctttctcttcagtcccaacagtcccatctgggagttcagcacctcctgcttggaatgccttcacaatggttactctctgccttcccaaaaactgcatacccttcatgtggccacagctctgaaatcacttctgctcaaatcctttatggttgcgtcaccccttaacagcataatgtccagatttctacatgaggcctctgataagctggccccaacatttcctaccttacttttctactttcccttcccaaacctcatgaccatctacatgcaactacta

SEQ ID NO: 199442 - DNA, 406 bp, Homo sapiens
acaaaacaagtgtgaaacactgccactctcagaacttttgaaatacagcagcctagagcaatgtctataaccgccaaggaccatatacaaactttcagtttctctaacccattaagatcctagtcaatctggaattctactggtttagccacttagtatttgatcatgggcattatacaactctgtaacactcaaatttttcatctctaaaatgggcacaacaatagacctattttacaggactgttgtgagaaccaagtaagagactggaatcccgtccagaatatattccaaattccttaacttcgtcttcacagccctccatgaactagtcattacctgcttggcaagtgttcaccccttaactctaatcaaactggagattattctacttcctgtgagcaca

SEQ ID NO: 199443 - DNA, 673 bp, Homo sapiens
ccagtccagtgttttacaggagaggctgcaaggcttgggaaagtggcccaggattcagagtcagacctcaggtgctgtgaattctgactccaccttcttccaggtgaatcatcttgtcaagttacttgatgtgcccttgcgtttctttctccctatccctgagttggggagtatcagatgccagaaagttgggaggttgataaataaagatgtggaaatgcctgcctggagcctggtactggagctgctttcgtccttgggatggatggtgccgcctgccctataggcagtgaccccagcagcatgtcccaccttccactgaggcaggcgtgtctgtcttttctcagagtgtgaagagtacaaagagtacaaagacatcatagactctgccaatgtttccatgtagcattagagattcttttgatttaatctgtccctctaaatgcaaattctacaaaaacactgacaacagcttatcagaaggaaacatgctgaatactgcagtaacctgctaggaagcattaaagtagatccccaggatctgttagtaaacaggatatggttaacagtttgctgtgactcaagacagaagggactgtgatgatgacctgtcagatcagggagatttgctccatgactcaggaaagcaaacctagtgacttctcacaaggct

SEQ ID NO: 199444 - DNA, 391 bp, Homo sapiens
tattaacctaatccaaaaataaagtgtaataccaacaatgaggtagctaattacatattctcctttaagagtataagacagcttttttaaggaggaaaaaaactcaagcttgcaagtttaagaaaacttctaaaagtacagacaacttgggccatgggggaaaaaaatgtgaaaagagaaaaattctaaaagtcttttaaacaaaaagtatgggcctggcggtggctcgcgcctataatcccagcacttcgggaggccaaggcaggtggaccacctgaggtgggagaatcattttgagcccgagagtttaagaccagcctgggcaacatagtgagacattgtctcaaaaaaaaccaaaaaacaaaacaacatgtgggggggaacacccacg

SEQ ID NO: 199445 - DNA, 449 bp, Homo sapiens
ccaccataaagcagaatgccagccgcacagtgcctactagctcatagctaaacaacggagaactgcagccttgaaacagtgccccaaagagttaaagaagtctgtgactaacaaattcttgagtttgcaggatagcagatgagaaaagaaacaacttgctgaaactccctccacttgtaatattaaaaaactgactgaaattgcttgcaatcaacatgactaactggagtttgtgcagaatggtttgctaacatcacagcctgaatttccagtgcatggttcatacaaactccccgagtttgacatatgatccatgtggtggcatgaagaggtaactgtgcatgcctcagcactttctagacctccgctttccttccgccaatcacctactaatcccagaatccacccatgaatttttttctaataaaattactgctttaaacctagca

SEQ ID NO: 199446 - DNA, 382 bp, Homo sapiens
taattagttaatgggattgatattcacattaacctttatttatttctctttgttgttaggggttctgtctgtaatgtgttgttaacttcatgtcatgatggtgtgtgccggctctgggcagaaactttattaccagaagactgtcttttgggtgagcagatttgtgagactaccacttccagcattgccagcagcctttctcatgctggaagacacaaagacagaatacagcatgctcttgaggtattatattatttaaaatggtaaatgaattttgaagataatgtgagcctggtggaaattcatgaactaacatgcagatggcacacatggtacatgtaatgagtgaaattaatagcaataaactctcatttatgcttgt

SEQ ID NO: 199447 - DNA, 712 bp, Homo sapiens
tatctgtgaggattcctaaacttccattaagcaattctactacttccatttttaaggaagtaaaatgatattaaaaggacatctatttattatactcaatgtcttccagcttgcagataaggaaacgtatgcagactaggaaatttgcttagaagtcacaaatcactttgttattcatccctgaggcagtatttcttccagagagaatatggtaattacccaattcccacaatctggtatggtcccctttccctgcaattgtaagtcactgcctaaatgagccactgttaaaatgggaatgtgcactatgtattaagtgtgtacatgcatgcatggagcatacatttctgttagagaaaggaggaagaggtaggaaagatgggaagactgaaacccactgttctcaaaagcaaaaggatataaacatcatcgttaaacctcattatttgctctaaggatttagattacagttatgccatacagcgaatttttctttaagacacaaacaaaccacattctaagaaagtgattaacatgaggcctggcacggtggctcacacctgtaatcccagcactttgggagacccaggtgggtggatcacctgaggtcaggagtttgagatcagcctgggcaacatagcaagtcctgatttctacaaaaaaattttaagcattagctgggcatggtggcatgtggaggctgagacaaggg

SEQ ID NO: 199448 - DNA, 876 bp, Homo sapiens
gtaactggcatagatatcatggggatatttgaagaacgctgtgaacacatatgcatgggtccatgtattcatgagtgtgcacatatgtgtaattattcatacaattcatggtggatactacttcgagggtgttcacagaccccaggcagagagcgcctggagggaaaattatccaaggcaggcccattcatagttccaggacagccagaagaaagcctccgttaagcaccagaagtctccggggcaggtggggccaggcagcatgaaagaattggccgcaagagttccaaaccctgtcccaattatggagggtgacttttctttgtcctccttctccattcccttccatattgctcatgcatccaaagggagacctgaagactctctagcagggcaaggccattttcttttggcatttttctctccccagagtctagctgattatcagcttagacacacagcaggctatgtgctgtgaacaacaggcatcctgggttattttacaaactcatggatagtcattttgaaaccacctttgcaaaattgtgactgaaacagtgaaagagagctaacttaaccagctccatcttgtttctaacctccaagctgtctttgttcattcctgggcgtaggctgaactaactttgggagaaacttagtttgtagttatagtttaaacaaagactgtgacagccctttcccaatgcagacctccttcttgtctggggactagactaacattagccacaggattagaaattacggtttaggagtcacgcagctggaggctacaagattctgaccctccctaaactgcttctaagatcagtgcttgagacatgttgcagaccccgcacttgctggatcagctgacgc

SEQ ID NO: 199449 - DNA, 169 bp, Homo sapiens
agagaaagaaaaagaatgaagaacgaaaataaaaattttttaaaaacctaaggttaaaataaaccctttttcttcatatataaacacatgagttcaaattacagctttgctgcttaatagcttggtgacccaggacaagttatataacctctctgtgcctcagtttcct

SEQ ID NO: 199450 - DNA, 163 bp, Homo sapiens
gattgccagctacattttcatgagacaggtgatttgacctctctggtgcctcattttccaacacctgtaaagtgccagtaataccagggcctacctcagagtattgaagagttagcctatgtgaagccctagaacaatgctagacacttcctaagcaggcaat

SEQ ID NO: 199451 - DNA, 439 bp, Homo sapiens
atgagttggagaagaaaatattcttttcagattcctggtccagagctgtagcattaactcccccacactggtccttggacatgtgccctatggtccacctgtaagatttcttgggccactggcaaatataataagaacagcataataggatgtgggcaaaagattgcctgcttatcttatcctggataggactatcttttattgtgtgtcttgagtgttctgacagcttttacattaacatgtcctatctttttttttttttttttagacagagtctcgttccatcaccaggctggggtgcagtggcgtgatctcggctcactgcaatctctgtttccctggttcaagggattctcctgcctcagcctcccaagtagctgggattacaggcacacgccactatgcccagctgatttttgtatttttagtagagacaggg

SEQ ID NO: 199452 - DNA, 876 bp, Homo sapiens
agaactcacagtcttcttggggaagaggtcataaacttgggcctgggtggttgccctatccaactgaggtcgcctttgcgatccctgctgcaaataggcagtgactagtccaggagtgcagctgggaggaactgctcgccggatagaagggaagaaaggagattctaggcagaggctggaatgcaatgatgcgatcttggctcactgcaacctccacctctcggcttcaagcaattctcctgcctcagcctcccgggtagctggtactacaggctcctgccaccacgcccagcaatttttgtatttttagtagcgacagggttgtaccatgttggccatcctgacctcaggtgatctgcctgccttggcctcccaaagtgctgggattacaggcatgagccactctgttcagttggccatactgatagactccaggctttgggaaactgatggcatttggggatttccccagcatgtcctgtgatgctcttgattccttgtgtctccagtcatgacagagagaaggcattcctggcttgttggtccacatttatgatttgttgatgttgttgttgagatggagtctcaccttgtcgcccaggctggagtacagtggcgtgatcttggcaacctccatctcttgggttcaagtgattcctctgcctcagcctcccaagtagctgggattaaaggggcgtgccagcatgcctggctaattttcatatttttagtagagatggggtttcaccatgttggccaggctggtctcgaactcctgacctcaggtgatccaccagccttggcctcccaaagtgctgggattacaggcgtgagccactgtgcctggcctgtgatttttttattttttcagaaggg

SEQ ID NO: 199453 - DNA, 1039 bp, Homo sapiens
attctagaggatcccaggacgtgtcagtgatactggaggctggctgcagtggtggcggtggagtcagcagaaggtggaggtggagacgaggaggtctgcatgctggggggcactgtgtagagttgataatttttacgtcgttctagatccaaaacttctctccgacactgaataccttctgcttctcctatcattactctcattgtctggggactgggaaatgggcagtggaggatgaacttcaggggtatcgctccggtcctcaggaagtacctgaatctcctcagaagcctgagagtctgtggaggtatcaacactggggctactagatcgagaggagtctgaagacattggagaggagtgctgagaagctgcacttgatttttcagaagatccacaggccgttgtcaatgacccccgagcggtcggcgtcccccaacttcttagagggacaagtggcgttcagccacccgagattgagcaataacaggtctgtgatgcccttagatgtccggggctgcacgcgcgctacactgactggctcagcgtgtgcctaccctacgccggcaggcgcgggtaacccgttgaaccccattcgtgatggggatcggggattgcaattattccccatgaacgaggaattcccagtaagtgcgggtcataagcttgcgttgattaagtccctgccctttgtacacaccgcccgtcgctactaccgattggatggtttagtgaggccagccccgaattcagcccttccagaacctcacgctgctactcagcctcctcctagccttcactactccctgcatctgtttgagggcatgaaggcgttctaaaggcaatatgaccaagctatggtgcgcctcttccacgcctggctcaacatggaccggatgctgcgctcatccatgcgcctgtgcctgccgagtttcgacaagctgtacttgctggagtgcatccgccggctcatcgaagtgataaggactgggttctcgatgccgccagcaccagcctctatgtgcggcaatagctcatc

SEQ ID NO: 199454 - DNA, 1114 bp, Homo sapiens
tgggactacaggcactgccaccatgccctgggtaatttttgtcttgttgtagagacagggttcgccacgtatcccactctggtctcaagcacgtgtgctcaagcaatcctcttgcctcgggctcccaaagtgctgggatcacaggtatgagccaccatgcccagcccattgcaaccatcttagtgtatcaaaatacatgtgaaagatgacatgcatggaatcaccctaagggtgtcttctcaaaatttgcaaatattatacaaagaaaatatccctctgctctttaagaaatatatatatatgcactattagaccagcctggccaacacgggaaacctcacccggcccggacacggacaggattgacagattgatagctctttctcgattccgtgggtggtggtgcatggccgttcttagttggtggagcgatttgtctggttaattccgataacgaacgagactctggcatgctaactagttacgcgacccccgagcggtcggcgtcccccaacttcttagagggacaagtggcgttcagccacccgagattgagcaataacaggtctgtgatgcccttagatgtccggggctgcacgcgcgctacactgactggctcagcgtgtgcctaccctacgccggcaggcgcgggtaacccgttgaaccccattcgtgatggggatcggggattgcaattattccccatgaacgaggaattcccagtaagtgcgggtcataagcttgcgttgattaagtccctgccctttgtacacaccgcccgtcgctactaccgattggatggtttagtgaggccagccccgaattcagcccttccagaacctcacgctgctactcagcctcctcctagccttcactactccctgcatctgtttgagggcatgaaggcgttctaaaggcaatatgaccaagctatggtgcgcctcttccacgcctggctcaacatggaccggatgctgcgctcatccatgcgcctgtgcctgccgagtttcgacaagctgtacttgctggagtgcatccgccggctcatcgaagtgataaggactgggttctcgatgccgccagcaccagcctctatgtgcggcaatagctcatc

SEQ ID NO: 199455 - DNA, 823 bp, Homo sapiens
tagtacctcggtagtcgtgaggtgcttgagtgttcccggtgttgtgggccttggtggtatacctccaacgggtaccgcttaatgcagctacctacggagtggcagtcgagatctggcttcggattgtctcccattttccgaggtgggtgcctgccttggggaaagcttgtggcgggaagagaaaatgagcttcctaggacccctgactcactgagcacgaggaattccggcagggacaagtggcgttcagccacccgagattgagcaataacaggtctgtgatgcccttagatgtccggggctgcacgcgcgctacactgactggctcagcgtgtgcctaccctacgccggcaggcgcgggtaacccgttgaaccccattcgtgatggggatcggggattgcaattattccccatgaacgaggaattcccagtaagtgcgggtcataagcttgcgttgattaagtccctgccctttgtacacaccgcccgtcgctactaccgattggatggtttagtgaggccagccccgaattcagcccttccagaacctcacgctgctactcagcctcctcctagccttcactactccctgcatctgtttgagggcatgaaggcgttctaaaggcaatatgaccaagctatggtgcgcctcttccacgcctggctcaacatggaccggatgctgcgctcatccatgcgcctgtgcctgccgagtttcgacaagctgtacttgctggagtgcatccgccggctcatcgaagtgataaggactgggttctcgatgccgccagcaccagcctctatgtgcggcaatagctcatc

SEQ ID NO: 199456 - DNA, 1079 bp, Homo sapiens
gtggcgatcaacagtggaacgggacatccctgtgacccacaagcccagctcgtaggaagtgattcgacagatccatctcacatggacacaaagacgtgaagagaatgacatgaaagtgtagcactgtttgcggcagataagcggtaggaaataacctagatattgatcagagggcaacagtcaaaagtggcatatcggcaggtgcggtggatcactgggtgtagtccgaggacttagggaggccgaggagggtggatcacaaggtcaggagatcgagaccatcctggccaacacgggaaacctcacccggcccggacacggacaggattgacagattgatagctctttctcgattccgtgggtggtggtgcatggccgttcttagttggtggagcgatttgtctggttaattccgataacgaacgagactctggcatgctaactagttacgcgacccccgagcggtcggcgtcccccaacttcttagagggacaagtggcgttcagccacccgagattgagcaataacaggtctgtgatgcccttagatgtccggggctgcacgcgcgctacactgactggctcagcgtgtgcctaccctacgccggcaggcgcgggtaacccgttgaaccccattcgtgatggggatcggggattgcaattattccccatgaacgaggaattcccagtaagtgcgggtcataagcttgcgttgattaagtccctgccctttgtacacaccgcccgtcgctactaccgattggatggtttagtgaggccagccccgaattcagcccttccagaacctcacgctgctactcagcctcctcctagccttcactactccctgcatctgtttgagggcatgaaggcgttctaaaggcaatatgaccaagctatggtgcgcctcttccacgcctggctcaacatggaccggatgctgcgctcatccatgcgcctgtgcctgccgagtttcgacaagctgtacttgctggagtgcatccgccggctcatcgaagtgataaggactgggttctcgatgccgccagcaccagcctctatgtgcggcaatagctcatc

SEQ ID NO: 199457 - DNA, 1056 bp, Homo sapiens
ctcggttagggagctaacattaaggatgcatggacgtaaatacaggaacactagacactgtggactaccagagggtgagggtgtcggtttaaaaactacgcatcaggtactatgctcactaccggggtgacgggatccatattccaaaccttagcatcaagcaatattctcacataacaaatctgctcgtatatcccctgtatctaaaataaaagtggaaatcaaatacaactaacagtagagctacggggaaggcttaaagggccaacacgggaaacctcacccggcccggacacggacaggattgacagattgatagctctttctcgattccgtgggtggtggtgcatggccgttcttagttggtggagcgatttgtctggttaattccgataacgaacgagactctggcatgctaactagttacgcgacccccgagcggtcggcgtcccccaacttcttagagggacaagtggcgttcagccacccgagattgagcaataacaggtctgtgatgcccttagatgtccggggctgcacgcgcgctacactgactggctcagcgtgtgcctaccctacgccggcaggcgcgggtaacccgttgaaccccattcgtgatggggatcggggattgcaattattccccatgaacgaggaattcccagtaagtgcgggtcataagcttgcgttgattaagtccctgccctttgtacacaccgcccgtcgctactaccgattggatggtttagtgaggccagccccgaattcagcccttccagaacctcacgctgctactcagcctcctcctagccttcactactccctgcatctgtttgagggcatgaaggcgttctaaaggcaatatgaccaagctatggtgcgcctcttccacgcctggctcaacatggaccggatgctgcgctcatccatgcgcctgtgcctgccgagtttcgacaagctgtacttgctggagtgcatccgccggctcatcgaagtgataaggactgggttctcgatgccgccagcaccagcctctatgtgcggcaatagctcatc

SEQ ID NO: 199458 - DNA, 730 bp, Homo sapiens
tgggactacaggcactgccaccatgccctgggtaatttttgtcttgttgtagagacagggttcgccacgtatcccactctggtctcaagcacgtgtgctcaagcaatcctcttgcctcgggctcccaaagtgctgggatcacaggtatgagccaccatgcccagcccattgcaaccatcttagtgtatcaaaatacatgtgaaagatgacatgcatggaatcaccctaagggtgtcttctcaaaatttgcaaatattatacaaagaaaatatccctctgctctttaagaaatatatatatatgcactattagaccagcctggccaacacgggaaacctcacccggcccggacacggacaggattgacagattgatagctctttctcgattccgtgggtggtggtgcatggccgttcttagttggtggagcgatttgtctggttaattccgataacgaacgagactctggcatgctaactagttacgcgacccccgagcggtcggcgtcccccaacttcttagtgtgcaattgcgtctttccttccttccttccttcctgccctccttctctctctccttccttcattccttccttccctctctccttccttccttccatatatccaaaaaacaaagcataatatttcgccctctaaggccctcactttattgactcctagccgcagacctcctcattctaacctgaatcggaggacaaccagtaagctaa

SEQ ID NO: 199459 - DNA, 656 bp, Homo sapiens
attcacatctgacacgttttgtctgatgcgctgtcattgtagttcttgagcatggatacacaagcccacgctgcagctggtagcgcagggcaatcagtggctgggtgttctgcttgtgcttatatgccaaggcatgaaggactgggtcctcgaagagcaccgggtatttcgtgctctacgcatggtcatacgggtaacccgttgaaccccattcgtgatggggatcggggattgcaattattccccatgaacgaggaattcccagtaagtgcgggtcataagcttgcgttgattaagtccctgccctttgtacacaccgcccgtcgctactaccgattggatggtttagtgaggccagccccgaattcagcccttccagaacctcacgctgctactcagcctcctcctagccttcactactccctgcatctgtttgagggcatgaaggcgttctaaaggcaatatgaccaagctatggtgcgcctcttccacgcctggctcaacatggaccggatgctgcgctcatccatgcgcctgtgcctgccgagtttcgacaagctgtacttgctggagtgcatccgccggctcatcgaagtgataaggactgggttctcgatgccgccagcaccagcctctatgtgcggcaatagctcatc

SEQ ID NO: 199460 - DNA, 971 bp, Homo sapiens
ttgcgccaacgcaccgtgttgggccaacccaccgtgttgggccaacgcaccgtgaagtccgtggaagcctgtggctacaaaaaatgttgagccgtagatgccgtcggaaatggtgaagggagactcgaagtactctgaggcttgtaggagggtaaaatagagacccagacggtgcgttggcccgccaacgcaccgtgttggccaacgcaccgtacaggattgacagattgatagctctttctcgattccgtgggtggtggtgcatggccgttcttagttggtggagcgatttgtctggttaattccgataacgaacgagactctggcatgctaactagttacgcgacccccgagcggtcggcgtcccccaacttcttagagggacaagtggcgttcagccacccgagattgagcaataacaggtctgtgatgcccttagatgtccggggctgcacgcgcgctacactgactggctcagcgtgtgcctaccctacgccggcaggcgcgggtaacccgttgaaccccattcgtgatggggatcggggattgcaattattccccatgaacgaggaattcccagtaagtgcgggtcataagcttgcgttgattaagtccctgccctttgtacacaccgcccgtcgctactaccgattggatggtttagtgaggccagccccgaattcagcccttccagaacctcacgctgctactcagcctcctcctagccttcactactccctgcatctgtttgagggcatgaaggcgttctaaaggcaatatgaccaagctatggtgcgcctcttccacgcctggctcaacatggaccggatgctgcgctcatccatgcgcctgtgcctgccgagtttcgacaagctgtacttgctggagtgcatccgccggctcatcgaagtgataaggactgggttctcgatgccgccagcaccagcctctatgtgcggcaatagctcatc

SEQ ID NO: 199461 - DNA, 598 bp, Homo sapiens
tgggactacaggcactgccaccatgccctgggtaatttttgtcttgttgtagagacagggttcgccacgtatcccactctggtctcaagcacgtgtgctcaagcaatcctcttgcctcgggctcccaaagtgctgggatcacaggtatgagccaccatgcccagcccattgcaaccatcttagtgtatcaaaatacatgtgaaagatgacatgcatggaatcaccctaagggtgtcttctcaaaatttgcaaatattatacaaagaaaatatccctctgctctttaagaaatatatatatatgcactattagaccagcctggccaacacgggaaacctcacccggcccggacacggacaggattgacagattgatagctctttctcgattccgtgggtggtggtgcatggccgttcttagttggtggagcgatttgtctggttaattccgataacgaacgagactctggcatgctaactagttacgcgagccccgcaacgagcctctcaaaccagccaccccaggagccacccaagggccggcgcgttgtggatatgggtacggcccggcgcgagatttacaccctcccccccatgag

SEQ ID NO: 199462 - DNA, 829 bp, Homo sapiens
ggatctcgggctcgttgcgtggctcattgtgtggcccttcgcgtggcgctcgggtggcacatcgggtggctcgttggtgtggctctggttgcggcgcctggttgtggttcatcgtgtggctcttggtgccggcgcttggtggagcgatttgtctggttaattccgataacgaacgagactctggcatgctaactagttacgcgacccccgagcggtcggcgtcccccaacttcttagagggacaagtggcgttcagccacccgagattgagcaataacaggtctgtgatgcccttagatgtccggggctgcacgcgcgctacactgactggctcagcgtgtgcctaccctacgccggcaggcgcgggtaacccgttgaaccccattcgtgatggggatcggggattgcaattattccccatgaacgaggaattcccagtaagtgcgggtcataagcttgcgttgattaagtccctgccctttgtacacaccgcccgtcgctactaccgattggatggtttagtgaggccagccccgaattcagcccttccagaacctcacgctgctactcagcctcctcctagccttcactactccctgcatctgtttgagggcatgaaggcgttctaaaggcaatatgaccaagctatggtgcgcctcttccacgcctggctcaacatggaccggatgctgcgctcatccatgcgcctgtgcctgccgagtttcgacaagctgtacttgctggagtgcatccgccggctcatcgaagtgataaggactgggttctcgatgccgccagcaccagcctctatgtgcggcaatagctcatc

SEQ ID NO: 199463 - DNA, 824 bp, Homo sapiens
aatcgagtacaaaagtggatacagcatatctgaacacacaagtagtttatgctgtacagcataacaacaggattgacagattgatagctctttctcgattccgtgggtggtggtgcatggccgttcttagttggtggagcgatttgtctggttaattccgataacgaacgagactctggcatgctaactagttacgcgacccccgagcggtcggcgtcccccaacttcttagagggacaagtggcgttcagccacccgagattgagcaataacaggtctgtgatgcccttagatgtccggggctgcacgcgcgctacactgactggctcagcgtgtgcctaccctacgccggcaggcgcgggtaacccgttgaaccccattcgtgatggggatcggggattgcaattattccccatgaacgaggaattcccagtaagtgcgggtcataagcttgcgttgattaagtccctgccctttgtacacaccgcccgtcgctactaccgattggatggtttagtgaggccagccccgaattcagcccttccagaacctcacgctgctactcagcctcctcctagccttcactactccctgcatctgtttgagggcatgaaggcgttctaaaggcaatatgaccaagctatggtgcgcctcttccacgcctggctcaacatggaccggatgctgcgctcatccatgcgcctgtgcctgccgagtttcgacaagctgtacttgctggagtgcatccgccggctcatcgaagtgataaggactgggttctcgatgccgccagcaccagcctctatgtgcggcaatagctcatc

SEQ ID NO: 199464 - DNA, 891 bp, Homo sapiens
  misc_feature (718)..(719): n is a, c, g, or t
  misc_feature (721)..(721): n is a, c, g, or t
  misc_feature (728)..(729): n is a, c, g, or t
  misc_feature (733)..(733): n is a, c, g, or t
  misc_feature (737)..(737): n is a, c, g, or t
  misc_feature (739)..(739): n is a, c, g, or t
  misc_feature (743)..(743): n is a, c, g, or t
  misc_feature (745)..(745): n is a, c, g, or t
  misc_feature (748)..(748): n is a, c, g, or t
  misc_feature (750)..(750): n is a, c, g, or t
  misc_feature (754)..(754): n is a, c, g, or t
  misc_feature (762)..(762): n is a, c, g, or t
  misc_feature (764)..(764): n is a, c, g, or t
gaagaagttcttactgttagattgttaaagctggacaaaagagtcagggtgcttgtcacttcatcccctaagggagccctgggcctttatgctccgtggcttctgacttgccccttatccccttgaactcctgccacatactcatttctcctgcctcctccagcatcccttttctcagaagaatagtgacctttagtctatatctctaattcttcccaggaacaggaagagaagtccaattctaaggcagcaatgcagtaaagagtcttaggtttagccttaacaggacactggtcagttgataccagatatcggggatccgcaatctgtgatcttaaactaggctgagagaaatctccaagtgtaatgtgaactttgctttgtgcagtaaatatgttggaaggaaatccacattagctcgttatctcctctctctgagtgtcatttgaaatgttgctgctgtcttgcaaagtttagaaatttgcaatggtgacagctccaatcactaagttttacggaggtgacttacttacctattcaatatatccaaaacctcaattgcaattttcccccagagagctctgggttcctagatgaagaacaccattgaaggaagctatctagtgttaaccatttaatgatatggcctgtaccacaggagtggggatttgtggttgtatgctccaatgactcttatcatagatgtttgaacttcccnntntgggtcnnaccnttcngnattngnagngngagncctgggtncnggaagcgacattcgggcggccttccctggagggtggagggtgcgcgcgggcgtctggttggcccatgggcacaggggtttgttcttcttttttcttttgttgttcgtgttattcttctcctcggttc

SEQ ID NO: 199465 - DNA, 1136 bp, Homo sapiens
gaagaagttcttactgttagattgttaaagctggacaaaagagtcagggtgcttgtcacttcatcccctaagggagccctgggcctttatgctccgtggcttctgacttgccccttatccccttgaactcctgccacatactcatttctcctgcctcctccagcatcccttttctcagaagaatagtgacctttagtctatatctctaattcttcccaggaacaggaagagaagtccaattctaaggcagcaatgcagtaaagagtcttaggtttagccttaacaggacactggtcagttgataccagatatcggggatccgcaatctgtgatcttaaactaggctgagagaaatctccaagtgtaatgtgaactttgctttgtgcagtaaatatgttggaaggaaatccacattagctcgttatctcctctctctgagtgtcatttgaaatgttgctgctgtcttgcaaagtttagaaatttgcaatggtgacagctccaatcactaagttttacggaggtgacttacttacctattcaatatatccaaaacctcaattgcaattttcccccagagagctctgggttcctagatgaagaacaccattgaaggaagctatctagtgttaaccatttaatgatatggcctgtaccacaggagtggggatttgtggttgtatgctccaatgactcttatcatagatgtttgaacttttcccatatttttgggtacaaaaccattctcagcaaatttctgaagatgctgtgaatgctccttgagcgtatacctgagaactgcccaaatttcaccaccataagctctccaagatactttcctctacttaaaaaaatcgaggccaggcgcagtggctcatgcctgtaatcccagcactttgggaggccgaggcaggcagatcatgaattcaggagatcaacaccaccctggctaacacggtgaaaccccatctctactaaaaatacaaaaacttagctgggcctggtggtgggcgcctgtagtcccagctactcaggaggctgaggcaggagaatggcgtgaaccctggaggcggagcttgcagtgagctgagattgcgccactgcactccagcctgggcgacacagtgagactccgtctc

SEQ ID NO: 199466 - DNA, 590 bp, Homo sapiens
agccagtgcgtagagactggaatgtgggacgtgctcagaaaagggtagttatcactgctgctgagtaacgagaggaggctataggagaatgttcatagccccctacctctacctttgcccccaagtcagtaagcggcaactaaaggcagggagccatctcggaagtgctggaggcccacactcaaggactccaagtgtgactgatattaaagaacagcaacgtagattttagggcataatctgtctaccccattggtactttgaacacttcaagtaattattatctctgttataataaataatgcaattgaggttgagagagtgtaaatggctatggctattcaaagtgacacagctaaccacaaaaatcaaggtttacacacagtacttcactggccaaggccccccgccccagaggtcactgaccgctagtgttctagtggttaatgttgttagactgtttgttttttcttgccctgtcgcccaggctggagtgcagtggcacaatctcggctcactgcaacctccgcctcccgggttcacaccattctcctgcctcagcctcccaagtagctgggactacaggtgac

SEQ ID NO: 199467 - DNA, 506 bp, Homo sapiens
catatctatacttggatttatatgacacaagaaactgaatgatgtcggcttcttgaaaggtatgcggctcataaaaagcaaccagcaggaaatcagaaacaggaaggatgatgctttgttggaaacaatttttcattctgagtacaattatactccatggacaagaaagctactacatcctgtcattaaatatcacaacctagaagcctctaatgaactgattagcattcatgtatctcttggaagtcagatatatgaacagttggtgcactttgctattgacaaagcttataatcataaatattctttgctgagattagattgcactcgtttgcttttcatcttagttagacatactagtttcgaagtaattaaattcattcattgcgagtctttgtttacattaattaggactgacatgtcagattttgcatattaaatgcatttatacagatcttattaaaatggcaaattgtgagcttcttagatgttaaaaaattgaagaa

SEQ ID NO: 199468 - DNA, 211 bp, Homo sapiens
atactgctgtgctgtcattctcagacggacaatcccaagtgtcagagcccatgtggggcaaacagaattctcatacgctgctggtgggagtggaaaatggtgcaactacttggaaaaatcggctggcaatatctatcaaagctgaacaaacacctgccctgtgacccagcaattccacccccagatagatacacaacagaaatgcatcccc

SEQ ID NO: 199469 - DNA, 645 bp, Homo sapiens
tgcgatggctcacgcctgtaatcccagcattttgggaggccaaggtgggcagatcacctgagatcaggagttcgagactagcctggccaaaatggtgaaaccctgtctccacaaaaatacaaaaaactcagctcggcatagtggcacaaccctgtagtcccagctacttaggaggctgaggcagaagaaacactcaaacccaggaggcaaaggttgctgtgagctgagatcacaccactgcactccagcctgggcgatgagaatgaaactctgtctcaaaaaaagaaaaaacaaaaacaacaacaaagtggggaaggggaaatatgagttttacagggcaggcgcagtggctaatgcttgtaatcccagcactttgggaagctaacatggacggatcataaggtcaggagttcgagtccagcctggccgacaaggtgaaaccccatctctactaaaaatgcaaaaattagccaggcatggtggcgcgcacctgtggtccagctactcaggaggctgaggcagaggaaccgctcgagccccggaggcggaggtgcagtgggtgagatcgagcaatgtggcatccaagcctgggcaacagagcgagactccatctcaaacacacgactcatcacacatgtgaaaggc

SEQ ID NO: 199470 - DNA, 482 bp, Homo sapiens
  misc_feature (433)..(433): n is a, c, g, or t
tgcgatggctcacgcctgtaatcccagcattttgggaggccaaggtgggcagatcacctgagatcaggagttcgagactagcctggccaaaatggtgaaaccctgtctccacaaaaatacaaaaaactcagctcggcatagtggcacaaccctgtagtcccagctacttaggaggctgaggcagaagaaacactcaaacccaggaggcaaaggttgctgtgagctgagatcacaccactgcactccagcctgggcgatgagaatgaaactctgtctcaaaaaaagaaaaaacaaaactacacctatactaaacaaaaaccctcaatggatacctgatttccactgagtgactgacttcatcaccatctcctgaatgacttcctcccagtttcattctgtatagtatctgcacatatacggctatttatgccanatgttttaatgcaatggacataccggcgtgcaatggatctcaggtacct

SEQ ID NO: 199471 - DNA, 583 bp, Homo sapiens
ctgagttctaaattgacaaattttaatttccaagttgtttctgacacggtgagagttgggttagaatttttatttcattccccaagtcattttttctttttctttattttttctttttgagacagagtctcgctctgtcgtccaggctggagtgaagtggcgcagtgttgtctgcagcctcaacctcccaggctcaggtgattctcccatctcaacctccagagtaactgggactacagtcacgtgctaccatgcctggctaattttttgtatatctgtagagagggggtttcaccatgttgctcgggctggtcttgaactcctgggctcaagtgatccatgtgccttaccctctcaaagtgctgggattataggtgtgagcgaccgtgcccagcctcattttttctttcaatatggaaaattggctaatccacctaatacctgctcatcttctagtattctatcctaccatctaccctcagagttattgatgtactctttcatcatgtgctatcatgatttctccttagattagaaagtaagcttcaaatgggagtgtgtcttcatattgttctgaattaac

SEQ ID NO: 199472 - DNA, 351 bp, Homo sapiens
atgagcataacttgaagtacctaatacagtaggggcttaaatattagtcccttccatgtgtacccattttattatttttcttcataaagtaagtctttgtcagaatgtttggccctctaaatttaaggttcctgtaaaatgtcttataactgttgtaccatttacatataatttgcaaaggtaaaatatctgtcccactgaagtattcacagaagcagagtttgtttctgcagccttttcacctcatacaacataggctgcaataccagaaaatcattcaaacatgagcatgctttaacctacacttatatgtgagagataacagaaagaaactttgagaaaagaggaagt

SEQ ID NO: 199473 - DNA, 875 bp, Homo sapiens
gctgttaaaacacccacacgcatgcgctggtctaccgagctccgcgcaactcccggcgcactactctgatccgagccccactgcttccggccgctggtcgcagggctgcgggactacaatcttcgcatgaaatggaagagagggtggtgcggatagcttgaggaagttccgtttccctccagagcatcaagcctcctcccgcccagggggcctcctgctttcctaagctgctgtggaatcggcctgaggtcccagacgctgtccattgtgctgctgctctctgctttctccagccagagtgccagttcatccgcttttgggagaactccgccgcctggcctgcccgcggaaaaggtcacagctttgcagggggtgacatgggctatggcttcctggaaatgtcaccctcactagcgccttttagatagatgtgaattttgagacatgagggagagtaattattggtttacccaggagatgctaagagcagcaggagaaaaccctaatttccaggcatgtgtcctgagccagggacaggctggccagaccctaagcccccagtgccgccagagagcagcctactgccctgatttgtgtggaatccccttcgtgctgctgggccttagcgtcagggacagcccagtcaggtgaaggtggggatgacccatgggcttctggaagtgggttggtggtcctgggagggccagcccatccccccttggagagggtctttgtgctgaaggatgcccacagaggcctgggtaccaggaacactgctctaggcaaggtgcctttcttccagatttggctgaaaggaaggaagacttggtcagcttttccacccagccatctggcccttacagggctgctcccca

SEQ ID NO: 199474 - DNA, 339 bp, Homo sapiens
tcagcatgcgcagggttcaagggtgttgcgcagccccgcagggaggggcagggcggtgttgacctctgtttccaaacccatgctggctactgaatctgtgccacccctggctaaggggagtgagtccatagagggacttgaagggcaggtctgggctgggcagtgaggagagtatgatactgcaaagtgcgcctcgcctttgccaaaatcggtcgggtctcaggctcaccccacctcccgctgctcagttccgtttccctccagagcatcaagcctcctcccgcccccaccctgcctcctttctctgcttgcttctttctcttctcctacctgcctgca

SEQ ID NO: 199475 - DNA, 303 bp, Homo sapiens
gcagtaacattctacacacttggcaatttgtgaaagtctttgggaagcatgatgtgagaatatcagggtcaacttgtataggtcaggagttcaagggatacatctgggctgaaggtacagatttaaaaaccatgagattaacaaatgaaaatgaagtgatcaagaaaaatattaaatacctggctcatgaaactgtagaattaatagaaagaaaaaaaagaaattgatgtcttttttcattgtcttatttcttcattttatcatgtgttttaaaattcttggatttctcccattcccttaaga

SEQ ID NO: 199476 - DNA, 481 bp, Homo sapiens
ttctaatctgaaattattcaagccagagaacaagtgagtaacattttaaagtaatgaaatattttttaaaaccaaagaaacccaaaaacctattaatctagaattatatgcctagcaaaaataacttaaaaataaaagggaaacagacttcttcagactaaaaaaagctgagagaattttctaacgtaagatattcaccataaaagttgttgaaataggctgggcgtggtgcctcattcctataatcccagcactttgagaggctgaggtgagtggatcatttgaggtcaggagtttgaaaccagcctggccaacatggtgaaaccccttctctactaaaaatacaacaattagctgggcgtattggtgggcgcctgtaatcccagctactctgcaggctgaggcagggaggcggaggttgcagttagctgaaatcatgtcactgtactccagcctgggtgacacagtgagacaccctcta

SEQ ID NO: 199477 - DNA, 524 bp, Homo sapiens
tgaggggagagaggagaggacttaagcaactgtgccactcagcattggaaaggtcacctctgtgacattaaaatcaagaattctgatagaagtaagagttctggcatgagtggtgcttttccagagtacacttggatatatgattacattttaataagttatataaatatgcagatattcatgcggcttttcctcatttgggattttggaaactaaaatagtagtaagagcattaaaaaaaagatgtcctggaagttctcgttcattgcaaatgttcttgaaatgtgaaattcttggaaaagtaatcagggacaactattgacagttgtgtgacatttgggtagccctttctacagttaaagtcattgtgacttttagtagccacactgaaacctttggaataatgaaagaccctttcaaaagatcttccatactgatgatcagtttgcgcctttgccatctatggggtatgaaatgtaaaggcacatttagccaggagttaacacaggtgttttgtaatgcgt

SEQ ID NO: 199478 - DNA, 381 bp, Homo sapiens
acgcgtccgcccacgcgtccggggccaaagcctcccagcatgaggcgccacgactcagggcggagaggggctggtcgataccacctgggcccctcctccagcttgagcccgaatctgcagcatcctggtctcccatcctggagggctgcagcgaggctgctgcagagggaagcagaaggttctgttgaccaggagaggctcctgtttacttaccgatggtgcagagctaagcagccagaaggccccgggctccctgcccctgccccacccagggtggggtctgcgtccgtccacagggcaggtgttaggacccatcccaggtacttttcaggcctatgtttccccagcccccaaatgtgataggatgtggggatggggtgg

SEQ ID NO: 199479 - DNA, 1300 bp, Homo sapiens
gaattactcaataaatacaactgggaagttggttatttgctagggaaataactaagccatttttctttgttatacaaatcacttaaatgaaattatagttcctttaatatttatgtaaaaaaggaatcgtaaaatgtgtaaaatataaatatttgatcttaaggtaaagaaaacctttctaagcataaaagcaaagaaagaaaaaactagggcaaagtgatataacccttaaaacagaattaaaaggcaaatgacaagctaatggaaaacagtaaaatatatgacaaattaatttcccctatctgtagagtgcgcttacatatatttcattgtgctcagtagtaaattggggaaatgatataaataagcaatttacaaaaagaagattcctgtgtttcaaaaaattttcaatttaacctgtaatcaaaaagaagaagaagaatggcaatgagatgaacattagtgagatgccccaccaaatcagatactatttctgtgactcttgggtttcaacaggtgacatttcctccagagctggtaggtatggaatacgatcagtttgagtatgtgtatttaaaagccttgaaactgtcataccgtttaaaccagtaattctactttcacaagtttgtcttaaagtaatcagagctgtatatgaatgttgatgctcaaagatgtttattgttcctactattttaaaatagtgattaattggaaatcaccttaatgtctaacagaaaaagattggttaggttaattatgctccttatagaatggactactatgtaatcatttatttaagacttcggaaaatacagtgtatgaaatgaaaatagatttgttgaatattatcccagtttttaaaattgtgtgtgtttgtgtgtgtgcctgtgtgtgtgtgtgtgtgtgtgtgtgtgtgtcttgggagtgaaattatgagcagtatctatttcttttacacttaaaaaaattccagaatttttacagtagtcatttattgtatttgtaatcaagatgaaaatctgaggccaggcgtggtggcttatgcctttaatctcagcactttgggaggctgaggcgggcagatcacttgaggccaggagttcaaaaccagcctgggcaacatggcgaaaccctgtctctgctaaaaatacaaaaattagccaggcgtggtggcaggagcctgtaatcccagctactcagaggctgaggcacgagaattgcttgaacctgggaggcagagtgagctaagattgcgccactgcactccagcctgggcgacaaagtgagactccgtctc

SEQ ID NO: 199480 - DNA, 339 bp, Homo sapiens
aatagcttacaagaacacaagaacagcttttctaaagaaccatcaccaacttagaatttgttaaataaaacagaaccgagaaagaaatccagccttagaacactgaaacatctaagtgcctgacacataacaggcatttatttggcaacggtatgttgactagacacacaatattgataaaaaaaaatttttaaatgtagtaactggacagtacatgtgataatataatctgcccaactggctttactgatttggaagctgaaactcaaaaggttaaaggacttgtccatggacacagatattttggagcacagccatgactaaacaatccttgtctcc

SEQ ID NO: 199481 - DNA, 498 bp, Homo sapiens
aaatcattaatccactttcctttgtcttgtgtttagccttatattcccaaagctattataattgtttaaatagaagcttctacatttattacaatcattacaaaatgaaactggttttgactttcacaatttcacttctcacctgagcaataccttctcatatgtatcctttgaccaaggcagaggtcactatttaaagcaggtagttttgaaaatattatgctaatcagcaatcaacacatttgtaactctccaccccctaaagcagaccaggtggatggttactcaagcctttgcaacagttccccttttcttcttatgggaagtggggaatgtgagaacttaaatattctaaaaaaaattaatagattgggtggggtgagggcttctctgacagttttaacatgcagaggtgtgcttcaatcatccaaactcctgaaaagggcatcaagcaccctctcccattccaaatggagccctcagctggggccaggcaaa

SEQ ID NO: 199482 - DNA, 178 bp, Homo sapiens
actccatcctggctgacagagcgagattccatctaaaaaaaaaaaaaagatacagttgtgaggtttcttgatgaggaagagcaagtcagaagcagtgaggggtgactgctatctggctttcatcatgggaaggcctgctctccttctgattcccttgccaggccatttaagatgcttc

SEQ ID NO: 199483 - DNA, 558 bp, Homo sapiens
gcgcaggtccaggcggccctcgtacatgaagtccagtaggcggccgaaggcgggcgccgtgacgatgtcgccgttgagccgcaccgtgtcgcgactgcccgcgggccggtccctgtagaagagatggaagtagacgctgcacgcggccagcacggcacggtgggccgggaagcgcgcgtcgcccaccagcacggtgcagtcgcataggaagcccagctcgcgctgctgtctcaggcggcccagcagccgtccgccgtgctcagggaactccatgccgccgccgtcatcacctgggcacaaacgggacgcccgtcagcgcgcctggaggcgcccacgaagcgcccttcccggctgcaggcagcgcggaaagagcggcgcgggagtgacgcgcgcaacctcccgtccagagccgccgcgggcacctgccccgagcaggaaaaactcgatcgaaagtaaacagtagcagctccgccgcgggggcgggtcccgggactcaggcgcaggagccggagccgcgcaaacctgcgcgcgtccccgcccgggcgctcctgaacttca

SEQ ID NO: 199484 - DNA, 663 bp, Homo sapiens
cttgagaatttcagaaatgaagtttacctccccagtccctttaaaagataaaaacaaattagctcaaattctaaccacagccataagtggtccttgtgcatggcaatggctaagaatgggcactgcctgcttctgaggtgtcctctgtctttgctgtgagcggcgtgacagctgtgccttccgtgcttctcttcggaggcttgtttctgggtatgtgttcaccgcaatggatgcttagattttggttcaccgaacgacacagaagtcactgcattcgatgtggtgacctcagagcaagtggcctccaggtccagtttatctaagtcagaagctgtgattcaggaaagccactgcagctgtttcctgtagagaggttggccgaggcaaggacctcatcacctgtgggcgtatctgcttgctaataccattgctgcagaggaataggttcctggagacggaggcacacaggcccagagaggaagtgacagggatttgtaacagatcacactgacctgaaggaaggccctgacgtagatatgtccccttttcacattcagagtcgttgctgctgcttctctttatgtcttggataatccaccttggcctcttgagtatactgtacctccctaacctgctgggctgaaaggccaagtgcaggcaact

SEQ ID NO: 199485 - DNA, 450 bp, Homo sapiens
aacatccgattttattgccgctgggtggacagcgccgtctagacgccgctcacccttctcaccttcgcagttgtctgtgtggaagacgggagaggcaggggcaccacgccactgtccccaagaccggcccccaggcactgcgcggaagaggccgtggcctgtgaggtggcccttccctgccctggacaggctgtggaggggctgcaggcggaggctgggcttgggagtgcttgaaggatcactgggctgtggaggggcccgcaggccgcctggggacctggggagggaagctccgggcctttctctggctctgcagacgcacggcctgggttcaaatgccagctccaccacttcctggctgtgtggccttggacatgtgtcttaccctctctgagccttaaatttccttctctggaaaatcaatgcttcatcaaataaaaagtgatcatg

SEQ ID NO: 199486 - DNA, 563 bp, Homo sapiens
cggaaaattaaatacagcatgttctcacgtataagcgggagttaatgatgagaacatatggacccacagaggggaacaacagacactgggcctcctcaagggtggcgggtaggaggagggtgaggatggacacactgcctagcaggtactatgctgattacctgggtgaagaaataatcgcacaccagccccctgcgacatgcacttcacccacataacaaacctgcacatgcaccctctgaacctaaaataaaagttgggaagaaaatgaaaacaccggcttcctgctttactcctccccatgcccagtgccactctccagagcaactattttgggtttttttgtttttgtctgttggtcctcaactgtgtattttcactctcctcattaaagtagagaatatttgtcatcattaaatgaatgaatgaatggactcccacccaaaacccacctgggcaagctcaggaagaatgtctggaggcctggaagactgggggcagccagcagcctccctgctgagcggttccaagcactgcccattggcatgtgggaaagggcacct

SEQ ID NO: 199487 - DNA, 484 bp, Homo sapiens
gcgttggccccaggcgggcatctgtttctggtgggttgtcaggcctcttacagcaagtacttaacaaacttagatttccataatcagatttatctcaaaccgcaaaaaaaagctgattttattatgttaaactgataggagatttttatgagagatgaaagtaagcgattttaactttttaatttttttaatttttgctctgtttctcacacttgaggcttttctgaaattcaccaaaagagttttggcagttgtggggaatttaccagaaccccccattattaaaacaattggtttcttatattaaaatcatcagacaggttttgtgtacacagacatttatgttaagccactgatagaactaaactgtgtgtaggaacctgttttctctaagaaaggactcctttgagttctgtaggatatgtgcttaaaggttttctgtgtcaagctattttatgaaataaaattttacaaacaatgaaaa

SEQ ID NO: 199488 - DNA, 354 bp, Homo sapiens
gctgcagcatgggtgacagaatgagactctgtctaaaaaaaaaaaaaaaaattacaagcaaaaagggccaccaggcacagtggctcatgtctgtaatcccaacactttgggaggtggagacgggatgatcacttgaagccaggcgttcaagaccaacctgggcaaaatagtgcgactcccgtctctgctgaaaatttaaaaattagccaggtgtggtggtgtacaccggtagttccagctgctggacagggtgaggaggagaattgcttgagcccaggagttgaaagctgcagtaagccacagtagcaccactacattccagcctaggccacagagccagaccccgtctcaaaa

SEQ ID NO: 199489 - DNA, 591 bp, Homo sapiens
cctcttcaacatctcatttctgtctcatactagtttttctaaaagccttccttcccatttctaccccgctgcacccggccaagttttcattttctaggtgctgttcattacttgaagaaatacattcactttgtcagcactgtggtttgtcatttggaaagaaaaatacaccctctttaagaaagcgagttccctgtgatgtagtgtgctttctattaggactcaaatcagaatgagtgttcagcactgatgttttcattccgtcctcctcctctcacctcctgcctgctctcagcccactgtcctctctgccctattcctccttgggttgtcttaaagtcaaaagctctcagggttatgttgatttgggcttgcagagaatttacctgttgttaaagaatacctttgagtatagcagcttctttgtttcttgatggtgatttttttcctaccttttaatgtttcaatttgatgacatggttgattaacttgggactataaggacttggaaggcagaatatttatatggtttgcttgcatatctcaaggtagatagcactttgcaaatggtaatatttgtttaataacagg

SEQ ID NO: 199490 - DNA, 100 bp, Homo sapiens
ccatatattcatatatttttgctcgttagtgtatttcttgagctgttttcatgttgtttatttcctgtctgtgaaatggtgttttttttttttttgttgg

SEQ ID NO: 199491 - DNA, 257 bp, Homo sapiens
atattgatagggatgttcattctgatctttcaaatgatcagaaattagaaaaaccccaaatgtctaccaacagagaatatgggttaacttaattgtgatatggtcatgcaatcaatggaatgccttggaatggttaaaaaatagatctatgtattctgccatggaaagacatgtaagagagtcagtttgttttttgtttttgtttttgttttttttgagacagaggtttgccattgtcgcccaggctggagtgcaat

SEQ ID NO: 199492 - DNA, 326 bp, Homo sapiens
agggtaaaagaatggttctgagggccaggagcaccaatcttctcttattttcagttttggaaactggatatactctgtattcagcaattgccttgtaatagacttcaagagtgagaaaaaagaatcccttaataatagtttctgcaaatgtgtgaaagctgagtgtgaggagaaaaagttgttttcaggaactaggagctggttcacctttaaaaagaaaatcagctgcctctggcaaaatggaattgcagcattgtcctggatggtaatttgcactagtaaatttatcaccaacctggcaggggagatgctgaagaaaaagcttt

SEQ ID NO: 199493 - DNA, 494 bp, Homo sapiens
caatcctcccacctcagcctcctgagtggctgggactacaggcgcctgctaccatacccggctaatacttgtttgtagagacagggtttcgccatgttgcccaggctagtctttttcttttttttttgagacagagttgcccaagctggagtgcaatggcatggtctcggctcactgcaacctctgcctcctgggttcaagcgattctcctgcctcagattctcctgcctcagtcccccaagtagctgggaatacaggcacccaccatcaagcccggctaatttttatatttttagtagagacagggtttcaccatgttggccaggatggtctcgatctcctgacctcgtgatccgcctgcctcggcctcccaaagtgctgggattacaggcgtgaaccaccacgcccggccaaattgtggttattttttaaagacagtattctgttttagaagtacttactgaaaaattacagataaaatcatacagtgtttg

SEQ ID NO: 199494 - DNA, 472 bp, Homo sapiens
atgggaaaaggataggcttgagggttaaataatttgtccggatcatgcaggtagtaaaatggcaaaggaatgaaggaaatgaagttcaggcttttagaggattgttttcttcccattctcgtgtcctgcttcctccatgtctgttagatggtggccgtctttgtccagacagtcatgaggccttggagaggggcttttcgctcagccacctgtgctctggggaaatacacgtctcctggtcatgccaccctctccaatgctgtccacagcaaactgacaggctctcctttatgttttcagtagctctagcccttgtctcacagcttttctttattctcagtctctgccctcatcccgggtgactcaatattagcatggatgacccttacagtcttagtctctctttccctcagcttcccccagcccctaaatcatcgtgttcattattctttggaaacccactctttgttcc

SEQ ID NO: 199495 - DNA, 113 bp, Homo sapiens
ccggcgaccatgcaggtaagggggtgctggtgctcttcagggcagcgactgagaacagggctcccaaccagctctgctcgctggtcccttcccttctctgggcctcagactcc

SEQ ID NO: 199496 - DNA, 235 bp, Homo sapiens
aggctggtcttaaactcctgagctcaagcaatccgcccacctcagcttcccaaagtgcagggattataggtgtgagccactgcacctggcctggaaaaatcctatttgaacaaggtgtaaaggattctgactcagagcagaagatgtgaattctagtctttactccgcctcctattaagtaggtcgctggccctttaagcctcgatttcccagcctgctttaacgcatgccaagt

SEQ ID NO: 199497 - DNA, 305 bp, Homo sapiens
gtacgatattgatacatacaacatagatgaatcttgaaaacatgttaagttgaaaaagccaacatattatatgtaacatattgtatgtaagaaataggcaaatccacagagacacagagtagattcatggttgccaggagttaaggaaagtggaataaggagtgattaccagtagacatgaggcttatctgggggaagatgaaaatgttctaaacagtggtgatggttatacaactatgtgaatatgtgaatggaccaaaacccactgaattatacacttaaaagggtgagttttatagtgtgtg

SEQ ID NO: 199498 - DNA, 347 bp, Homo sapiens
ctgattcctaatccatctccctctgtgttctctgtggtgattcatcctatggccacacagatgcacagagagctcttagagccacagatgccagcacagagagctagattttccccaaaagtgcataaatgcacccaacaggtagattttaaagtgtggtttttcagcagttgtagcatttccctgttatttcagggctctgaatatacctctgtgacttgaaagtgatcgtgaaaaatacctgatttactctgtggtgagacaacagatgttaaagacagcttccctgatgttaggctataaagctaggcgtttctccctcctcacagcaaagttttacatatcag

SEQ ID NO: 199499 - DNA, 534 bp, Homo sapiens
tcctaataaactaacataagtatttagaaattacaatcaagtaatttaactgtgtactctgtgaaaccgactcgtgtaccacccaccacgcttgggaaacacagcatgtattattacataagcgatggggatttggttgtaactcccataggcctgggacttgatggtaattcagttcaacaatgtttcctgagtaccagctgtttgccaggcactgtgctaggcacttgtgaagataacggaattaaaatgaataagacggttctgttctggccctgaaggagcttaacatcttaagagaaaaaaaagtctgaataaataactgcaaatatagataatagcttttgtagtacaagtattatatttcaatacagtggcttattagcatagaaaatgcatggaccaagtgcccaaattcctatggctttcagagttatcacaaagcagtgtagaatgcccatgttatgcctttaaagatttacaattaagtagattttagagaacaactagcgaatacttaaactgtaaaaatta

SEQ ID NO: 199500 - DNA, 341 bp, Homo sapiens
agcggtgcctctccgtggcctctgtcctaaattaaacgatgggctaagatgccttgaaatgcctgcagcaggcccggcgagagcttgaatgctcaaaggtgtctatgccaacttctgcttcttcaatcaaacttgaggctttaagagacaggcacgaataaggtgtctctccagaaggaaggcctgggggagacgcctgggctggggcatggtgaggacgccccaatccagaagcacagcctctgccctggacgtgcccagctgccggagccaggcgctgcctcgtggccctggagaaactcgccttggtcttgcagatggagtcatccaggacactgaga

SEQ ID NO: 199501 - DNA, 427 bp, Homo sapiens
caatgcaacaaaactagaaatctgtaaccaaagaaacttttgaaattgtgcaaatatatggaaattaaacagtatgcttctgaatgaccaatgggtcaatgaagagatgaagaaggtatcttaaatgggttttgaagcaaatgaagataggaaaacagcataccgaaacctgtgggatacagcaaaagctgatataaacaccaacattaaaaaactagaaagattttaaataaaccacctaacaatgcatgtcaaaaatagaaaatcatgaagaaactataccccaagttagttggaggaatgaaacaataaagatcagagcagaaattttactaattgagactacaaaacaacaggatgaatgaagcaaaagttgatttttgaaaagattaacataaatttaccaatagctagactcatctagata

SEQ ID NO: 199502 - DNA, 461 bp, Homo sapiens
aacattggtacaggtataccccagagatattgtgggtcagttccagaccactgagataaagccagtattgcaataaagtgagttgcatgaattttttggtttccccatgcttataaatgttatgtttacattatactatggtctatcaaatgtgcaataacgtgttaaatgtatgtatcttaattttataactgtgttgcaaaaaaatgctaacacatcatctgagactttaatgagtcataatcttcttgagtccaggagcaacatagcaagaccctgtctctacaaaaaactagaagaaattttgcaagaactaccaaaacgtgatgcagagacatgaagtgagcacgtattgttggaaaaatggtgctgatagacttgctcactgcaaggttgccacaaaccttcaatttgtaaaaaatgccatgtctttgaagcacaataaagcaaagcacagtaaa

SEQ ID NO: 199503 - DNA, 449 bp, Homo sapiens
ctctccttctctctctccgtagcctccttcttcctttgcttccaggaaacatgctttttcacctcaagaggccccctgaacctgactcttccactttctcccaattcatcagcaccactttggccttccttctttctaaactgagccccatggaaatgatgtgacacatgacaattcagctcatgcaccataccctgcctggtgctaagcacgtgccacacatcgtctcatatggttctcatcacaagcctaagagtaagagttcttcttgtcctcggttgacaggggaggagcttgaggattggggaggtgaaggcagccaaggccacatcgctgagcaagcagcagggctaagatttgatgctggctccccagccagcaccttgctctcttgtcccaccccatctctcccatgagccttcatctctgaaatgtcccataatcatctc

SEQ ID NO: 199504 - DNA, 438 bp, Homo sapiens
ataaaagtatttgttaaagataatacccaaattgatatgataagatctcctaaattccacaatcttatattcaattgtctttggggtatgttcatttaaatggaagaggtccaacaatgacatcagcgtctctccacccaaacttattcttctagtatttcttcgcttggcaaatggcgaatcacctaggtcagaaaccttgagctcatcctaaatgctaacttctctttcacttccaacaacccactggtctctaaaagtaatagagcccacctccttcatctctcacactgaccccttaccttcatcctcacctctgctgccttggttcgagccctcatctcttttacagggatccaccacagcatcccaactgatctggccttaggtcttcttctccaatccattcttcaaaaggctgccactgtgatcttccca

SEQ ID NO: 199505 - DNA, 705 bp, Homo sapiens
ctctagcacgcagtctacactggactgactcctgactctcccgtgactcagcggccctgcaagtcagctcgtgccttgcgtgcacagagcaggttcctccaccccgtgacccaggacaatgacctggcaagctcgcgggcatggcctggcccccttccctgcccttgtgcgttagaaccctcagggtcctatgtgttaattcccaaggaatgaaacagctggaaggacccaagaattgctgggatctcattcccatggcttactgacttcccagacctgatggaacaagcctgaggagctcgctcggctttcctggtggtctttcgtgcctcctgccatttttccatcttttgcaaaaggctgcaggcagcacccacacagccctgcatgaggcttgggtcagaagtaagggaaactgccaaatgcagccttctgggtcatttcaataacacatacctcctcaagcaatgaacgtcagccacgtccaacattgcacttaggtccaaagattaaccagccatttcttaatagaacaaacaagcatgttggctttgcctggtggaactgcagcctccgggcgactgggcaaaatccacgaagaactgaagtaagccctggagaagccttccactcagctggggaaggccaggagctgtcagggggtccgagctgtttgctgtggtgtacgggaggagagtgtagagt

SEQ ID NO: 199506 - DNA, 487 bp, Homo sapiens
tgtcttatgctccacctcggaggccagcaggaatttcagtatttctgtgaaaactgctttaggttatttctcctcttattccaatcagtttgccaaagaaacagctcataatgtgacaggagccggtccctcagcaacctagaagggatgggatagaactgttatctgagtgtcagatagaaaatatacgagcagggaggggtttcttggcacttttggcaaacattggacttctgcctggtaaacagatctttttatcctttctgttctgaaaattcctccttctccttaaccaagcctctgaggacagtaacacccaaagcattctattccaacacctgtctcccctggtatgtctctgggttggtggaattagcatagagattacttttattttcagggagggccgtaagactataggaaattgactttcaaaaagtagatgattgtgattaaataaaatacaaaatgttctattaatctactc

SEQ ID NO: 199507 - DNA, 278 bp, Homo sapiens
aatcactttaggttctcccacgttaactggtttcccgagtttggttcctgacaaagatatcctagagtaatcattctaaaacaaaaatgtgatcacttcactcaccaacttaaaaaagccttacaatagctatgtttctcagcttaaaaatccttcaatgttcctcacttgagaaagctgaagacacagaatgctagaatactcttggtgatctggtggcacttatctacttctccagcctcatctctctcttgcctaacccctaccctaaatctctt

SEQ ID NO: 199508 - DNA, 539 bp, Homo sapiens
cagagttgctaagaccatttaatgggaaaagaacaatctcttcaacaaatggtactgggatagctggatagccacatgtaaaagaatgaagttagacccctatgttttatcaaatacagcagccttttagtataagatctgattggctggatcaacaccctacatgtaagagctaaaactttaaaactcttataaaaaaacatagggttattcttcatgactttggatttgtcagtgaattcttagagaatgatactaaagcagaaataacaaaaaagataaactgaacttcatcaaaattaaacatttttgtgcataagagaataaattatcaagaagtgaaaagacagcctgtagaatgagagaaaatatttacaaattatgcttctgataagggtctagtatccaaaatgtatagaagctgggtgcggtggctcatgcctgtaataccagcactttgggaggctgagacgggtggatcgcccgagcccaggaattcaagactagcctgggcaacataatgagaccccatctgttta

SEQ ID NO: 199509 - DNA, 468 bp, Homo sapiens
tatgaagtccaatttaccaaattttgcttatgagaattgtgcttttgttgtgatagctaagaaatctttgtctaatccaaggtttcaaaagttgttttttcctgttttcttctaggagctttataattttaggttttaccattaggtctattaacgttttttagttaatttttgcatatggtgtgagatatggatcaaattaattttttttgtaaatagacattcaacttttcctgcatcattttgaaaatattatcccttttccactgaattgcctttacaactttacaaaaatcagctgtccatatatgtgtgggtctatttctgaattgcatatccagttctattcatctacagttggtcctctatatccatgggttctgcatctgcagattcaaccaatggcagatcaaaatattctggaaaaaaataataaaaaataatttgtatacattgattttgtatgct

SEQ ID NO: 199510 - DNA, 412 bp, Homo sapiens
gacaaagattgtctctatcctgtgtatacaatgtgattatttgatacatgtatatacattgtggactgatgatgacagtcaggctcacatgttcaccacccacgcggtccgtcagagcctcagaacttgttcatcttataactgaaagttcgtaccctttgactaacatctccccatcgtccctaatggcccagcccctggaaacccccattctaccctctgcttccgtgagttccacttttttagatgcaacatgtgagatttaaaaaaatatccagtgaaggctgtcgatgggacattgatgaacctgggggctatgtgagctctgggctggcgcctacccctcccacccaaggaatctctgcttcccgggctgtgccctcctgtgtgatctgaagtagggaagtggtat

SEQ ID NO: 199511 - DNA, 2038 bp, Homo sapiens
  misc_feature (3)..(4): n is a, c, g, or t
  misc_feature (6)..(7): n is a, c, g, or t
  misc_feature (1540)..(1540): n is a, c, g, or t
  misc_feature (1671)..(1671): n is a, c, g, or t
ggnngnngcagggctgaagttgggaccgcgcacagaccgcccctgcagtccagcccgaaatgctgccgccaggcagcaacggcaccgcgtacccggggcagttcgctctataccagcagctggcgcaggggaacgccgtggggggctcggcgggggcaccgccactggggccctcacaggtggtcaccgcctgcctgctgaccctactcatcatctggaccctgctgggcaacgtgctggtgtgcgcagccatcgtgcggagccgccacctgcgcgccaacatgaccaacgtcttcatcgtgtctctggccgtgtcagaccttttcgtggcgctgctggtcatgccctggaaggcagtcgccgaggtggccggttactggccctttggagcgttctgcgacgtctgggtggccttcgacatcatgtgctccactgcctccatcctgaacctgtgcgtcatcagcgtggaccgctactgggccatctccaggcccttccgctacaagcgcaagatgactcagcgcatggccttggtcatggtcggcctggcatggaccttgtccatcctcatctccttcattccggtccagctcaactggcacagggaccaggcggcctcttggggcgggctggacctgccaaacaacctggccaactggacgccctgggaggaggacttttgggagcccgacgtgaatgcagagaactgtgactccagcctgaatcgaacctacgccatctcttcctcgctcatcagcttctacatccccgttgccatcatgatcgtgacctacacgcgcatctaccgcatcgcccaggtgcagatccgcaggatttcctccctggagagggccgcagagcacgcgcagagctgccggagcagcgcagcctgcgcgcccgacaccagcctgcgcgcttccatcaagaaggagaccaaggttctcaagaccctgtcggtgatcatgggggtcttcgtgtgttgctggctgcccttcttcatccttaactgcatggtccctttctgcagtggacaccctgaaggccctccggccggcttcccctgcgtcagtgagaccaccttcgacgtcttcgtctggttcggctgggctaactcctcactcaaccccgtcatctatgccttcaacgccgactttcagaaggtgtttgcccagctgctggggtgcagccacttctgctcccgcacgccggtggagacggtgaacatcagcaatgagctcatctcctacaaccaagacatcgtcttccacaaggaaatcgcagctgcctacatccacatgatgcccaacgccgttacccccggcaaccgggaggtggacaacgacgaggaggagggtcctttcgatcgcatgttccagatctatcagacgtccccagatggtgaccctgttgctgagtctgtctgggagctggactgcgagggggagatttctttagacaaaataacacctttcaccccgaatggattccattaaactgcattaagaaaccccctcatggatctgcataaccgcacagacantgacaagcacgcacacacacgcaaatacatgcctttccagtgctgctccctttatcatgtgtttctgtgtagtagctcgtgtgcttagaaacctcaccccattgattggtagttcgaagaattggcagaancagttgcaataaactcagtcaaatgtacccagcctaccagagatggaccaacgatcctatgagagaagagagtatggtgctgggtccttaaaaaaaaaaatgatacttggtccttaaaaaatatgctctcccctccctttttaaacaaatggcttgttcagtcacttgtttgtgtttgaattgatttttaaacagcaggttgtgtgtgtgtgcagtgatgtggtgggagcacagctttcctgggtctggattcccgtggctttgtgcttatgtcatttcttctctctgtgctggtgggggcctctttaccatagcttaagaagtatccctgatttattctggtgtctaataaacacagattatttgt

SEQ ID NO: 199512 - DNA, 200 bp, Homo sapiens
gcgtcatacacatttaacatttgattgtacatgcaatggttccaggacaagttcttaacaatgaagcttggcctcagaatggtcacaaattgtattttagtcttttgctctgggacgcctaactgagtgggattatctatgtctttatttaaataattttcattaaatgtttttattttctatgatgggggctaaggaag

SEQ ID NO: 199513 - DNA, 336 bp, Homo sapiens
catatgcattctggcgaccatcactacggactctgacctttgaagatatccctggaattcccaagcaagatgacactctcaccagtgccatgacagttgataatcaccatgacaacaactggaagaagtcataaaaggaaaaaaggaagacagcactactggttcagagaagtttaccaccctattctggaaaaggcatgaatattgctccctttgcttttactgtacaaacccttcattaaagagactctatattttaacctcgtcatccttcactagttgagaagttgatttgcaagccacattcccacttctctattccacctgctattgaat

SEQ ID NO: 199514 - DNA, 297 bp, Homo sapiens
caggagtgctttggagagacagtaatttgcttgtatggaattttgcccaagagacctcattacagtttctaatcttttgatgttatcatccatcactgtccttgtcaaatagtttggaataggtatgatgatcacaataacatcaagcataatatttcattaattctcagaattagagaagatgatgtggtgatggaagaagaggtcagagagggagatttgaagatgttgcagttctggccttcaagatggagtcaggggctatcttcaaggtgagtcaaggaatggggtggcttc

SEQ ID NO: 199515 - DNA, 165 bp, Homo sapiens
tccaggaagagagactgactgggcaacatgttattcagaattagagaagatgatgtggtgatggaagaagaggtcagagagggagatttgaagatgttgcagttctggccttcaagatggagtcaggggctatcttcaaggtgagtcaaggaatggggtggcttc

SEQ ID NO: 199516 - DNA, 559 bp, Homo sapiens
gtgattccatgacactttgtttgtggcctgtcccttgtttccttgctaagtagttctttttatggtgtgaccctcaggaaggttaagtcaggagttcaggagcatcagagttctctagaaatgtgcctacttgttacctggaatacctggtctctaaacaaaccaacaaaaaatccacgtggcttttccacatgatggtgcagactggaagaggatgttatattggactcgttattggggaaatgaatgagcgggagaaaatgtgaatgacgggcaagaaggtggtctttctccctcagaagtcctaattcagctctggagttcatggaaatccgcaacttcagagtgtggcctaaggattattttgttggtcagcctttccaagaaagtgtgtgttctctcaatctctgtggattttctcattttttagcaaatcagtgagataagcataaataggaaggaagataccccaggtttaagaatcaccaatatcattaggcattggcatcattattagaattctgaattatagaataaaaggtacaacaaaaatttcaaa

SEQ ID NO: 199517 - DNA, 498 bp, Homo sapiens
tttctgaggcgaagtctcgctctgttgcccaggctggagtgcagtggtgcaatctcagctcactgcaagctccacctcctgggtccatgccatccccctgcctcagcctcctgagtagctgggactacaggcgccctccaccacacccggttaattttttttgaatttatttttagtagagacggggtttcaccgtgttagctaggatggtctcgatctcctgacctcgtgatccgcccgcctcggcctcccaaagtgctaggattacaggcatgagccaccgcggccggctccatatatgaatttttaaaagactgcctttgaagtgctcccaaaggagagtgaagataaacacaaatgtatatcattaggacatgtataatgtatcaaagcctcaaatggtatgggactgaggtggtactgttagaagaatctgcctgtgcttgtggaagggacatcacagaggaaaaagatacatatgtaagttaggatttaaaa

SEQ ID NO: 199518 - DNA, 489 bp, Homo sapiens
tgccctttatatactatttactgggttgtataagttagcatctctcagtgaaaaatatttgttaactgtttggtttaagctttgaatattgacctcctgctggtatatagttgataattaattctgaaaaaacagaagtccattattcttagctgtaggaggcaagaaagagtgtgccatccttggtaagagagtctttcaagagttgcccaaatttacttcttcttctggtaatacctatagagtagatcgtgttagagaaaaaaagcctcagaaggggctatttttggatcaaacacattagcttttctttctcacatggtgataatacaaacaaaggctcctgccagaagcacctccatggctgtctgcatattgggtttctcaacagcaaatagcatgtctctcaatatgagagcagatttatttcagaccccagtgtgaggcatcacagtagggaataccttgcacaattcccacttttaaatg

SEQ ID NO: 199519 - DNA, 454 bp, Homo sapiens
aaataaatgaacaataatcaccaaaatttttccctaaacctgtgttatagtcttaaaaacattttttcccctatggaggcttttggtaataaaacacaaattgagggattttaattaaaagaaatttttttttcaagaactggtcatgtactaaattgcttataatcaaataatcaagtagcatttcttttattataagagcaaaacctataattaagccaaaattcaaatttgtttttaaaggttgaataatcttttgttttggccaatagtatgtggattttttttttaagtattatctctttgtagtattttctaatggataggaaatgcctttctcaggttgaatgattatttccacatagaattagttcctgcttacaacagtgctccactaatgtaatggctcggtgaattggctttataattcattaatcatagctcacattgagct

SEQ ID NO: 199520 - DNA, 340 bp, Homo sapiens
aggtagatgatttcctttaagctctggaaaaggttggtggtaaaaagaaaacccaatgtctactttcttgagaatactaatctagtttcctaaagcaccactacttatttctttttcattttgcattgcactgttttaagaacagagggagtataaaaccgaggttagaagcaaaagacaggaaaatattttatttataaagctaaatatttaaatacaaacgtatatggaaaataattcctttgctgtgaaatttcaatgagaagctggtaacaagcaaatgagaccgtgctctttcattataatctactggtctttaaattcaacttgtgtctcataa

SEQ ID NO: 199521 - DNA, 689 bp, Homo sapiens
tgcctctgcagcgggtcccaggggtcggggcctggaagggtccctgggaatgctccgcgccgagaaggctctgtggtttctcctcccccacacgtctccctctcctcccctcttcccggggacctcagaggtggcggggaagtgggaagggaggcgggcttgcagaccgtgcaggctggggagccggagctcgggagttgggggagtccgagtgagaacggaagcgcgtggacgcgatggaaggggccgggggaaagggggacggcactggggagggctggggtgcggggcaggcgacagtcccttcccctccgagcggcgcgggggacctcttccccggggaacccccacccagccgttcccaacctcgagaacaaagggtctgggaagcacggtcggggtcggggagcggaggtggagggaggcaggaaggcaggcggtgggggcaggggagggcgcctccccacgtttcctctcgcggccgaatgatggaaagctccctccagcaaacgcctcactgaggccgcttctgaatccgggagggttcgggttcgttacctaacggctgcacttcgctcccttcctcccccagcgtccccaccccctccggggaccggggccccggagctgccaggcccgctgcacgcggcggcgcgggagaaaccacggggcagcagcgccccctgcag

SEQ ID NO: 199522 - DNA, 413 bp, Homo sapiens
tttggttctcccttaaattttgtgatagaaaagttgctcacttacctcttcctagccctgctcttgggttcactgttcccctggaaactttaccccctggaagggattaggcttgagacagaagatgggtaattaacaccttactggacattataggattcacagaaaatgggctttcatttaactctggatactatctaatcagctatatagagtgttgctacaatgattgctactgcggttatgtcttctgtcatgatagccactctcatttacatgagtcttaattcctgacccccaacatcttgatgttaatttgatatcctacaaagacattactgttaatggtacatttgttttcagaacaagccatatatcacagatgagtggcagtggaaacaaggagtagtggc

SEQ ID NO: 199523 - DNA, 329 bp, Homo sapiens
ctgggattcacatgctgaacgacattcatcctcaaatcatccttaaatctaggtggagtggctggagaacacatgtgtgccctgtgcatgcctgtcaataactgatgtgtcctgcatggaatgtgtccaggctgagggctaggctcctttgttctgttatttgtcctagacattgcattgtaaggaattagcccatgagagctgtgactatgtttgttttactcactactaaatcccttaagtctaaaatggttcctggcatgtggcagaggcttaaaaaattgttgaatgaatgaattttgtagataaaaatttcttctcaccaatat

SEQ ID NO: 199524 - DNA, 256 bp, Homo sapiens
cgagccatgatggagcctgcactccagcgtggttgacagagcgagaccttgtctcagaaaaaaaaaaaattctaatatttcagtctctaatacattttgttaattgtagccatccatgcactagcgaagaggaaagagtaaggcttatcctgttgaactgaccagagtgtggccagttggaagactgatcatcaaggtcagaattgtacctatcttataactggctgattgcacacagtgttctgtgaataataat

SEQ ID NO: 199525 - DNA, 274 bp, Homo sapiens
ggatgctttttgttaaaagggaaaccttatcaaggactctgttaccctcactacctgcctaaataatttctttctagctcctgtatcaacatcacttttattgtcattcttaccagactttatttgatggaggatgtgctaattcccttaaaagaaagcaaaatgaatattggtttaccaaaaataactacaagggcccttattgaataacattgagtatatgtttaaaaagcatttttatgatattgacaaatatttaaatgctagaatgttt

SEQ ID NO: 199526 - DNA, 581 bp, Homo sapiens
ctggcaaggactattacatgtagactggcatcggatgcagtccctagaaaataccccaaataggagagacttctatttctggcagttaggcagactagattactggaaagaccctcccaccgggaaaaaccctaaaatgtatagtaagattttttaaaatatttttaatgacatcaataactactcaattagcaaagaatactcataaatcaatgattaagtgaaagaggaaactcagagaaggggtagcatattgaaggtggctttccccttaaggatatttggtgaaccgaataaattctaataactgttcgcacagctttcccaaccataaggaatacaaggaagtccaaggctcctgtgcagtatctaataggagaccctccccatacgagcctgaaacctcaaaaggctaaactctcagtgtaaagatgaacaaaaaatactccccactagaaaactacaaggaaaactgactatctcaaaacatagtgctgggtagggccaggggaatttccctctgagaattcataacaataaaccatccctcacgtgagtttacaacccagtttgattgtatc

SEQ ID NO: 199527 - DNA, 374 bp, Homo sapiens
taacccaccttatctctaatattatctttagtaagtagaattaatgttctcatattaagtgaaaacactgaatttttaagattccctggcacctggtgatagttcaatactgtttgcaaaagaggatatgaagaaatgatgtatgtattgtcttttctagttttgcagtcaggttttatttttcctgactagccatcaacagaatcttctgacctatgcagcatgagaccaaagcccagaaaacagctcttggtcctaaaaccttggcagtctctctcttgcaactacatggctgcccattcaatttggtgccttttcctgtgtgttagtttctgcctgctatgctagggagtggctggtctttttttctgcta

SEQ ID NO: 199528 - DNA, 444 bp, Homo sapiens
ataaaatataaattctacacaaagggattttatccaattcgataatttcagacaatgtttcaacattaacaatttagtaaagaccagttgtaaaactaaaagtacgtaatccctaaatctttctttgtcagattaagaattttatatctaataaaagtgtgaagctggatgccatggctcacacctctaatcccaacactttgggagtctgaaggcaggaggattgcttgagcccagatgtttgagaccagcctgggcaacacagtcagactccatctctacaaagagtaaaaaaaaattagccaggcatggtggctcattcctgtagtaccagctacttgtagggctgaggtgggaggatctcttgaacccagaaagtgactgccatgacctgtaattatgccactgtactccgcctgggcaacagagcgagaccctgtcttt

SEQ ID NO: 199529 - DNA, 679 bp, Homo sapiens
taactgcttttggagaaatccatgttctgacaatccaaggtttcaaatttcattttcttccccaaaatctcttctcttacatgagctgttgcacaagacagaatctcattttttgtgctaatagctccttttgagccattctccatatattttaagcaatataatgtttatgcactctatcgctagttttatacttcaacgaaaaagtacaattctaagactttcctactcaaccacattatgaaatgaaaaaaagtcaattcaatctctgtaagtgaataattttcaaaaagtaattagacattgatttacagtaaatccacttggacatgtagacataattttgacaagatcgtattagatgctttgagttttcatgaaacctagagtgactgactttggaaagtgcacacatgctgtgtgtctggtgggacctgtcccaagcagtccctggcatttgggcagcataaggatcccctgggatgtgtactttacttctcgagttcaactcatgggttgagtcagattaaatcccaagtgagatatgcactcctctattaagctccccatacagcacctaatcatagccacacaatttctaattggatataaacacacactaaacaaaactcattcttcaactttaacttaaagatctaataaaaaatcctaatctgat

SEQ ID NO: 199530 - DNA, 616 bp, Homo sapiens
tgctgacataacattgcaatactacatctttatggtagaataaaagcatgtgccttatacataactttcatagaagatgactgcagagcagatctctgattgtgggaggaacagtgatcttgtttctaagcataaatcacctgaactgctaaattccctgaaatgcaaataaatctcaagaattatttgctaattaaattgatgtttatatatgtagattaatctagatactattgtagtgtctctagctataatacgtgcatgtagataagagttatatatacctgagtatccagtaattttacatggaaaaaagtataaaagattagactgcctatttatgttcctaagatattcgtttcttcctctttgactcatcttttatttactgaatttaattaatgcaatataaaccatttttccccaagttagatatgcagaaaaccaaatcaactgttctgtaaagataaagcaatttcctgaaaatttgtggtaaagctttacaaatgttataaaaatgggccacgctgcatgtcaaaaccacaggaatgtgaagattaaactatacattagagtattgtagtaaatagatcacacagagctaataactagttac

SEQ ID NO: 199531 - DNA, 610 bp, Homo sapiens
ctatcagaaactttactgtttggaattctctgagtaaaaatgaacgtcacacttttgtcaggaagatctaagtcattttgacacagagaactagctttgatttacaacttcagagctttggataaggggttgttaaacacaaaactctgcatctaccctaacttctttcccaggaaataggaccctagttccactctgcagtccagacctgatattgatccctttaacacagttctgtgcttatagtctatcaagatactgcttcatttatcttagttctacccttctccaaaattctgtaattttttctgttacatgagatgcttcacacttctctgatgtgcttgtccttcattgtattcagtcaataaacctaaatttgtcaggctacaggtttgtccctagcgattgagttacacagtttggaagacaccaccgaggtttccaagaccatgggactctactcagtaatttcgcatctgagaccccttcagtctcacacattagaggtttctctgtccccagttgcataggttttacactaaacttccactgggaaaaatctaacctagctgactttatttatcaaatactttatcttatgctcatt

SEQ ID NO: 199532 - DNA, 427 bp, Homo sapiens
ctttttcagccccacatctgaatcctctttcctatgtttggggaatcccccaccttatgaggcagcgcctacctccagatggtgattcaaaagcaaatgactcaaagaagctgggtcctcagaaaatctattctggcaagtgaaagcagcaagcacagcagcttcatccagtttccagagacagtaattctacctacagtgtctagcaccccctgatggtattggcgattcaacctcgtctgtgcctagaatcttgttcctggatgctaacttctcagcctatttctccagccctccaagagattctgtgagccacctaacaccctgttcataagttcctttcccagactcaatttctgttgctcacaactaaaagtcttgactattaccccatttgataaatgtgaaaaaaagctaataactttga

SEQ ID NO: 199533 - DNA, 225 bp, Homo sapiens
aaaatttagtcttggaacagggactgaatcttttttcacagcaactcaaaatgagacaccttttgcattgcaacccagtatacacacacgaaacaaaagtttacaaaacaatacctacccaatatgcacctgatattttcatcctattagataaaaattcttgtcaggacccactatatggctttcaaaattacagtttggaaaaacagcctattgagttgcctg

SEQ ID NO: 199534 - DNA, 464 bp, Homo sapiens
gaggaatggactgggctgcagatcagggcactgcttttataaaaaggctggcacttgcccatatgcaccgttcctgatgtccactggccaccacttgtggccaaccacacacacacacacccttgactaacagaactatttgtgaaataattgttctcattaattgaatattatggttaaatgaaaattgaccaggaaagtagtttttgtttgaagacttacttcaaataaatacctttccagatgtccacattcctgtgtaaattgattataatgatcattattatcttttttacttgaggcatcattctcattttgaacatatctaggttatgttcttgaagggacagtcttttatttgtgttttcttggcacttaatgcatcatatggcccagctaacacttgtaggaagaacatttgtcatttttcaatgaagataaaaaatgtatggtagccttttttt

SEQ ID NO: 199535 - DNA, 199 bp, Homo sapiens
aaggtggcacttgggttctgggctttattccatatgatccccagtaagccatttcagccccaggacttcactttccccatctgtaacctggaggaggggttgtctagaccagtgtttctcaaactacggcttgggatcacccacatcaggatcacctggaatacttccccaaaatgcagatttctaggccttgggctag

SEQ ID NO: 199536 - DNA, 265 bp, Homo sapiens
ctgtaaccactgcctgtcaccccacgtctagacactagcaaacagaacactcaagtttctgctttcctgcttggcagcaacaacagaccaggaagagaatctcttccaaacttctgccttccacatctcctaggtggaacctaattcacatccagctataaaggagtctgggcaatgtagtttttatctttctagcccctgtaatgcaaaaaaatatattagaaaagatttggaatgatgtccagtacagctgatagtatccagc

SEQ ID NO: 199537 - DNA, 279 bp, Homo sapiens
gactccccagtcttcataactgtgagaaatacatttctgttatttataaattacccagtctgtggtattctgttatagcagcacaaaatgggactgagagctacctaacattaagtcctatacaagagtagaagtgggctgcaaaattgactgagcctcctagcaactgaagcaaaaaaggaaacataatcacagttcaatcacagtggccatagataaaaacaagcctgtttctacacatggtatatttagcacatcatttttctgagatttgttggg

SEQ ID NO: 199538 - DNA, 348 bp, Homo sapiens
catcagcctcaggtggcctgcgggtggtcagtggggaattttaagccaaggtctggctcagcaccaacgacaggaactggtctggcctgattgtagaaagggaggtcctatgacactttcacaacatcttcccgaagacagagagtgggtggccgcttccttatcctgccatggccgcctgcttgttttaactctgagtgcatcaggtggccacagggagccccttttgtctgtcggctgggagcacacttaacaaagcttacattcaggaacacatgcccagtagaggtcggaggggtgcgatgttggaaatgagattaaataaatgcctacgtaatattcacagag

SEQ ID NO: 199539 - DNA, 417 bp, Homo sapiens
tcttctgtctcctgccatcatgtaagatgtgcctgcttctcctcctctcatgattgcaagtctcctgaggcctcctcagccatgaagaactgtgagtcaattaaacctctttcttttataaattacccagtcttgggtatttctttgtagcagtgtgaaaacagactaatgcaattaccataatgggctttcaattgatgaacttgcatcactgactcctcaacacgcagctgacttcctactgtaattgttcaccatgcagacatttgtggagccacaagcataaccatcatggtatttaagattcgttctgtatctggatttatgcagtttatgaaaaatcatcaaactgtccttattattggtgtcttttttctgtatatatgttatgcttcaataaaatatttacttaaaatt

SEQ ID NO: 199540 - DNA, 452 bp, Homo sapiens
atgtgggaatggagtatcttaatctctctgaggtcactgactgataggttaagtgtcagctgggctcagcccaaacattagatgttgctgggaaggtattttgtaactatgattaacatttacaatcagttgactttaagtaaaggggattatcctggctatgggtgggccaaatccaatcaggtgaaggcctgggaaagaagaagaaggaggaagtctgccttaagactgtgacatggaaatcctgcttgagtttcgagcctgccagcctgctgcacagatttcacacttgtttgtccccacagtggcagcagccattattccttaaaataagtctttatatacaatatatttctctccagagaaacaaccaaaaatactattggttctatttcgtggaagaatcctcactgatacactcaccctcaagaagaaaattaacagtttttacc

SEQ ID NO: 199541 - DNA, 159 bp, Homo sapiens
aaagtcagctgtgatgcagcagagcatatatactgacagtctttacttcagtctgtccactttggtggttttttttaagccacctttctcagatgagcagctaatcagaaataaatgcaagttggccaggcacgatggctcacgcctgtaatcccagca

SEQ ID NO: 199542 - DNA, 332 bp, Homo sapiens
gctaatttggatagtcataatactactaattaaacactgactactgatttaaccaaaacctgtgatataattacattttcacacacttgagtctataactttgtaatctacctaatacagaggcatggtctcaattcttacaacttctatagaagcattattagccttatatcctttggagcattaaggttctcttctttaaaaaaaggaattaacgctatgaagattggatcctaaagaagctagcacacaaaatggacccaactatgccatttgaatgaaaaggattccaatgcctggatataaaagcaaaatgtgtttcaaattccact

SEQ ID NO: 199543 - DNA, 443 bp, Homo sapiens
cccgaggatcacccccgcaccacgataaccatcctaactcttcaaagtttccccaagggttctctatacacttcacaatgaaggcagctccaatgatgtgagaaatagaaaagagtcattcaggagcttcttagctgggatcacagttaatcaaatatctaactatgtctctaagaaaccccccacctccaacttaagaaataccagacaacatacttgaatttgttggaaaaaaaaatgcatcttatcctagaaaataaaatggatgggcaatatacaacaggaggaaatatgtcagtcactggtagattctcctataaaaactgtggagtgtttaaggaaaggtttgatttagcatagatcgtgttccatatagttacacacacaagtacaaaaaaagactcactcaaaatacacaccttcagactttttttttttgagtc

SEQ ID NO: 199544 - DNA, 613 bp, Homo sapiens
tcacagcagccctgtgaaggagcactgtgccatcctgtgacagggcagccgggtctcattggcactgggtgctgagggtggtgggtgggcgcaggccttgatgcctgactctgaccttgttctccccggcgtggtctgcaccctgtgaagggtgagtgaacgccctcctggcccagttcagccccaggttgtgcctgttgtccccacatcgttaataattatccatagcgtccccttcactcgcagaagcgtccgagcttagacagcaagttccacggccactccaacctgcggtctcaaacccagggcctgcaactcccgccatgtgccccgttctgcttgtcacccgcctcgccctgaggagcctccagctgcttcaggaattgtccctgtgtcacacatccagggcagttgttcactagcatccccgctacccctgaatccatctccacgtgcgtgggcttggacctgcttctctcgcccacttatctgtgtatctctgagtagtgagacttccacgttagcgctgtggggaagaggctgggcttggctcagctgctgagggatcagccgaccccaggtcgctgcggccctttcaggaggacgttggggg

SEQ ID NO: 199545 - DNA, 569 bp, Homo sapiens
actttcaggacaattagttctagaaggacgcattataaggtgatttcttgttatccttccttgaaacagatagctgcattttgtcaaaaataaattcagatcccaagggggcctaagtttagttcaaaccatcagaaaggaggcgactcaagctgtgtttacaatctggcagtttacttccttcgtatgtagctagcagtgggcaagccttgcacatcggattttaaggttaacagtaagaagcattttctaatctcactgagaatttaaggaaataaaacccttttcttcaacttattcattcttttcttcctatggcaaacactccacagtatttttagtaaagaaatgtgaactagtcagtgtctaaaaaaaaaaaaatcagtaatttgataacgttctgagacataggctctcttttttctagaatcttgtattcttttaggtgactctttgaggaaggaggtcaaaatattgagtgtgagcaatttaaataggagacattgagtaatttaaaaatgagacattcagtacaagactcattcatttaaattacatgaaaatccaag

SEQ ID NO: 199546 - DNA, 294 bp, Homo sapiens
agtctaactaaccccttattttattgataggggaactgagatccagaaaagctatggtttattagtagcaatccccttgtaatctacataaatatactgatgtgactaaaaggtttaaaatactgtatttaatattattaaaaggaagagacaacaaatacacataagaaatgcttcaaaattacaaagaaaaaaattacaaaaaggaactctccgctcagaacagctagtcatctgttctgatgttagtaacaaatagcgaattaaaataaagagttttttaaaaataaatta

SEQ ID NO: 199547 - DNA, 318 bp, Homo sapiens
gacctcctttagtgtggtatctaagcgttcagcaggatggctgattttagtaacaaatttaacaaagagccaggaatttggtctgagaagatggctggcaatattgccaacctataaaggtctagcaatcatcttctgatcagatttataggtctgagaaatggattttcctgaatgagtctgattatcttctcaaaatcctggaatcatattagattcctcattgtcttcactcttcatagccaatcaatcactaaagccctgccaattctacatccaaaacatctttcaaatctcctttccttcacctctagtgac

SEQ ID NO: 199548 - DNA, 370 bp, Homo sapiens
ggacataatataaagaatgtactgctgatcccacagtaagctcaaataactattattagatagctattgttacgataatagaacttagcagatgctgatttacaatccaagtatcaaatctattgactcacaatattagtgaaactgtcaaatagattaaaattattatgtccactgtgtattcttttctagttaggaaattttgcctcggaaaggttgcttagagaattaagagaaacagtttgtcataatggctatcatcaccaagctctgatgcctgatgtattagtcttccctaagaggattaaactgtcatgtcaagcagaatttacttgggttccctttaccctggacacttaacaaactcttc

SEQ ID NO: 199549 - DNA, 428 bp, Homo sapiens
acaggctgttgcgcgtcctgagttcatggagggaggatagcatggacagaaaggttggtgaccacatcctcttctggcctgtccttctccatctgcccctaagtgagggaccaagatgtctagtctaggagacttggttcaccatcagcagtccatagtcaggtagtccacaaccaattacggtagttttagttttggaaaacattgaacttaaaattttttttaaattaggtaaatgtctattcacatgcaaaatatatttttcaatcttcatgatttttaagacattgtataactgaagagtgacttcaaaataaggacttctaaggagatgaagctgacaagaagagaaaataaccaaagagactgataaacatttccaggtcataaaatgaaaatggaaaagcaaggacacacagagggagaga

SEQ ID NO: 199550 - DNA, 439 bp, Homo sapiens
gttcacttctcctgccccagcctcccgaatagctgggactacaggcgcctgccaccacgcccagctaatttttttgtatttttagtagaggtgggttttcaccatgttagccaggatggtcttgatctcctgaccttgtgatctgcccacctcggcctcccaaagtgctgggattacaggcgtgagccaccgcacccggccgcattaatattgttcattatgtatttttttataattaataaatctgattgatgcattattattaactgaagtccatagtttacatgcagattcactctttatgttggacagttctatgggttttgacaaacgtataatgcatttacccacgttatagcatcataaatagcagtttcatcgccttagaaatatcccatgctttctctattcatctcttccccttctggtaaccatgatc

SEQ ID NO: 199551 - DNA, 484 bp, Homo sapiens
aaataaaagccatgtaaaattaaggactaagttgtctagtctgtgctgaaaaacttagtccataaaaaataaaagccatgtaaaattaaggactaagtttttatggaagataattttctctcattataaatttgcttaatgggggaataatatataatgtgtatgccacctatccttgcatacattgaaaatattttagcttagaagtttgtagcatacaattcaatcatttataccataccaattatttcttctttgagaccttgacacagtaaggttatattctaaatatatttttagcaattaaatatcaaatctaacccaattagtctaacacaggagatgcgttcaatcacgtgtttatgtttttctctctatgaaaaagaatataaattggccttttttcactatgcagccattactgtgtttctggactgctcccagtctgtcagctgaacagttctgggtgcagcttgtctgatga

SEQ ID NO: 199552 - DNA, 987 bp, Homo sapiens
ttgagatggagtctcgctctgtcgcccaggctggaatgctgtagcaagatttcggctcactgcaacccccgtctcccgggttcaagcgaatctcctgcctcagccttccgagtagctgggattacaggcaagcaccaccatgcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttttcatcatagtcccaaaaaccaatactttacaagtggttttggaaaggcaccacttttgtggcatgttctggttgggagagggagtcacagttcctactccccccaccagctatgcttctgctctgagaaggtggttatttatacaaacatggacatactcactcccaagggctgatgagatgctgaattttctttgggggcattcattaattgtcccagctgcagcgactggagcaagtctggaagctgcctgtgctaagaccacccagctgtccctgggttctcatcctagggccttctttgcttccaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccagaactctggtgtctgacctagaagaggccagtctctctactggagaaaacgatgtgccgatgccaggtgcagggggccctgtggccctcaggacggggaggccgggtggggagcccggctttctcgggcttcgtgaccacttgggtcttgccggttcctgggtggtcggggccctccgtgtcgccgccgcggtgcggggcccccttgtcgccgcccgggttgagcgggggctccct

SEQ ID NO: 199553 - DNA, 339 bp, Homo sapiens
ggattacatatgtgtgtattcagaaagtaaatttgtttttcttggccttttaaaaaatgtttttattagatatcataactatttttcattttattacatgtttttatctgaagatttcaaatctcctgtagatacctacccattatctagaaggattaggtaaggttatttacctgtaaaacatgtaacacaaagaatccttccttttgttctttggggttaataagagtgtcattattaatgttgatttctttctttcttgcatttttgtctcctcttccattactctggctaagattttctttatgatcaacaatattttgaaattgctcttaaact

SEQ ID NO: 199554 - DNA, 308 bp, Homo sapiens
acagaaagtctactgggattctaaatgttattgtagtacatctatagattaatttggtgtgaaatgaaatcttagcaatattgatctttgagcttctaagcacagcatgtctctacattcccctaccatctcaggacttctgattagaatgctatgttgggtgatccccaagactaacgccccgttcagtgatgaactgggatacttcacaagactcagcatgtagttttacaaatggctatgaattgttacggcaaaataatacataacacaatcagaaaaggtaaactacctatggggcgaaggcc

SEQ ID NO: 199555 - DNA, 309 bp, Homo sapiens
ccaccacatccggctaattttttgtatttttagtggatgaggtttcaccatgttggccaggctggtcttgaactcctgacctcaagtgatccgcctgtgtcagcttcccaaagtgctgggattgcaggcatgagccaccatgcctggtctaggaatttctttatagtagtgcaagaacagactaatacagcttctatgtgcaacaaattgtaggaaagtaagtatatggaggaaactagtggaagatgtggattatttaatcagttttattatgcagactcaagttattacaatcttcagtgataagag

SEQ ID NO: 199556 - DNA, 271 bp, Homo sapiens
tgttataatcagaatgcttcagatcattgcaaaagagctgggttttgttttttgtggatgggccaaactaatttattatgagacagaaactatggattcacatgtttttatataaattaaggtattgttgacaaataaaaattgtatatatttactgcatacaatcagaggtttacatatatgtgtaccttgtggaatggttaaatcgagctattacgcatatgtatcacttcacatactttttttttttttttccctttctggagcaaga

SEQ ID NO: 199557 - DNA, 217 bp, Homo sapiens
caagagtctagattaacttctctccttcctagtcatggtcactccttcattcactgaagactttggcagtggtttccactcttcgtctctaccccaattcccatcatcttagggtcaccctggtgacttcgaagtgcacatgggtagccccttcaacactgcatggccacagtttatcacctcatctctaacaaccttcttttccatgtcactttac

SEQ ID NO: 199558 - DNA, 368 bp, Homo sapiens
ttaaaggctataaaatagcagttacgtaggatgaacaagtttagagatctaaggtacaatatgagtactaaagttaataaaattgtactgtattgatggcagcagtggcccatctggagtggctgctgccatgatgctggttgcagtgtgggaggctctgctggggctgcatgttccatggagccagcaagggctggaagcaggcaggagccccactcttctgggcacagctgcagctacccaagttgcggctgcagacctgggcatctctgcactctcgggggcctgggaaggctcccgtgcccctgcaggctcagggtgtctgcttccaatgtctggactctcactgctcctggtgcctgctctga

SEQ ID NO: 199559 - DNA, 408 bp, Homo sapiens
ccaattctttctcctcttctgtccactgtatgattattattagttccaaatctttgggagtgtcattcaaacatgtttttatgattataccatcttgctgttgtactatgtaacacagacatagattgaggtatgggagaagttatcagtgaatcagacatttcactcaactaatattttttgagcacctactaagtagtataggatcataggcccacagggcttagaacagtctaggccagcgctaccaatagaacattggctgtggtggaatgttctgtatctcagttgtctaatgtgtcagtcattagctacatgtagttattggacccttaaaatgtgatgtgaaagaaaatatattaactcttggaggccaggatcgtggcggctcacacctgtaatctcaca

SEQ ID NO: 199560 - DNA, 2199 bp, Homo sapiens
  misc_feature (2)..(2): n is a, c, g, or t
  misc_feature (6)..(6): n is a, c, g, or t
  misc_feature (8)..(8): n is a, c, g, or t
  misc_feature (994)..(994): n is a, c, g, or t
  misc_feature (997)..(997): n is a, c, g, or t
  misc_feature (1014)..(1014): n is a, c, g, or t
  misc_feature (1023)..(1024): n is a, c, g, or t
gncacngncctcactgaagtgaatatgaataataatacaagtaattattatcgtattggattttggaaagttggatggtgatattcctttggcatgcgagactattaatatgactcgtgctggaaaaagtcactcatgttttctctgggcttggattcctcattccttcattcaatgaacatttgctccgcagttacttgtgcgaggcactctaaccggagactgaaggtatagagcaagcttgtccaacccgtggctcactaaccgcgtgcggcccaggacagctttgaatgccgcccaacacaaatttgtaaatgttcttaaaacattatgagaggttttttttttgcgctttttttttttttctcatcagctatcattagagttagtgtattttatgtgtggcccaagacagttctcccagtgtggctcagggaagccaaaagatcggacgcatggtatagagaaaaacaagaagcatccctccatagcgtatgccccacaagagacaatttcccagagaccagtagctgaggcaggtgtaggaagtgaatgggccattagatggatgcctgtggaagctaaagaaggcggatcggaggaagacaatccgacctggggagtggaggagagagggggagaaggtggcatcgacttggattttttaagattgagtcatttggggcacttggaaatgggcattctgggtagaaggttcagtattaacaaaaacaaaacaatactcttgagtgggaagaataatggatagtttgatttgcctagaatgtagagattaataaggatgccaggattctagggcgggggacaagatggggagtcagtggtgggaagccctggaagattccaagcaaggcatgacagtgctgtggcagcggatagttaatttggccaaggagtggaccctcctttgtagcgtgagagtgttggaccaaggatctttgcagcactgagagtctatgaattagccaatctnggnatacagggcttcatggnaacatcacnntgtaggaggattatggatggaaagtgcagctggaatgggaaaaggtcgaaacctaattagaagccttgggccaggggtagcctgtgatcacctgcgattgtgtttcagacttccagtaacattcttgggagtagttgttaaaaaagtgctcttcgtgtttctgtaacttgggtggcctcttaggcatgagcagacgttcagcctgtccctatcggcagggaacatttatttattttgatgcatccccagggaccaacagagagctataaagacagcagcctgttttgccagttggccagttgaaatgggaaatttcttatacaaagattacagacttaaccttcatgccactctttattataaactgttcatacagttctttgcagatggactcaaaatgaagcatttttttaccttaaagattgtagtagaggatgttataaatgtgtctttaattggttctgtgttttctcatacttatgaagcactgcattacacaatttgtctgaatgaaattggtagatgtggtccatgtaaaacttacccaatcagacaggttacagatatttgcctaaaatctgagcctgggcaccttagagatattctaacctcacccggaaactccgcaactggaaaggtgcagggattctggagcgaggttccacttcacattatcttctggttctgcatatgaatatttaaaaacttcctgtggtgttatatgaaatatgtatttgcatgcttttgcagctgctccatctaatagtatttgagaaggggaaaaaatgaaatgttgcttagtagaaattcctttggttaatgatgttaatcaatggtataaaaaaggagcatgaactctggaataagaagggacacctgaaattgaattccagttgtgtcgcttactacctgtgcgactttaggtctggcacttaactcatctgagtctcagtttcctcatctgtaaaatggtcaccacaataatcagctcgcagtctaacagaacaacctgtcaccactagaatcccacttgttggccttttatagccacacctacttccctcccactgcctcctccacttccttaactcatagcaaccactgtgtgttcactatctttttaaataattgtatcatttcaagaatgttataaaaatggaatgatatagtgtgtg

SEQ ID NO: 199561 - DNA, 333 bp, Homo sapiens
taaggacattttcctgctgcagataactagccagagcccatccttttgtttcccgtaaggaatacttttagtaaatcttatcactggcttgctgtcaataaatatgtgggtaaatctctgttcaaggctctcagctctgaaggctgtaagacccctgatttcccacttcacatgctgtatttctgtgtgtgtgtctttaattcctccagcaccgctgggttagggtctccacaaccgagctggtctcagcagtaaatattgaaaaggaatagatacaattgtcattatttacagatagaatttccaaacaattcccagggaataaactgaaaa

SEQ ID NO: 199562 - DNA, 707 bp, Homo sapiens
tggaaagaatctgaagtcgttaactccttttaggtcctgtgagatggcaggcattccagcattacatctgactgatgcggctatgggcctagactgagatctgaaacaggctgttagggaaattctggtcaatcttgaagtctcaacctctttgctctctaaattgtccaccatcaacgaaccccctccaaggtttgctggaaacactgttagcctgtaagtagcagatactccctcctctgtttggtccagtaacctgtaatgtcactattctttttacttcttgttgccgctcccctcctctcccaagctcctcaaaagccaaacataaaacttccagaaatacaggtctagaaacatactcttactagtaaatccaaccctaagtctattttcttgactcttccattactgttaagatcttaaataagtaagactatgggcaagtcgttctaagaaggggtttgtgctagttttcctcctcatgctttcttgcctggtcacgtacttaactacctaaaagtttagctatggctactttctttctcacagaaattaaattattaaagcatttagcctttaacttcatcatagtattatttcattagcagtatttctacatttcttttactcacttctgtgtaaacactagtctctgtttcttacagatttatgctataggaggcgcagcatgggattcaaaggaa

SEQ ID NO: 199563 - DNA, 480 bp, Homo sapiens
aggtcttcatgcggctgtcaaagagccactccctggtcttcctgacgaagtctcccctgccccatcattcttggtcccatgcagtatctgaagttatccgagtcacttttctttctttctctttctctctctttctttctttctctttctttctttctttctttctttctttctttctttctttctttctttctttctttccttccttccttccttccttcctcctctctgtctctttcttttttttttttgagattttttttttgagatggagtctcactctgtcacccaggctggagtacagtggcacaatctcagctcactgcaacctccgcctcccagattccagtgattctcctgtctcagtctcccaagtagctgggattataggcgtgcaccaccacacccagttgatttttgtatttttagtagagacggggtttcaccatgttggccaggctggtctcaaactcctgacct

SEQ ID NO: 199564 - DNA, 272 bp, Homo sapiens
aacatacttcctgtacagattagcatggactctggtactgaatatattgctactgagttgataaatgctttttttttcaatatccattagtgatggcatcaaagtactgtagtctttccatggcaaggactacagtacaccttcaacataatagctttagggctatgttaattttcttgtcataatctagtcctcaaggaacttgattgccttgacattctgcagaacatcacatgggtccattatcttgatgttataataattgcatgggg

SEQ ID NO: 199565 - DNA, 157 bp, Homo sapiens
ataaatgtagtctcagataataggaatgagtggatgaaaggggctgaatatgagagaagaattgatcatgttatagtgaccagcttcaaatttccgaactgaaataatattatgagtgaactgttttaaatcccacccagtgatgttgaaaatagta

SEQ ID NO: 199566 - DNA, 385 bp, Homo sapiens
atttcatgaacctcttccctgggaaaccttatgactcaacagtcaaaggtgtccgaatagtaaagatggttttcagtgatcaggtctgtgcccatgcctggccttggatagactctgaaatgagattctttgtttgattgatggggtgatggtttctgttgtgtacatttgaaggaaaccagtttccccacccaaaatttctaaggagtttaatctttggggtataggggagttaaactacactgagtcaaggaagtaattgattgcatatttcctctaaaagtcagctatggacttgatattgactaaaacaaactagcagttctcttccaccaccaagtcagagcgtctgttcaccattctgcatgattaaaagaacaactaa

SEQ ID NO: 199567 - DNA, 431 bp, Homo sapiens
  misc_feature (27)..(27): n is a, c, g, or t
tcttccgtacccccctaccatctcttntaaatcaaagaaagattaatatatggggactttggcctcaacttaggaactaaacttaaaaaggagtgtcagctggccaggtgcaatggctcgtacctgtaatcctggcactttgggaggctgaggcgggaagatcagttgaacccatgagtttgagaccagcctgagcaacacagcaagactgtgtctctaataataataataaaaagaaagaagaaaagaacgaaagaaagaaagagaacagaaagaaaactgggcatggtggcatatgcctgtagtcccagttgctcaggaggctgagcaggactattgcttgagcccaggaatttgaggctgcacacttcagcaacagaatgagactccgtgtctacaaaagaagaaaaagaaggccttctcccttttta

SEQ ID NO: 199568 - DNA, 613 bp, Homo sapiens
aagcgctaatccgtaccaacaaggaaagatccccaagacatactgttaaggacaaaatagtacacaacaggttagataatgatttacctttcatgtaaaagaacgtggaggggtaagaacatatgttcatatctccttttatttacataaagaaacactgcacagatatataaggaactattaagagtgacacccacaataaggagcaggggttctacagggtggaccagacaggagtggaaataatactcgtcaacatatgcctttcaaaaaaattttttttcatattttaaatttacctttactacctatttatttggttcaaggctccatttcgtccactttgggactaggtaatcaggctttaaactacttacctctgcctgtcagaagtcactaacctcatgacaggaataatttaggttagaggagtagcaaaactattactcaactgtttctttagaaaaggagaaactcataaaacatgggaccctaaaatttgaatattatatgtaagacggggttaaaatgtgttcaaatagtgtcttctaaaaatgtacaaacaacagaggtgtgacagtatgctgaaaaaaatatgaggggggtggaagag

SEQ ID NO: 199569 - DNA, 586 bp, Homo sapiens
gcttataacaccccttggcatacctcttcactaccccagaggtagagttaacacagagtaatctcagagagtaacagaaacctaaggcaatctgggcatgtttcctctgtgcaaccaaaaagaaactaagtagcactgctatcatttattaactacttactattctttcattaatcaaatatttactgagagccaactatgtgctagccattgtaaatggtgaagatggaacaactaaacaaaaagacaagtcccttctttcacaagcttgagtctagttacaatgaagaaaattaaagtgcaactacacatttcatgcatagataggtagaatatacatatcttctaatcaaattgctttcacacaacatatataacttaaaatcctctattttcatttaatatgacattgtaaactctcatctccttccttccattataaatgcatggttatggccgggcatggtggctcacacctgtaatcccagcactttgggaggccgaggcagacggatcacctgaggtcaggagtttgagaccagcctggccaacatggtgaaaccccatctcttctaaaaatacaaaa

SEQ ID NO: 199570 - DNA, 512 bp, Homo sapiens
ccatattgatgccgaacttagtgcggacacccgatcggcatagcgcactacagcccagaactcctgagctcaagcgatcctcctgcctcagcctcccaagtagctggcactacaggtgcctaccaccatgcctagtgcctcatggaaatttgaaaatgtgtttaaatcactcttgttggatataatttttaaaagatggtgatagaaatgtaaaatggtgaagtcatggtggaaaacaggtagttcctcagaaactttcagcatatgccatatgaccaagcaattccactcctacatataaacccagaagaactgaaaacatgttcacataaaaacatatacatgctgtggaaaaacagtactgcaggtcctaaaaaaattaaacacaaattaccatatgatcaacaatttcgcttctgggtatatacccaaaagaattgaaagcagggactcaagcagatatttatacatccacattcatagcagagttattgataatagccgaaaggcag

SEQ ID NO: 199571 - DNA, 230 bp, Homo sapiens
aagtgaaggaatttcacagagctgaagatcaagcgcctgagaaataagtttgcccaaaagatgcttctaaaggcaaggaggaagcttatctatgaaaaagcaaagcactatcacaaggaatatatgcagatgtacagaactgaaattcaaatatcgaggatggcaagaaaagctggcaacttctatgtatctgcagaacccaaattggcgtttgtcatcaggatcggagg

SEQ ID NO: 199572 - DNA, 288 bp, Homo sapiens
gggatgcacaagctacctaagcactactgcgctggcactagtaaagcactgagccaaaaggtccccagaggctgccacatagtctctgcccatcctgagtgaagctgcacacttggctcaaaggccctgctgatccaccgagagggcacaagggggcatgagggaaatggctgaactccaacaaatcactttatgcaggactgaatccccaacacacatcagaggagacaattaaacgagggagagtggacttaaaggtaaaatgtcatcccccaacatgcctgtgat

SEQ ID NO: 199573 - DNA, 193 bp, Homo sapiens
tttcaaggaacctcagactgttttccacaatgactgtgttttacattccttccagtggggtgtaagggtcatggtttcttgtttcttcacgtatcttgtaatttttttattgaaagctgaacatttcaaataatttaatgcgataactttggaaaccagattctccctctgccccaggattctgttgttacag

SEQ ID NO: 199574 - DNA, 600 bp, Homo sapiens
ggcaaactgtggaaaaccagaaccagtgccaatgacttaaagtctcagttgagcttgttatatataaagcacaggccagatgcaacaagactaatgaaaacatgctgtgtccagtttaccatcaatgagaaaaatgggagacattcaatctgctttaaattggggccatctcaaatgatatgtaaaacacagagttatggcctaccattcctgagtgacaattcttgactctgtgctgaatattttggtgggatttgtgttgtatttgtattgagctgccctagatggtctcaccatatattcattcatgaaacaaacatttactgggtgcccatgatgtgcatggaactattgtaggagctcagagttagtccttagccctagagagtgaaggggtgacaaagaagaaatacatacatcttgtaacaacacaaactacacaagtcaaaataggctggcttgagaatgatggaggtagggacatgaggatggggaaatctaaggttttccaggaatggcaaggaggtaagccaggatacaggggtgccagggaaaagaaaagaagaacccatcagagaatatagaggtacagattgtgta

SEQ ID NO: 199575 - DNA, 534 bp, Homo sapiens
caagcagtcctccctcttagcctctcaaattgctgggatgacaggcatgagccactatgaccaacccaggctgtcttgattactgtcactttctagtcagtttgaaatcagaaagtgtgagtcctccaactttgttcttcattttcaaggttgttctggctatcacactgccttttatgtcctgatagcagacatcacacaccatcacttctgccacactctattacaagaagtaagttcctaaatccagcccacattctagaagaggagaattaggatccttctcttgaagggaggaatatcaaagaatttgtggacatatttccaagccactgctaatggtaatatactaaacatttggttctgtggcttgctttttcactcaacaatacatcttggagatagttccatatcagtgtataaagagccacctttttcttaacagccacgtaataaacttttctatagatgcatcacaatttaattaatatttatttacaatattttgctataataatgcttcagttaataatg

SEQ ID NO: 199576 - DNA, 346 bp, Homo sapiens
tacctcagagggattagatgacttattttataaaaagcaaccagaacagtgttagctatgattatgaactatcatttcttggtacaaaagttcaaagtgacaagtgacaggtgattataccaaacttaagctattttaaagccatctcatccataaggcagaaattgtcatttaaaggccctttcaaggaaaaaaaaaataccctaattctatatattttaaagtcttgcatttcttaagtactaaacttagaaaacacaaactcaggtacagtcaagatattttggaattgtttgtgaaaaaatgtaacaacagaaccaaaaaagtgatggttctagtcaaagct

SEQ ID NO: 199577 - DNA, 422 bp, Homo sapiens
ccccaacccttctttaacagaagcacgtcgttaggtgcagggtgactaagtagaactggaactgagaacttgaaccagacctcaggttttccagcttctagcccaggcttttatcttgatgactttccgctttggtttcttttctttcttccaccttaaaaaccctaatttatttgtaagtgggttcttactaccaaatgccactgcccttgtccacattgacatctgtgaaaatgttcccgaagagagtaggtgactggttgttgtacctagaattcattgaaaagagctatgggggagatctttgttttgttttaacattttgtaatttgcatctccctgccatgagccattcattccctaaggatccttagctaggtggggagcacgtttgcatagtgccactgcctgaaccgccagca

SEQ ID NO: 199578 - DNA, 404 bp, Homo sapiens
cattggtaataatggaaacgtattcctgccttcagattgtgtttgcattttttttctcatctttgtggtttgaaatagttaaagcatcagccccaaccaatatgcacttgaatttgaaatttgctgtatgatgctgccgcttttcattttttaccatttcacaccttgtccgcatcttgagcaagcttgtaagtttccagtgcatacatttcttgtgatgatatattgtcctggtggaaaatttcatttactggctgtgccctttgctgaacctgttgctagtcagggaacatgataagcgtataagtagcatgctacttcatttatcatacatcgttttagacactcaaatatctcatatacaattctgcattctgcacaaagggaaactacccaactcacag

SEQ ID NO: 199579 - DNA, 450 bp, Homo sapiens
atattaaattaagaataaataaattgagcaagcaagctaacttatgggtggttgggctttggatatccttataaattttgaggacaactagaaatgttcataattatcagatatcacaaggaataagccaacagaagtaagtatctacaaggctaattgtaaagattataggccaggcacagtggctcatgcctgtaatcccagcactttgggaggctgagcctcgcagatcacctgaagtcagtagttcaagacccgtcttggcaacatggtgaaaccccatttctactaaaagtgttctaaaaattagttgggtatggtgacgcatgcctgtaatcccagctactcaggaggctggggcaagagaatcccttgaacacgggaggcggaggtttcagtgagccaagatagcaccactgcactccagcgacagagagagactctgtctca

SEQ ID NO: 199580 - DNA, 436 bp, Homo sapiens
gcaatccagcctgggcaacagtgagactccgtgttaaaatacataaataaaattcagtgccttcctttgaccctttatatatggaaaagtatgtatttgttttactatccctatataactatcatatatgaatgcaaaaacaaacaagatataaaaacaacattctcactgtaccaaaactagaaaaccataacaaccttgaaaaagaaggaaggaagaagaaggaagaaagaagaagaaatctactgaaacaaaatggtggagatcattgcctaaataagtagtttataaaatagtatatctgggccgggcacagtggctcatacctgtaatcccagcactttggaaggccaaggcaggtggctcacctgaagtcaggagtttgagaccagcttaatcaacatggtgaaaccctgtctctactaaaaacacaaca

SEQ ID NO: 199581 - DNA, 444 bp, Homo sapiens
gcacgagagggtgtgagccatcagagattatcagaagtcttaaaacaacagattgctgtgaaaaggagccatttcatggtcttgtaaataagtcattgaaaaaatagttctaggtgagctgcataattggctatcacctaccgctaaatgaattaggatataaaacgtagatggtcgcccagaacactgaaattccctatggtaatcaagacatgggaaatgtaaaggagaaatgaaaagctatggaatgagttagggagtaagtaaggatgtacaaagcatttgtaaagaaaactgtaaacttttccagaagtcttgaataaatggagacgtgatttttctgggcaaaactcagcattataaaaatgtcagttctccctaaattaatgtgtgtattaaatatactcttggtcagaatcccagcaggtttttttttctcttttg

SEQ ID NO: 199582 - DNA, 239 bp, Homo sapiens
tgtgcattttgtgccctgcactattctaggcaggggattgaacagcagtcagagctggcatggtccttgccctcatggactcatactctgttcataacctgtcactaccttctgaacttctcttgtggtgatgaagtgagagcccctgctcagcctcagatggagcaagctacacctgcaccttcccagagtggttttttcttcgtccttgggttgtggaagcagagcatcacacagag

SEQ ID NO: 199583 - DNA, 104 bp, Homo sapiens
ttaacggcctatgctactttttcaggtcatctattctcatatttttgtactatctataccctgacaattcctaaatctacatctttaggccagcctaactgtaa

SEQ ID NO: 199584 - DNA, 488 bp, Homo sapiens
agcttccagcaaattaagccaggccagtatgtgtcacaaataataagacatactgtattggagaaaccaacaggatatatacagtcatatgccatataacaacgttttggtcaacagtagaccacatgggtgggcatggtggctcacgcctataattctagcactttgggaagctgaggtgggtggatcccttgaggtgatcccacgcctggccttaaataggtttcaatacacaaatgcttaccattgtgttatggttgcctataggtagtcagtacagaaatgtgctgtacaggtttgtggcctaggagcaataagctctacgcaacctctacctaggtgtatagtagactataccatctaggtttgtgctatgatgcttacataatgatgaaatcccctaaggacacatttctcagaacatactgatcattagacaatgcatgactgtaggtatatgtgtgtacatgtatataaagagatttatt

SEQ ID NO: 199585 - DNA, 285 bp, Homo sapiens
ttgctaaaaggtaggggaatcctattgaggtgataaagtgttctagacttgtttgtggtgatggttgcacaactctgaatcagtcgggtgccagtaaggtatgtgaatttattagattggtacaaaagtaattgtggtttacaagtggcaaaaccccaattattttcgcaccaacccaatagttcactatagctgttaaaaaaattataaagtatgggaggctgaggtagggagatcacttgagggcaggagtttgagaccagcccggccaacatggtgaaatcc

SEQ ID NO: 199586 - DNA, 431 bp, Homo sapiens
tttttttttttttaaatgaagaaatatacaagcatgtgcttacattttaacaaaattagaatagtttcactacttttgtatgctggtattttcacttctgttatgcagtatgcatcttaatgatactaattttcagcacttttttattaatggaaaattttgagataattgtggattcataggcagttttacaaaataatacagtgagagcccttctacacttagtttggtttcctccagtggtataatttccgaaaactatagtataatattgcaatcaggatattgacattaatacagtctaccaggccaaacatgatggctcatgcctgtaatcctagcagtttggaaggctgaggctggtggatcacttgagcccaggagttcgagaccagcctgagcaacatagcaaaatctcatctctaccaaaa

SEQ ID NO: 199587 - DNA, 245 bp, Homo sapiens
aaagatcccaacagagattctccttcctagagtaaacagcttatggaagcatgcgcaactagaattgttatctggctcaaagctgcccctaagcacacaccattttagcaaacaccattttaaagtccttatcagggcaagggggacttgattttcttcagtgctttgagacagatagggaaaaggagataaaatcaacatgaaaccaaacaatttcttggaagagaaacagatcaggaatctta

SEQ ID NO: 199588 - DNA, 530 bp, Homo sapiens
gctgggcacggtggctcacgcctataatctcagcactttgggaggccaagacaagtggatcacctgaggtcaggagttcaagaccagcctggccaacagtgcaaaaccctgtctctactaaaaatacaaaaattagctgggtgtggtggcgggtgcctgtaattccagctacttgagaggctgaggcacaagaattgcctgaacctgggaggcagaggttgcagtgagccaagatcgcaccactgcaccctatcctcagtgacagagtgagactctgtctcaaatcagtcagtcaatcaatcaatcaatccggaaagctgaagacaagggaaggagacaaaaacaaggacacccaaggaaagtttagcctctgatacctacatttgcagctgcaacagacaataaacacagcctaacttctaaccagatgaacataaaacctcagcttgaaggcctgtgtacctgttcaccctaaaggactatttacctagtacatcatgcctggctttcaacaaaaaacattacaaggc

SEQ ID NO: 199589 - DNA, 295 bp, Homo sapiens
gccttattgttacaaaggtgcacaaagcaaaatatcacaaacattttcaagtagacaagctgatttacaaatccatttaaagctcaaaacatcatgaggcacaaactaagagaaactggatgctaaacactgaagaagctattgtagttctcacagcactatggacttgaactgttagtgttcctagctgctgttcagttcttgggcacaagctattctgctttctaaaactgataagccttacttccccaaacttacagttctattagtctacaagaactttccactagaatgt

SEQ ID NO: 199590 - DNA, 904 bp, Homo sapiens
tgctgggattacaggcctgagccactgcgcccagctggaacatttttgaaatgctgaaagaaaagaactatcaacttggaatcccatacctggtgaaacaatccttcaggaattggggggaagggctgtgggggaggaaatcatgacattcttacatgagggaaaaactaagggaatttgtcactggcagatttactttatagggattactaaaggcaattctctaaacaaagggagtggtaacaaaaggaatcttggaacatcaggcaggaaaaaaggacaaaaagagcaaacatacaggtcaatacaatagattgtctttttcctcttgagtattctaaattatgttcaacagttgaagcaaaaattacgcttgtctaagtggctgtccatatatgtagaggaaatacttaagatagttacattataatgggagagtaaaaggacacagaaaaaggtttctttctttatttgtaatctggtagaactttccagaggtatagaggtaatgtttctacctttcactcaaactggtaaaatgtcaacaccagtagactgtgataagttactgcactccagcctgggcgacagagcgagaccttgcctcaaaaaggaaagaaaaaaaagaaaaaaagaaaagaaaaaggaacacataccaaacttaaatgtgtacgtaccaaacaacagacttgaaaaataagtgaacctggccaggcgcggtggctcatgcctgtaatcacagaagtttgggaggccaaggcaggtggatcacctgagatcaggagttcgagaccagcctggccaacatggtgaaaccccgtctctactaaaaatacaaaaattaggctgggcgtggtggctcacggctgtaaacccagcactatgggaggccgaggtgggtgga

SEQ ID NO: 199591 - DNA, 162 bp, Homo sapiens
gattctttagggcagagacttggtttgtttgagaaatcccatgcctggtgccaggcctgctccagagcacagaggttgggaaaaagctgcaggagaagttgagccctgaaagaaaacccagcatgcccacccctgttacatgatgccctggtgggtgcaagg

SEQ ID NO: 199592 - DNA, 610 bp, Homo sapiens
aataaataatcaacaaccatgctagctgattgctcccgagataagggtcctagaatgaaattgtgaaagtcaatcatctctctcctatggtatgggtagagggcaatggagagacatcgttgctgtgttgaaagtccaggcagagggcttgtgagccagtcagtcccagttgcttgaggagcaggatggaaggtcaatagctattttgcaaaatattccaggagccagaagtatcccaggaaggtttatatttcaaaataacttgagagaagttttaaaattaccttccctcttgattttccattagttctgtggagaaggtaactttatcttcccatttcagaccttgggaaatctgaaggaaattccctgcccctttcaatattatgattaaattttgagtagcttctgtggccgtagatgaaagaggtaggggacctgaagtgggcactgagcacactctcactttctaacactacagagcagtgttcttggctctgtccattccaccctaatattgtggccatgctgtaattggcaatctagtccattgcttttagttgaacgctgggcagctgtatgctagtaaaatggttcttgggttaaaaaa

SEQ ID NO: 199593 - DNA, 1388 bp, Homo sapiens
  misc_feature (1057)..(1057): n is a, c, g, or t
  misc_feature (1127)..(1128): n is a, c, g, or t
  misc_feature (1133)..(1133): n is a, c, g, or t
ggctaaccggtgctttgaaaagcagtccccctctgcattatctctccagctggcagcgtattactatagcctccagatctatgcccgatggcccatgtttcagggacaagtgccatcctctttacagggctgatcccaaagaactaatcaagatggtcaccaggcatgtgactcgacatgagcacgaagcctggcctgaagaccttatttcactgaccaagcagttacactgctacaatgaacgtctcctggatttcactcaggcgcagatccttcagggccttcggaagggtgtggacgtgcagcggtttactgcagatgaccagtataaaagggaaactatccttggtctggcagaaactctagaggaaagcgtctacagcattgctatttctctggcacaacgttacagtgtctcccgctgggaagtttttatgacccatttggagttcctcttcacggacagtggttgtccacactagaaattgaaaatagagcccaagaccttcatctctttgagactttgaagactgatccagaagcctttcaccagcacatggtcaagtatatttaccctactattggtggctttgatcacgaaaggctgcagtattatttcactcttctggaaaactgtggctgtgcagatttggggaactgtgccattaaaccagaaacccacattcgactgctgaagaagtttaaggttgttgcatcaggtcttaattacaaaaagctgacagatgaaaacatgagtcctcttgaagcattggagccagttctttcaagtcaaaatatcttgtctatttccaaacttgttcccaaaatccctgaaaaggatggacagatgctttccccaagctctctgtacaccatctggttacagaagttgttctggactggagaccctcatctcattaaacaagtcccaggctcttcaccggagtggcttcatgcctatgatgtctgcatgaagtactttgatcgtctccacccaggtgacctcatcactgtggtagatgcagttacattttctccaaaagctgtgaccaagctntctgtggaagcccgtaaagagatgactagaaaggtattaagacagtcaaacattttattgagaagccaannaaaanaaactcagaagacgaagctcaagaagctaaggattctaaagttacctatgcagatactttgaatcatctggagaaatcacttgcccactggaaacctgagccaagttcatcctttctctgaagaatagtgagcaggaacactggaaaaataccagtcactctatgatctgtcccgatcagaaaaagagaaattcatgatgaagctgggggtattgggtagatggggaggtctagaatgatttagagtggtaacag

SEQ ID NO: 199594 - DNA, 289 bp, Homo sapiens
aggaatctaaaaggctgggtgattcattcaagttcagaagagtgcgtgccagagaggcaatgcacctacctgctgtctctttcgacggcgtgtaaaaaagaaaaaacatctgactcaaatagcttaaactttaaaaggggcttattagctcacctaattttaaaagatgaaaggtatgctggcttcaatagttccacttagaattttttctcttcctttatctctgttctaacttcaacttcatcttaacactggttcccctactgttcttcagatagctgccagcagc

SEQ ID NO: 199595 - DNA, 736 bp, Homo sapiens
gtccccaccctttgctcccactccaaggaaagtctgttacatttttagccttcagaggtttgatgtagataggaagagatgagggtgacagaaatcagctcttaagtttataaataaaacagggatattatcggggaagcttttgaaatgtaataggttgtaacccacattttgaaagcagtaaggaaataattgctgcttttttcttcttctttattctgttgactttgttgataatattaggtgactacatcgagcctgggttctctcagtattagcctgttattcctaaagtatcatcctctccttgtatcaaatataaggacaaaaatgtcttaggataaaagtctgtttgtttgcattagactatacatgatttgcattacaatgggccgtggatttggatggatgatgaagctgaaacaagggacctaatcatgggatttaactgttcacttcaggtagataagatatttctgggagaagtaaattggatgagcttttgtgcttcccagcagctccaggtcttgtccctggccagtctgggcagctctgcgctcagaggcctttggcacgatgggtcctcccagcaggggctccagcgctcaccgctgggtgagatctacagggctcagtgcgcttggagtcctggattcctccaggactgctactgtattccaattgagtggtggtttgctcttcacagagcgcttacatgggattcttaccttctgac

SEQ ID NO: 199596 - DNA, 330 bp, Homo sapiens
cttgagtttttgaattgagacttatttatgtgaacctattaattatacattctgcttatactaaagatgtctccatgtagatatttttgtcagacttttaatggaacattctcagtatgattcagagaaacatggtatatcatttttatggcagttcatctttggtttatatcattttaattttattccagtgccccagcaattttatttttgtaacactgtatagttaaagaaattatatggtgattttatgcaggaatgatataaggattttcccctataaaccaaactagttcattaataattttagctggtaatattatcaggaac

SEQ ID NO: 199597 - DNA, 528 bp, Homo sapiens
ataacaaacatatctgttccattagtcagggttctccagaaaagcagaatcaatagaatgtacactatagatagacagggaggggatggagggggaaagagaggcgggagggagagggagaaatagagagagggagagagaaagagatttattataaggaattggctcatgcaattgtagaaactgacaagtcccaagatctgcagggtgagtcagcaagctggagacctaggagagtctatagcatgttagttccagtccaaagtctgaaggccttagaaacaggagggctgatgatgtagttcccatccaaaagccagcaagttcaagacccaggaagaaccagtgtttcagttcaagtctgaaggcaggaaaaagccaatgtcccagtttgaaggcagttaggcaagaggaattcgcttttacttaggggagagtcagcctttctcgttctatttaggccatcaactgattggataaggcccacctatattagagagggcaatttgctttactcattctactgat

SEQ ID NO: 199598 - DNA, 562 bp, Homo sapiens
tcgtctcgaggatcccaggcgttgtcagtggagtgtagggacagaagccagaggggagagaaaggagagttgaggaatgtgtgggagtttagtgtgagttggggaaggccagagggtgctagggaccgggagggctgttttaagatgtgaaaaacttgagcatgtttaagatctgatgagaagaacaaagttgagagtgaggctgaagataatagaaggaaggagggataagtagaatgaaatttctgatcagtaaagagtgggtctaaagcacagggagattggttttagatgtgattagtttagattgagtgattctgatgccaaagttgaggacattccattttcttcttagcctaaatgcttgagggtttggctatttctacttctttcctcctatatctttaactgctttaactcactgctgtgttttagagtctttattttactggaatttcttgggtgaaggttactacagatctccaaaaattgccaaatgtagtagatactgaagtccttgtcttggtctttcccttatttgatacaactccacctctgacct

SEQ ID NO: 199599 - DNA, 867 bp, Homo sapiens
ggccaaggcaggtgaatcgcttgaaccccagaggcagagattgcacccagcactttgggaggccgaggcgggcagatcacgaggtcaggagattgagaccatcctggccaacatggtgaaaccccatctctattaaaaatacaaaaattagctgtgcatggtggcgcttgcctgtaatcccagctactcgagaggctgaggcaggagaatcgcttgaaccagggagtcagggttgcagtgagccgagatcgcgccactgcactccagcctggatgacagagcgagactctgtctcaaaaaaataaagcagagcttgtatggtgatgttgggggtagaaagaggaggcagtcaatgaaggcttttaggtaggtggtgatacttgagctgagtcttaagccatgagtagagtttagccagaaagagaggagggagggagggcacttgaagttgaggaagtagaatgtggaaagatactgatttggtattaattaattaattaatgagacagagtctcactctgttacccaggctggagtgcagtggttgtgatcataactcactgcagcctctaattcctgggctcaagtgatccgcttgcttcagcctcctaagtagaggggactacatgtgcatgacactgcatatagctaatataaaaaaaaattttttaggccgggtgcagtggctcacacctgtaatcccagcacttgaaactttgtttcaaaaaaaccaacacaacaataaaaaaaacacgccgggtttttttgcggggggaaaagggttaagggctggtgttgttcccccccctttttgaaaggggaacccggcccatagggggcgttatcaccgtggtttctttttctcaa

SEQ ID NO: 199600 - DNA, 675 bp, Homo sapiens
gctagtaagtcttagcaatgtggctctagagggatggcatgccaaattttttctggtatggattttagagagccccagaaattgttttctctctgagggaatggcctgaacattttacatgtccacacaccaagtgctaaggatgaaattattaggacatcctaggagaatacagggtctggggcaggggccaaagagagaagatgcatttgttcctgactgccagcaagtctaccaatgtgagtggcttctgtcccaatcatatatcagggtcttctatagtcaagctcccttagtgtttaatgacagaaatgtttttagaagggaaatgtgacatgtcagggcttaaagatatcaagaatgtcttccatccaatttccacgtagctggaaaggaaaatggttaagagttaagttactgttctctaaactctcaccatgtggtcctaatcagctgtctgccagtgatggatagaatgaataatctccttcatacttcagccctagaaggagtgcacagccaggatgtagaggggtctatttcccaagaaaaaaactgcgattgcaaacaacatcatcagtgtgtattttaaaccctagaaatatctgtttcccctctttcacatctttatcaaaatgaaaaaataaatccagcaaaacctgaccttgcactagg

SEQ ID NO: 199601 - DNA, 797 bp, Homo sapiens
gatttctaatttagctaagtaggaatacccaatctgagttttaacagactcattatttttggaaaatatatggagttctcaagaaattctcaaaataaaattaatctaatccattttaaacttttacaactcagtctgccatacagcaatttttaaatgacataatcctttagaaatcaagcagtgatcagtgctcaacttgaaaagtgatgggggtggggggaacaggcaaaaaaaaaaaaaatcacagaactttagaagatactgtctatcccaacggctctcaaagtttggccctctgaccagcaacgtcagcattacctggaaacttgtaagaaatatacattagtgggcccaccctagaccttctgagtcagaaactctggggtgcagcccaataatgtgtgttcttcagtgattctgatacacaccaaagtttgagaaccagagttcaatccaaccactccactgatgagaaagaagtgaagccagtaacatcctcaaactcgaacaagttggtgaccttcaaaatgattcttaaactatatacctgaatccaagtagtcccataggatcttctaggcaaaaatacatcctgatcttttgtagcattaattctaatatcattactatctactcagatacaggcaagtatttttgtcatgagtaatttacatttaatacctaaaaaagaagacttcgccaagcgcagtggctcatgcctgtcaaccaacactttgggaggccgagggggtgggtcactggagcctaggagtcaagtcaaccctgggcaacat

SEQ ID NO: 199602 - DNA, 423 bp, Homo sapiens
tgatcagcaactgatatttattcagagactaccaatgtcctctatttctagtgctttacattatttcattcttatagcaatcctaaaaggtagggaactaatattaaatctgcattttacagatgagaaaatgtaaagttaaaatgaaacatctgactctaaggagcttaaaatctagtttgtgagacacaaagacaaatgtattgataaaagtggtatgtgataaaagttgaaaaagtacaacagcaaggagttgtaagtttcatggaggaaaggagatttgtatagtataatacattccagttgaaaaaaagtaggtagtggaaaggattgtgttcacgtcaaaaagctttttctaaatttgctatacagaatgcttataataatggttttactggttagatattacagctaattatgcta

SEQ ID NO: 199603 - DNA, 505 bp, Homo sapiens
aaatttttagtatttaatatgtatcaggcattacactatatctcaaagtattttaaattcaacctttgtctaaatatgtggtctttcagattttataatagtaaaattaacatttcaccaatataactactcattttcaggcaatttattagacatatactcatagtttatcttaaacaattacagatttcagaagatatggtttgggtccttttattcaagtctttcctgtcactttgtcagtcatctcttttcaagccattttcttttaaggaatttgggctgaaatattagactgtactttgaagtaatgactgtaaacttcatgtatgtaactttggttatttcagtgttgtacagattgttaactaattgtgtgtgtgtgtgtgtgtgtgtgtgtacaggtgcacacaggtgcatgctttaaattgttatttaattggattataatgcttacacatattgtaaaatgttaaacataccaagaaggtttgcagtgaagaat

SEQ ID NO: 199604 - DNA, 340 bp, Homo sapiens
ctaagctactgtacattgtaattctccaagaggggagccacggtgtggtgttgtacctcatttgaaatggagttaggccaatctgggttttaattctgtgccactcttgacaaatcacataacatctttgagttctggtttatctgcaaaatgggtctaaaagcacatatctcatggatttgtagtgcacataaaacactcaacaagactatttgcataataacaaatgttaatttaaaatttatgcgtctattttgctttcttgaagttaggggtctatggtgaagtacccacttgcaccagagtaggagtttcttttttttttttttttttttttggt

SEQ ID NO: 199605 - DNA, 328 bp, Homo sapiens
gaataagccagttttagcttatccatgctttccctgttcactcccttatgtaggttaataaaatattaaagtttagtgacaagccgatgtgcctgagcatggctactgaaaaaaaaaattagaaaacaagatatcctgcattttattgcctcattcagcagtgaatggtgagagtgattttctagtggaataaggagatattctgccaatttcgtagtaattaaggttgtttttggaaatgagagccatcaaatcttccctggcagccacagtctctatattctgaacatagcaactctctcattgtcttatatctctatctgggcaa

SEQ ID NO: 199606 - DNA, 411 bp, Homo sapiens
caaactcctagcctcaaggaatattcctgcttcagcctcccaaagtgttgggatttcaggcatgagccaccgtgtccagctcctgagtctctgcatatgctgtttgcccttactcttcttcccctcttgacctaattcagccttcgagtcttagcctagatgtcgcctccaccaggcagccttccctgaacttccttctaccccggctaggacaggttccctctcttgtactaccacaatggtctaagctcataatgtttgtcaattttcctcatccactaggctgtgcgctgcttaagggtggggcctggggcttattcacccttgtaaccccatgctcagtactgtgcctgaccctctgtaaatatttgatgaccatgaacagaccactctgggttgaagtctaggtgg

SEQ ID NO: 199607 - DNA, 428 bp, Homo sapiens
tttttaatactctgcatctttcataaacatgtaaagcacaaagtccttttactttacccctaaatactccatacacaaatgttcttaattttgagaatggggactctgtctcaaaaaaaaaaaaaaaaaaaaaggcattatgagtctactggtcagagttttagcattcttaatctttttaagaggtgaattttaggatttatagaaagaatctgaattattctttgatctcaagtttaaagattttatttgcaggagcatattctgtgttttgattttatgaaaactctagaaataaagtttcaataaaaagcagataattttcacatgcttagaggctgaccgcaaaacaaaatgccaagaacaactagggaattcattgcatggggtgactctcaagcctgtgactaggctcaatggtaaaacac

SEQ ID NO: 199608 - DNA, 520 bp, Homo sapiens
gatgttgcaaaaggtatgatggaatggtaacaaactgggaggaattaggctcgtttgttcagtttcttcttggcatccctgtttgatatttcttccctgggatacagggcaggacagctgttacatgacagccttctgggggaaaaggagggaaaaggccagagagtgaccctccaagtttttatggtctgcttcagaggagaaaaagggtgaaggcaattctagtttttatggcttgctttaggggagaaaggcacaagagaaggtcaaagagaccctcctgcttctgctatcttctcagttttcaaactaccctatttctggacattatgttctgagccccaacaatgctaatgttaataatagaggaaactggctacaggatatatgtgaactcactctactatcttggcaatttttcagtaaacctaaaactgttattggagaacggataatgtttggttacatggtaagttctttagtggtgattctgaggttttggcgcacacatcacctaagc

SEQ ID NO: 199609 - DNA, 267 bp, Homo sapiens
tccttcattaaaaaaaatctttttttactggtcctttcatgataagcaatctgcctttatttttatcatggcttattttatatagttcggagaataaatggatgtattcagtttcttcagttttaatgttatatgtcatcgaattataaactcacagatctgcaaaaatatcttagtccagctccctgacttaacaacaaattataaaccagctggtccagtggtagtgagttatctcaattgattgttgggacttgactactcttt

SEQ ID NO: 199610 - DNA, 307 bp, Homo sapiens
atagagaaggaagaaaaggggaaagagcctggagaaaagtcagcagcaatgccttccaggcccagctcctcagaagacagtctgatgtctagggcaagctgctccccagctccaggccttggggtcctcctggaaaaaggagagaagcaatccctgctgcctcatagaattgatgatcataatgatcatcgctacctttcactgaggccaagccttgtggcatttgattgtcaccaccctctgaattgggcacagttacagccttcatgtcattgataaagaaaccaaggcacagagttgtaagtgg

SEQ ID NO: 199611 - DNA, 821 bp, Homo sapiens
tccggtttagttacaaagactataactaaaggatgatggttttaaaataatagagatttggaagagttggggaattactattactgctttctgctatagttgacttgataccttctttctaacctcatggcataaatagacatgccttatataggcaagacaattgtatattaatcactgggttgtgagtgcatgcatggatgagtgtgagtgcatgtgtgtgtttgaggggatctcagtcttccgtgtgtgtacaacctataaatgggacacgtggctagggagaagtaataggcagtgtagagccagtctggcctggttctcaccctgactggcaaatctttcctcttctgtgcttcagtttctgtattaaaagaaaggtggggacaggggaggcctaactacatgagccccaagttttcagctttttttcagcttgaaaatctatggtttgaaggtggtaatttgcaaatctatctctgtgttatttggcatcccaggtgtacctctgtaagaaaacatataaaatgtagaatttataaaaccaatcaatgtagtagtgatttttctcatgccaaaaacttagaggtgattgctttgagtggattggtgtgtggaagatcaagaaataagagagccactttcgagttagtgatgaataataaatttgcatcaaaaactcctttgaaattagaattctattctgatttggtgggaaattttttattttacaaaaatttgcttttcaccaactttttggagcccaactattgtgaaaaatggagcagactcatatatcatcgtgaagctggtacaaaaag

SEQ ID NO: 199612 - DNA, 800 bp, Homo sapiens
ctttttaaccacaaatagcatttaagaattagtgttaatgtgttacaaatggctcattgagttacttttccttctcagccccaaggcccaaagttttcttcaagagtggtagagaatctctctctcttcagtttgcattattttcttgtaggaagattgtttttttaatcttagaaaccagaataattgtgtaatgtccccacctaacccccaactcatcaaaattcagagatgccttacatgtggtgctatttccaatatatacatacttataaatgtgtttaaaaattccaactgaatttattaacttaagtatgagactctgagaagatcatatgggttgtaaatgaaatatgtggaagggcaagtaattctaagtgtaattagcttcaatttgcaggaaaatgatgaatacgttttacttttttacatttcttttttacgtttacatttccaaggctgcataaatttttttatgacagcttttgttagaaaacaattggcttagcttgcattaaaattatacaagtccagtcaagtaaaccaaagtaactggcaaagtaaaatgtctcattttccgtcaaaggagaaattgtttgtacataccaaatctaagaacgtgaggctccatcttgaaacaaccatagtttgttttacatgaaagctataaacaagaagtacaacaaaacaaagtttttatttttttctttttaaaacattacttttcaagcattatttcacaaacatcctaccatatcttttacttccaatcaaaattgaacccacttttctctccagct

SEQ ID NO: 199613 - DNA, 249 bp, Homo sapiens
gtcaatcatcaaatcttcctgttgattctacatcactgaccttcctgaccatgatacgctgtcaaaaacaccatgtatctgttcttcctagaacttacacaggtctattttttatatttatttgtataattgtcttctctctcctgttcatcccatccctacaaattatagactatatgtcctttttttttttttgggagggggggaccctcaagagctcgacgggcgggcgtgaaggcggggcagggg

SEQ ID NO: 199614 - DNA, 498 bp, Homo sapiens
  misc_feature (480)..(480): n is a, c, g, or t
ctaggcgcacgaggcgcgtccattattaattgaacataggttgaaaaaacttagcagcatgatccacattttatgtgtatcaatgatatacatgggtatgtgtgtctatacagtctatgtatagacatacacacacgagcacgtgacagagagagagagagacagcgcaagcataatagcctgaacaatgaagcaatttggacaagtattgccaaggtgttaacggtaattctctttcggtggtgaaatcatttgtgctttttcttaatgaaatttatatctactttctagttctatgctgaacacatactacttttgtaagtaaaataaattagaaaccatatgtaagaagttattttaagtgccagggaacaacttccatgtataactcagtgaaagctttcagagatggagacaatcagaaagcaactgtcttttccccacttctgtactcatattttccactgggagggcgcgccntcgtgcgctacggggacc

SEQ ID NO: 199615 - DNA, 460 bp, Homo sapiens
acttgaaaaaccttgtgtgagcaaatgcaaggatgagtgaattgaaagaactcgaggtcaaaaccaccaggtgacccacactttgcctaccaagtatctcctcttgcacaccagaaagaactgattcttccattttcaacacctattcattcttcaaaacccagtttaagcactacagctggcttcctgggccaagctcctgcatcacattgtaacatagccatgccattttgcatttgaattgtgatgtttcactatatgtaaaaatactttctcatccaatctcaacaattgtacatgcagtcacaccccagccctcacaagatggctaaagcaaatcacaagcaaaaattagtttgcccacaaacacttcagtgcttatcaccaacagatcagcacaacttcagtatcacaccccacatcattaccaattccttaatataaagctcatatctcatta

SEQ ID NO: 199616 - DNA, 379 bp, Homo sapiens
tgggattacaggcatgagccaacgcacccggccaagaggattttacctctaggcaaagcccccacaagggaatttcttcaatatgaccattgtgctcagctactgcagaaaaaaatgccctattgatgagggggtataacggtggtccagaaaattcaacagtagaaggttagggattaagaaaatgaaaagtgaaagaaaagagggacatttcaagaaaaaaaaagtttcagcagcatattatcttttaacacacagaaattttaatggtgcttatttctagttgataagactatttttcttcattttgctaaactcatcttttcttgataatgcatatgtgtttgttgtataataaaaaagtttaaaaggtagcagg

SEQ ID NO: 199617 - DNA, 329 bp, Homo sapiens
agcagcccatgtttgagagctcacaagcacacgacaggcgtgctggtcccaagcctccacagacgcacctcacagtaacttgctataatttctgaggagaagccaacacccagagaccaaaaataaccccttgcacagcggtcacatgttcctgccactcaaacccaaatcctaatgacaacagagcccgactgacagccagcatactccgtgtgcccaattccaaacaggaccaggatccaaaagctcagaacagcagcaagaatgctgcgctgtattttttcttactctcataaactcaataaaacataacttaaaatattatccca

SEQ ID NO: 199618 - DNA, 507 bp, Homo sapiens
catctaaaaggatgggcatggcaccatgtgtaggtgcaaaggaccacatagtaagaccattgtgaagtagtttttaaaaaagtcaaaagacagagaacaagcaaaggaactaataactaaaggaacaaccaaaggaactagcagttagaaaggggaagatctggaactcttaaaactaagtcattgtttggcttatgggacaaaccaaacagatagaatggttgcagtccctattaagccaaaaggacatgaaaacataacttcgtcatttttctctgacaccattgcatcttagattgttaacctcttccatgatagaacactgtataaagttcatatttagagtgaaaatgctttctgtatccaaaccatgtaccagatccatgtcttgttatttattacgtttcaactttttatgggttcttttctctctttaagaaaatatccaaaattgcatcctaattataaaacaagttaaaagaaaaaaaacaccattaatagacagtt

SEQ ID NO: 199619 - DNA, 138 bp, Homo sapiens
gaacaggttctacgtatcatgaacagtaatgtattatcacactacatcatgttgtaccatagggagaagcaatcctactaagatactttctactctgaccaaatctctaaataaaggatggaaggaaaaaaggaagga

SEQ ID NO: 199620 - DNA, 404 bp, Homo sapiens
gactaatcttcccgaatcttacattgtgccttaatttgcacatctgcacctctaatgtctgcctatattatctccttggctcacaaggaccttgtgggagagctgctcacatctcaacatgtaaataaaatgtgcctttgggtcaacacaggagaggtgattccaacgttaacaagttggtcaaggaaactgtcagctgtttatttttatttcaatctcttctgttaaactataacacactgattgagcaactaaacactaatatgcagagaggaaaaaaacaaaaaaaatatattgtggtaatacaaacaatacaatgaattccaaatactatggacattggaaaattaagtacagtgatataaaaatagtccattaccaaaagatctgttttaaaacctctg

SEQ ID NO: 199621 - DNA, 121 bp, Homo sapiens
taaaagttaccatttgtacaggttcaccaatctcatagttctattttttaaatcctctggaaaatttaagtttttcataggtcatctggtggcaaaatctgacctgacctaatctcaattc

SEQ ID NO: 199622 - DNA, 414 bp, Homo sapiens
acacagtgtggcaagctggaaagcccctggcacttccagttttcagcagcttccagcttttcgtctgcttatcccacagagcactgggaaatgtggtgaacaacctataggaaaaactggaaccagtcagataaagacaggagggtgcgaaggatggatctgacaaaccgaggtcccaaaggctgcctgtgatgggtcatccactgctctgtgttctccaacatatgctgtagctgaatactgaccagagttacatctgcctggaatattctgtctctgtctaatgtctatgcataaacaccaatcagctatgtgaaaagaatgtcaagtaagactttccttcaaattatgctataaaacaaaacaccatgtgagtcagagtttaaaaattttaaacattaaaaaggtagaaaa

SEQ ID NO: 199623 - DNA, 505 bp, Homo sapiens
aattgtaccacatggggtggaagaacgaagggagaacttgaccaagctcccatctagaaacacacaagataggtgaacaatggccaaaaagtacttcccttaaatacaaaaagcatggcatcaaaatgtgagataaaattaaggaagaatacatttaagacaacttgaatccattttctaactactaaaatactgagctattaaacaactaattttgctatcaaatgaacaaagattttcttttcttttttctttttttttaagattcagggggtacatgtgcaggttagttacatgggtatattgcatgatgctggggtttgggcttccaatgatcctgtcacccaggtaatgaacacaatcccaccaggcatttttcaaccccttcctccatctctccatccccactttgggaggcccagtgtctgctgttcaacgttagttcccacttataaatgagagcacatggaatttggttttctgttagaggaacagagatttaagg

SEQ ID NO: 199624 - DNA, 284 bp, Homo sapiens
ttttgcttaatctactttttaatttgcttttactttgaaaacaagtaaagtttttgtaagcctccaagttgagattaacgatgtgagaaggagaatccataaactttcctgttgaacaaatagcagatggattttttcaggaggtggggaccacacagggctggcctgctctgacgtggcagccgcagaggggtggcatcagcagcagacagtctcatgtcctcagccctgccgacgtccagatcactgtggagtgtagctattactcatgcctttttctttga

SEQ ID NO: 199625 - DNA, 575 bp, Homo sapiens
gcctcgactcatccgtcgtgtcttcctgtccctgccatccctctttactgaggcaaccactgatctgcctcctgcctctacagataagtttgcctctttctagagtttaacatacatggaataatatagcacatattcttttttgtctgacttctttcactctgcataattgcagtgtatccatcgtttatttacttttattactaactatattccattatatggctataccacagtttgtttacccattctcttgttgagggccatgtgtattgtctccagattgtagctatttccagtgaaactgtcatgtactaaataatctttgcatagatatatgctttttttttcccctaggtaaacacctagatacctaggagtggaatggctagatcttttagtaagtgtgtatttaactgttttttttaaaagacaaagttttgttatgtcactcaggctggagtacagtggcgtgaccatagctcactgcagctcaagtgatccttccacctcagcctccccagtagctgggactacagttacacacaaccatgcctggctaagtactttttttt

SEQ ID NO: 199626 - DNA, 355 bp, Homo sapiens
gaatggagagtctggaaatagatccaatatgtatatagtggactttttactaagttgctaatgcaattcaatgtggaaagaaaagtctctgcaacaaatgatgatggatcaattagacatctgtatggaaaaaaataataacgcatacacaacaattaattcaaggtagacaacagatttaaatgtaaatactaaaattatacatctcctagaagaaaatataggagagtatctttgtaatctcgtgcaaaatttcttaaacagaacacagcaagcactaaatatgaaagaaaaaatgataaaactggtcctcttcaaagttaaagctactgctcatcaaagtactgttaagaac

SEQ ID NO: 199627 - DNA, 2328 bp, Homo sapiens
cgggactcgcactcggcggttgttccagaagaaagagacagcgatggcggcagaggcttcgaagactgggccttctaggtcttcctaccagcgaatggggaggaagagtcagccctggggtgccgctgaaatccagtgcaccaggtgtggaaggagggtatccagatcatccggtcaccattgtgaacttcaatgtggacatgctttttgtgaactatgcttgttaatgactgaagaatgcaccacaattatatgccctgattgtgaggttgctacagctgtaaatactagacaacgctactacccaatggctggatatattaaggaagactccataatggaaaaactgcagcctaagacgataaagaattgttctcaggactttaagaagactgctgatcagctaactactggtttagaacgttcagcctccacagacaagactcttttgaactcatcagctgtaatgttggacactaatactgcagaagaaattgatgaagcattgaatacagcacaccatagtttcgaacagttaagcattgctggaaaagcacttgaacacatgcagaagcaaacgatagaggaaagagaaagagttatagaagttgtggagaaacagtttgaccaacttttggctttttttgattccaggaaaaagaacctgtgtgaagaatttgcaagaactactgatgattatctatcaaatttaataaaggctaaaagctacattgaagagaaaaaaaataatttgaatgcagctatgaacatagcaagagcattacaattatcgccttctctaagaacatactgtgacctgaatcagattatccggactttgcagttaacttcagatagtgaattagcacaagttagttctccacaactaaggaaccctcccaggttgagtgtgaattgcagtgagatcatctgtatgttcaacaatatgggaaagattgaatttagggactcaacaaaatgttatccccaagaaaatgaaattagacagaatgttcaaaagaaatataataacaaaaaggaactttcttgttacgatacatacccaccgctagaaaagaaaaaggttgacatgtctgtcctaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaacatgcggcacagatgatcttggggagacacctagatatccaaaaaagcctcttcagaaaaactcatctgttccttttggatcaaaagcagatactgtaacaactgtctgagcttgatgtagtggagtttactgtatgtgtagttctgcagagctagtttttgtaagccatgtaatagatccttgccatttctacattcggaagtattcacaaataaaagacgccaaagtactggagaagaaggtgaatgaattttgcaataggagttcacaccttgatccttcagacattttggaactaggtgcaagaatatttgtcagcagtattaaaaatggaatgtggtgtcgaggaactatcacagaattaattccaatagagggtagaaataccagaaaaccttgtagtccaaccagattatttgtccatgaagttgcactaatacaaatattcatggtagattttggaaattctgaagtcctgattgtcactggagttgttgatacccatgtgagaccagaacactctgctaagcaacatattgcactaaatgatttatgtctggttctaaggaaatctgaaccatatactgaagggctgctaaaagacatccagccattagcacaaccatgctcattgaaagacattgttccacagaattcaaatgaaggctgggaagaggaagctaaagtggaatttttgaaaatggtaaataacaaggctgtttcaatgaaagtttttagagaagaagatggtgtgcttattgtagatctgcaaaaaccaccaccgaataaaataagcagtgatatgcctgtgtctcttagagatgcgctagtttttatggaactagcaaaagatctgatctaataaagttggttgagacactttctcattttttcaatgtttctgtattggaagaagaacttaaagcttcctaatctattttgttggcgtcattcctctgctgaatttttaaatgttcactctggcttacctgttaatggaagaatttgcataatatctacttagaaagatagtgggccccggag

SEQ ID NO: 199628 - DNA, 2187 bp, Homo sapiens
cgggactcgcactcggcggttgttccagaagaaagagacagcgatggcggcagaggcttcgaagactgggccttctaggtcttcctaccagcgaatggggaggaagagtcagccctggggtgccgctgaaatccagtgcaccaggtgtggaaggagggtatccagatcatccggtcaccattgtgaacttcaatgtggacatgctttttgtgaactatgcttgttaatgactgaagaatgcaccacaattatatgccctgattgtgaggttgctacagctgtaaatactagacaacgctactacccaatggctggatatattaaggaagactccataatggaaaaactgcagcctaagacgataaagaattgttctcaggactttaagaagactgctgatcagctaactactggtttagaacgttcagcctccacagacaagactcttttgaactcatcagctgtaatgttggacactaatactgcagaagaaattgatgaagcattgaatacagcacaccatagtttcgaacagttaagcattgctggaaaagcacttgaacacatgcagaagcaaacgatagaggaaagagaaagagttatagaagttgtggagaaacagtttgaccaacttttggctttttttgattccaggaaaaagaacctgtgtgaagaatttgcaagaactactgatgattatctatcaaatttaataaaggctaaaagctacattgaagagaaaaaaaataatttgaatgcagctatgaacatagcaagagcattacaattatcgccttctctaagaacatactgtgacctgaatcagattatccggactttgcagttaacttcagatagtgaattagcacaagttagttctccacaactaaggaaccctcccaggttgagtgtgaattgcagtgagatcatctgtatgttcaacaatatgggaaagattgaatttagggactcaacaaaatgttatccccaagaaaatgaaattagacagaatgttcaaaagaaatataataacaaaaaggaactttcttgttacgatacatacccaccgctagaaaagaaaaaggttgacatgtctgtcctaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaagttctgcagagctagtttttgtaagccatgtaatagatccttgccatttctacattcggaagtattcacaaataaaagacgccaaagtactggagaagaaggtgaatgaattttgcaataggagttcacaccttgatccttcagacattttggaactaggtgcaagaatatttgtcagcagtattaaaaatggaatgtggtgtcgaggaactatcacagaattaattccaatagagggtagaaataccagaaaaccttgtagtccaaccagattatttgtccatgaagttgcactaatacaaatattcatggtagattttggaaattctgaagtcctgattgtcactggagttgttgatacccatgtgagaccagaacactctgctaagcaacatattgcactaaatgatttatgtctggttctaaggaaatctgaaccatatactgaagggctgctaaaagacatccagccattagcacaaccatgctcattgaaagacattgttccacagaattcaaatgaaggctgggaagaggaagctaaagtggaatttttgaaaatggtaaataacaaggctgtttcaatgaaagtttttagagaagaagatggtgtgcttattgtagatctgcaaaaaccaccaccgaataaaataagcagtgatatgcctgtgtctcttagagatgcgctagtttttatggaactagcaaaagatctgatctaataaagttggttgagacactttctcattttttcaatgtttctgtattggaagaagaacttaaagcttcctaatctattttgttggcgtcattcctctgctgaatttttaaatgttcactctggcttacctgttaatggaagaatttgcataatatctacttagaaagatagtgggccccggag

SEQ ID NO: 199629 - DNA, 2158 bp, Homo sapiens
cgggactcgcactcggcggttgttccagaagaaagagacagcgatggcggcagaggcttcgaagactgggccttctaggtcttcctaccagcgaatggggaggaagagtcagccctggggtgccgctgaaatccagtgcaccaggtcaccattgtgaacttcaatgtggacatgctttttgtgaactatgcttgttaatgactgaagaatgcaccacaattatatgccctgattgtgaggttgctacagctgtaaatactagacaacgctactacccaatggctggatatattaaggaagactccataatggaaaaactgcagcctaagacgataaagaattgttctcaggactttaagaagactgctgatcagctaactactggtttagaacgttcagcctccacagacaagactcttttgaactcatcagctgtaatgttggacactaatactgcagaagaaattgatgaagcattgaatacagcacaccatagtttcgaacagttaagcattgctggaaaagcacttgaacacatgcagaagcaaacgatagaggaaagagaaagagttatagaagttgtggagaaacagtttgaccaacttttggctttttttgattccaggaaaaagaacctgtgtgaagaatttgcaagaactactgatgattatctatcaaatttaataaaggctaaaagctacattgaagagaaaaaaaataatttgaatgcagctatgaacatagcaagagcattacaattatcgccttctctaagaacatactgtgacctgaatcagattatccggactttgcagttaacttcagatagtgaattagcacaagttagttctccacaactaaggaaccctcccaggttgagtgtgaattgcagtgagatcatctgtatgttcaacaatatgggaaagattgaatttagggactcaacaaaatgttatccccaagaaaatgaaattagacagaatgttcaaaagaaatataataacaaaaaggaactttcttgttacgatacatacccaccgctagaaaagaaaaaggttgacatgtctgtcctaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaagttctgcagagctagtttttgtaagccatgtaatagatccttgccatttctacattcggaagtattcacaaataaaagacgccaaagtactggagaagaaggtgaatgaattttgcaataggagttcacaccttgatccttcagacattttggaactaggtgcaagaatatttgtcagcagtattaaaaatggaatgtggtgtcgaggaactatcacagaattaattccaatagagggtagaaataccagaaaaccttgtagtccaaccagattatttgtccatgaagttgcactaatacaaatattcatggtagattttggaaattctgaagtcctgattgtcactggagttgttgatacccatgtgagaccagaacactctgctaagcaacatattgcactaaatgatttatgtctggttctaaggaaatctgaaccatatactgaagggctgctaaaagacatccagccattagcacaaccatgctcattgaaagacattgttccacagaattcaaatgaaggctgggaagaggaagctaaagtggaatttttgaaaatggtaaataacaaggctgtttcaatgaaagtttttagagaagaagatggtgtgcttattgtagatctgcaaaaaccaccaccgaataaaataagcagtgatatgcctgtgtctcttagagatgcgctagtttttatggaactagcaaaagatctgatctaataaagttggttgagacactttctcattttttcaatgtttctgtattggaagaagaacttaaagcttcctaatctattttgttggcgtcattcctctgctgaatttttaaatgttcactctggcttacctgttaatggaagaatttgcataatatctacttagaaagatagtgggccccggag

SEQ ID NO: 199630 - DNA, 339 bp, Homo sapiens
tcctcccgcctcagcctcctgagtagctgggaccataggcgtgtgccactatgcccagctagtttttcattttttgtggagatggggtctgtctatattgtgcagggtggtcttgaacttttgggattacaggtatgaaccactgtgccgggcctttaagcaaaatttgcaaacagcaaaatgttcaaattgtaagtgtactgttctgtgaggtttaacaaatgcatatatctgtgtgcaaacgcctgttgaggtacagaacatcacatcactccagaaagctccctcgtgccctttcctagtcagtcctcactcttactcacccagaagcaaccactg

SEQ ID NO: 199631 - DNA, 186 bp, Homo sapiens
ggaaagacagggtctcaaaagccccgtcccagttcctatgcatagttggagccctgcttacagtggtggcacctgattatgattgactggagggtgtaggagcctggagtgggacattcctgctgtcaggtttgctgtctctgtagaagcttcccaggaaagcaggcctgtcgttgcttgcctctt

SEQ ID NO: 199632 - DNA, 425 bp, Homo sapiens
gatgctgtgcacaggctgtgtgacctgaaggcccttgcaggctgaggtctcttggtgataatccacacactgtcctgagccttggttttgcagcatttccaacttgggttgacagagtgagactgtgcaggactgccccgtacagtacggcttctatgtgtgaacaacacagaccactaagagatgtgacaaagctgttccatcagaggaaacatagtctgggggacaaatcctcccattcctgataggacaggagggagcggttggctggggaagacctgagtgagggagctttcttgaggacgggttttgtcggagtgtagttcatataccatgcacagcctgtcagcatacagcttgaatgaactcacgtgtgtaaccagatcaagaggcagaatattactagggtggcagttttgagtccc

SEQ ID NO: 199633 - DNA, 1137 bp, Homo sapiens
ggtttttatatctggctacaggattatcttttcagaaatgtaatgaatagggactacataaggaaagattattttcattgattcaaaaattattttcattgattaatggtagagttgacgcaaataccaactcattaaacatacatgcacagaagatcacagaaaaagcagctactgctgccttaggcagacttctgaggaagtgcctgggctgtgaggcttcttccactagacataaagctaccagctgaagttttcaaggtttcctaataagatatgaataacctaaacaagttaggcatctctttatgaatctcgctaccattcaggtaaatgatgaaatacatttaaaaatcaggaatagttgagttttcagtcaaaaggaaagttgtacaataatagggaatatagtcattatgaaaaacaagacttaaccaaactaccaaaggactaaaatacaacagcaataaatacttaacctgtctcttcctttgaactcaggggtgacaaggtttttattgaactctcagaaagagaaagaaagagaaagagaatgctgacacctagtgtccatttaacagaattttataatgactagccttggtctttagatgcaatcaaagcactagtaagttagttataaggcacctccatctctgccttaggctaaagcatatctcaaaccttctcagtgtaattgtttaaaaaaattattggccgggcgcggtggctcacgcctgtaatcccagcactttgggaggccgaggcaggcagatcacgaggtcaggagatcgagaccatcccagctaaaacggtgaaaccccgtctctactaaaaatacaaaaaattagccgggcgtagtggcaggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaattattgtgctttggccaggcgcggtggctcacgcctgtaatcccagcactttgggaggccaaggtgggcggatcacctgaggtcgggagttcaagaccagcctgaccaacatggagaaa

SEQ ID NO: 199634 - DNA, 941 bp, Homo sapiens
ggtttttatatctggctacaggattatcttttcagaaatgtaatgaatagggactacataaggaaagattattttcattgattcaaaaattattttcattgattaatggtagagttgacgcaaataccaactcattaaacatacatgcacagaagatcacagaaaaagcagctactgctgccttaggcagacttctgaggaagtgcctgggctgtgaggcttcttccactagacataaagctaccagctgaagttttcaaggtttcctaataagatatgaataacctaaacaagttaggcatctctttatgaatctcgctaccattcaggtaaatgatgaaatacatttaaaaatcaggaatagttgagttttcagtcaaaaggaaagttgtacaataatagggaatatagtcattatgaaaaacaagacttaaccaaactaccaaaggactaaaatacaacagcaataaatacttaacctgtctcttcctttgaactcaggggtgacaaggtttttattgaactctcagaaagagaaagaaagagaaagagaatgctgacacctagtgtccatttaacagaattttataatgactagccttggtctttagatgcaatcaaagcactagtaagttagttataaggcacctccatctctgccttaggctaaagcatatctcaaaccttctcagtgtaattgtttaaaaaaattattggccgggcgcggtggctcacgcctgtaatcccagcactttgggaggccaaggggggcggatgccttgaggccagcagttcaagaccagactggccaacatcgtgaaaccccatctctacaaaaaatacaaaaattagccaggcatggtggtgcatgcctgtgaccccagctactcaggaggctgaagcaggagaatcacttgaacccgggaggtggaggttgcagt

SEQ ID NO: 199635 - DNA, 321 bp, Homo sapiens
ccactacaacagccaagtcagacataaaggcagatggagcatacacattggaaagtgagtgctactacaagcttagcattttgacaatttcatgttggaggtctaagaaactttgaggaggaggaaggaaaatggaaggcagaaggaaagggggaaaaaggaaagatagagagggacaaaagaaaatgaggttagagagaaagaaaggaaggggaagtttgtgtctgtgacgtaaaaaagactatcaattctactttcagtctctgaatgttgagacatcataaatctatctagacttagtgatcttattaccatttgccc

SEQ ID NO: 199636 - DNA, 509 bp, Homo sapiens
tagaagaaaagaagaaaggccgaaaactgtgaagtgacagaaagaagggaataaatctaaagatagtagaaggaaacaaataacaaaataataaagatatagcagaattaatgaaatagaaaccaaatattcagtaaaggggatccacaaagcctaaagtgattctttgaaaatattaataagacagataagtgtatagtcagggttctccagagaaacaaaagcaataggatatgtatctatgtagacagatttattttaaggaactggttcacatgattatgcaggctggcaggttccacagtctgcaggttgggtcggcaggctggagacccagagatgagctgatgtttgcaagtcaggtccaaaggccatctgctgctacactggttggtggaggtcactctttttgttctcttcaggcctttgactgattggatgaggccaacttgcattatggagggcaatctactttgctcaaaggccacctgcttaaatgtttttttggt

SEQ ID NO: 199637 - DNA, 358 bp, Homo sapiens
ggagtctggagatgggagtaatccatctttgccgcaagttgcaaaagatcttaacatctcccatcccagcctctgtggtctgcgttgtgtctgacatgagcagccttgagaaccagactcccaactatgtacaagaaaacttactttcaatcttcctgacatcaaattttccattggccagaaccagtgtagtgacaagaaaatagccttgaaaacccagaccctctgtcattatttaccatgtgactttcattttttctttccttcacaagagtagactgtcttcttctccattgtcttgttaaatttttcattcaggtgttttttaatgtgcccaattaaacagtctcaagaagtt

SEQ ID NO: 199638 - DNA, 768 bp, Homo sapiens
gcatatcattttttatttagaaaatatcctaagtaaaatttaaaggaaggagggcattccagatctatatctagaaaaaccaaggtcttcagaatatgagaggatgctgaaagaaatgaagagtttggatgaacatttttttcttccagaccaaaaactatctagaggtatatgcactaaaataatgtcaaagtacttttcatgctagaggtatccatcaactatataaccttgagcaacttataacttctctgtgccttggttttctcatctgtaaaattggagtaattctacttatcttaaagggttgtgaggattaaatgcatttaaagtggtaagaacactgccttatacatagccctgtgttttcatcctcataaaagctgaaaataaggttcaagtagtattttgatactacttatagatctaaaatggatcagggaaaatatgtgattacttgatgtatgttatttttatagctgagattatacaagacagctatcataatctcccttaggtaatgccactgtcaaagataatgaagaactgggtggatcactggtgagaatagaagtgtaaagtgttgctttttattaaaatatgatttacttggttgctttcaaagaacccaatataattttctttgtaaaatgattttgacacgaagtagcagaaaaagctccaaacattagaatatgaccagtgtcctggcttcacagttaaactatctttgctcagtttccctacttgcaaaataaagtgaagtaa

SEQ ID NO: 199639 - DNA, 442 bp, Homo sapiens
tttccaccttttggctgttggaaattcattacctcttgagtcaaggaatcacaagctattttgactgaagtgtcctgttaagaacaggtgaagattccaggtgaacaaccgtgcattccttttatctccttgtgggcttggtctggtgctgagaacttatgtacaatatcatatttaatcctttcaacaacatgatgaagtaggggtcttcaccattgtataatgaggaaactggagttgagaaagttaagagcttgttcagaatcacaaactggctgggcatggtggctcatgcctgtaatcccagtactttgggaggccgaggcgggcagatcacctgaggtctggagttcgagaccagcctggccaacatggtgaaaccccatctctactaaaaacacaaaaattagctggctgtggtggtacactcctgtaatcccag

SEQ ID NO: 199640 - DNA, 359 bp, Homo sapiens
caaaaaaaaaaaaaaagttcatatcaaaaggaaaatataggctgctctgcctgtggagtagctattcttttgtttctttacatctctaataaacttgctttcacttacaaaaaaaaaaaaaaaaaaaaaaggaaaatcctagcactctgggaagctgaggcaggcagatcacctaaggtcaggagttcgagaccagaatacaaaaattagccgggtgtggtggtgcatgcctgtaatcccagctactcaggaggctgagacaggagagttgcttgaaactgggaagcggaagaggttgcagtgagccgagatcatgccactgcactccagcctgggcaacagagcaagactccatctca

SEQ ID NO: 199641 - DNA, 746 bp, Homo sapiens
aaataccctctagaggcttcccattggttacttggttacaccctatgtaaatgaaggagtggcccacaaccagtctgattggttgcagaagacaggaccaatcagagactaaatagtagttaccaagttacgccctatgcaaatatctgattgattgcgggaggggaccaatcagaggtactttccatttttcatctgccacacagtgcaaaggtagtaacctctgatccttttgttatttgggtgtggagagacggggttttccttttgattcagttctaagaagtcagcgggaatggccttaggttccctgcctccagacctattctcctgtctcacctccatttatcactaaagagttcacaatacatgaccctccagaaaagagacatgtgacattaatatgtcagactcaaccagtgtcttcacactggaatgactttattagtgtgaagctggagtaacattttatcattagcacagaacgagaagcattgcagatgatagagccttttttggtcaccaagtgacgcagccagtacactgttgactagcagtgatggtagcaggccttcttgccttggtcctgatcttaaagggaaagatttcggtatttcatcactaagtaaaaaatgtgttgttggttttttgaaacagggtctccctctgtcgcctaggttgcagtgagccaagatcatgtcattgcactccatcctggaagataagagcaagattctgtctcaaga

SEQ ID NO: 199642 - DNA, 511 bp, Homo sapiens
cccaaaagcaggtagtcacctgtgaggctgagtctagggcttttatgggctcagaattggggagtgcatgctgattggttcgtgggcaggcctggaaaaagcaccattcgattggctaaaagacatcgaggaggttcttactctggtcatgtactctacctggaactggaagctcagttttcaggcatcaggctgtctttggcttgaagatcagggttcaacagggacctgttcgtctgcctaggaatttaactgtctcctattgctatcatcgagacaccaaaatgtctacaagtgtaatcatttatcatgatctacatggctgctgatatggtctaaattacccttaagatcccactttaaggtccgtaaaatactgctaagtaaaaatccactgtgacacacttactcctctcttgctgagatgccctgctgcactcttctgcagtgttctttctttctttcttttctttctttcaataaaactttcctttccaaaactataccattg

SEQ ID NO: 199643 - DNA, 190 bp, Homo sapiens
cattttctttaaagaccaagattgtttgcaatggcttcaggaaaacaataccaatacgaaaaccaaaacctttaatccttttagggaatcagttcactgttcctatttcaaggcaaggcaagtcatttagaaatcaacctctgacgtgtctgtttttatcagaacatttccagaaagtaagattaccatt

SEQ ID NO: 199644 - DNA, 807 bp, Homo sapiens
gggatgtattataatgaacagcaaatgcaaacacagattagagtttgataaaatttgtccaaattgggcagagtctaagtgacatgccagtgtgcttgtgcatctcaccatctgagggacccatctgataatggtgttgtgaggaacacagactagactctctagctgcaggcagtggatgcctgggagggaagatctgtggctgcagacagaaatctagtggctctaacctgtcagtcatggtctgtatttccttgtgctttaatttccctttaataaaatgagatggtgggctgggtgcagcggttcacacctgtaatcccagcattttgggaggccgaagcgggcgtatcacgagctcaggagttcgagaccacctggccaatatggtgaaactcgtctcgaataaaaacacaaaaattagctgggcatggtggtgtgtgcttgagtctctcaggctgcaggtggggatggtgaaaccacatggggcctgcagtctggagaagctgaggtggcagggatggaagtctcaagccgctgagctgttgaaatttgcaggatgaggaggcagtcaggacagagctgcacagagaagggactctaaaaacatcaacagggatccaaggaagcttctggacaaatagctgagggtgtcagagagaacatctgcaagacctggcagagaacagctctgggaagcgtgaggaagagaggttctggaggccacacggggcaggagacagacgtgttcccacacccagactggagacaccttgggcgaatagatttaacagagattccacaatg

SEQ ID NO: 199645 - DNA, 464 bp, Homo sapiens
cagttcatgtcaggcaagaatgaacagctcatgtatcccatacttctcctgctgctctaagacatctttctttttcagatgccaatgctgggggaaacccagaaccctaaagtatattgaagccatttataacatggagaataactatctttccttagtggtaaacagcagttatttctaagattagtgtcgaatttttttaagttataacgagagatcctaaatactaggaattaaaattgaaatgttctctttgaagttaaatcagcttattatttaaagttagagggaagaggagaagggaggcagcacggtatgatggaaagaacaatgaaatgaaagtcagaaagtatggctaagtttctccaggtcgggaactacagctctgtgtcccaaatgcctctgcaaatacagtaccaggctccttacaggtttccagtaaacatttgctaaacctagatgtt

SEQ ID NO: 199646 - DNA, 502 bp, Homo sapiens
aaaaatgattgttaaattatgtattacacgtagacattcattcacttaagcatccaggaaatatttactgagcaactagtaagtgccaggtaccattttaggagcagaagttatcgcaggaaatatgccacacaaggttcttggtctcctgacccttgtattctataggaggaaacagtaaaaagaaacaataaacaaatacgtaaaaagctacattttggctgggtgcagtggctcacgcctgtaatcccagcactttgggaggccaaggcgggaggatcacaaggtcaggagatggagaccatcatggctaatatggtgaaaccccgtctctactaaaaatacaaaaaattagccgggagttgtggcgggcacctgtagtcccagctactcgggaggctgaggcaggaaaatggcgtgaacccaggaggcggagcttgccgtcagccgagatcgcgccactgcactccagcctgggcgacagagcaagactccgtctcaa

SEQ ID NO: 199647 - DNA, 175 bp, Homo sapiens
attgccctattgaaaggttgtaccagtttgacattgctgtggtcagagtgcttttccccatggtctcatcattccctggttgttttaaaggcatgctggagaattgctcagcaaattctccaaaatgtctcagcaactggagggccccatttgcatccggaatttggagcagatg

SEQ ID NO: 199648 - DNA, 232 bp, Homo sapiens
gcctccgggagaggaagaggcatggaagggcctccgctgctcggcttgccggccgctccagagctctgcaccagcgctgctcccgccttgtcgcaggaggcagctatgaagacctaaggttcaagacccggctcagccgcgaacttgcttggtaccctttggcaaatcacttctctgaggcctcggtttcctcttctgtaaatgtaaacatcccttcttttttttttgcctt

SEQ ID NO: 199649 - DNA, 631 bp, Homo sapiens
aatcctcctcacttcctgaactcatggcaaccactgatctctgtactatcactttagttttccatcttccatgtcatactaatgaaattatatagaatgcagcctttttgaatcaggttccactttgtaatttgcatttaagattcatccatgtctttttgtggtttgacagcctatttctttttacagttgaataatattctacagtttgtttatccattcacctattgaagaacatctttagttacttccattttctggagatcataatatagctgccatgataaacattcatatgcaggtttttctgtgaacctaagttttcaaaggaaatttcaatatagcagttaacaccatcccttcttcctgaacaatcttccaattctgctacctatccactgaagtcaccaaagtctcttcccaccaaactggtgcatctgcccaataatcctctatttctctagcacaattttaattgcacatgtgctagccactcttttcaaagctgacggacctatgaattctactaaatcgaataaacatttactaagggcctactatgtgtcaggcactgtatacactaggattcaaaggatgaatgaaacagtggtcatggccctctatgaggaaa

SEQ ID NO: 199650 - DNA, 359 bp, Homo sapiens
ctgtacttccagggtcaatcagagtgactatcatgtggcagtttttgaatgataatgcctgaattaaatgattctcacctaaatcatctttacagcaatatcttcagagaccatcctccattaaaataccaccacaaggacattaagcagagtgctattccagaataaaaagcctgcacttgtgaacttctatgcctttgcatatgctcttgccttggcttggaatgccactgtttgttaacaatccagttattttttaagatccacattgtttctgtgatgttttcccctaaattccattttctttcatcaccaccctttccatatttgctaaagagagttattcttttcagtctgtc

SEQ ID NO: 199651 - DNA, 433 bp, Homo sapiens
aaagatattaagaagattagaaaaggttttgtgaaggagagctgaaatgggcctttgaaatacagatgacattttcattgatgagaataggaatatcataaaagtaattcataaagctgacataatgagcttagaaggaaatccataaaataatactactttaaagaaatttcagggaggtaaaatttctgaaaactttagaccctagtcatcagactgtgtatgtgcatgtctgtctctctctcctctatcatttgtttgttttttgttttgtgtttttggaggggatggagtagtaaaggaccataaggagatataacactgtaggaagaaaaaaaaatcttggggaaaatgaaacactgatacaatcattactaaacatttaagaataatatcttctagtgatggaacacatgctttgtgctttccatac

SEQ ID NO: 199652 - DNA, 311 bp, Homo sapiens
acctttaaatactattacaccatttcatataatatcagaaccttactacaatatacttacatttccccatcccatccattgtgttattgttgtagattttatatttaagttataagcctcacaatgcattcacattattttgcttttaactaaattagaaattaaaacgaggaaaatatttatattttcactatgtttactattttcactctcttccttttcatactttcgactttttatttaatattcttttccttgaggtattattttcctttagctttccttgtagtttagatctatcagtattgagt

SEQ ID NO: 199653 - DNA, 213 bp, Homo sapiens
tgacagcagcgagggaggggaagtgcatgtccccaagagtccagacggtccagagacaatgaaaatgctttatagagaagtaaccaagtctttgcatgtcagcaggggctttgtggagctagagaaagggcttgttaacgccctcgctctgagtcagcaaggcttcccggaaggtgtgttcagcaccaggatgacccggcagacccctgcggc

SEQ ID NO: 199654 - DNA, 532 bp, Homo sapiens
cctgtaccatcaaagttttaagtgatagagaatagttgcattgtatttaagttactgtcatcaacagctaatcctaataacaaactaatgcagggaattatcttgaatgtggagactgaggtaaacagggatgtaaggtatgacacagtagtcccaaatgtctcttgagaaaaggtggctaatcaatttaaaccatagccttcttggaactgctctcttaggcagcattgatacagactttcataagggaaaaaggggcagtcctctagcagcatatggaactatgtgggatttcttttcaatcttgataagggtgtcggcatttacttcactagcagtttaaggagggaaaggaactacagagaattagagggaataaccaaatgttactttctcctaatatccccagccttaaatggtaggctcagtccttgtgcctcttctgtatctgcactcactgccatggtgaactcatccagttttatagcttaatatgaatgtaaatatattcaccatatagtgacaactacta

SEQ ID NO: 199655 - DNA, 168 bp, Homo sapiens
tagtggtgagtgacaagcaccttggagacgcgccagcttgcctctccccgagtctgggcactcctactgtacaattcctgattggtggtcatcctaccatgtgctgagcactgccagtggcttggacagacaagcttggcaggactcccccattttgtgttatttgag

SEQ ID NO: 199656 - DNA, 398 bp, Homo sapiens
gtctgtgtgcgcgcacatgcgtgtgaacaaaattgcattttaaatgtcttaagctggatgggaatctaccaaaattgtatctgtaaaatatactcaattgccacagttttagaaatgtctgtggaaatgtccccaccggcctgcctccttcctgagagtttatatctaggtagagtgttaggtgatgacttcctagtcaccggtatgccaggattagttacctggcgaaactgagtctggtctttaattcaagaagttttctctaagtgaatctcctttccctataagttgatagaggggtgttgtttgagggagagttgtccagaggaaggtggaatcaagtgtgaatcatctgtgtgacccagtgagcagtgaataaatatgaaaagtgcagaata

SEQ ID NO: 199657 - DNA, 490 bp, Homo sapiens
tggaacaactgatccctagctttccaaaatatgagaaattgagatgcagggagtagtaagcacctagttaatgagtcaaagcatatttataaagttcacagggtacatagcatatagcagctgttctctatctcagttgagttttgactaggaaatgggcttaggataaaacacataggcttttgagtaatcatttgtaagaaattgtagatagtgaccacagtttaatagcattagataaattatgaaaagtcactgaaataccttctctggaaaatgttagaagctcaagtacaatggcttagttaaaggcaggtgggggagaaacttgaagaatgtggtccagtacaagaataccccatttttcccctaaggcaatgaaaatgacatgaagtaatcatagttatttatacaggaacaatttaggagacttagaatattcacttcttttgccttctagctgagcatcaaaattctctctctgtctctg

SEQ ID NO: 199658 - DNA, 151 bp, Homo sapiens
tggaggacagaaggaaagctgggagggagagactattttagagaaaatggtcagaagactgttaagctgttacttgaaccacaaacggaagtgtagacattttatgtaaatgtgtaagttgatttttaggtatatataacagataatctaa

SEQ ID NO: 199659 - DNA, 335 bp, Homo sapiens
tgttctaagaagtttcattttcctaatagtttactgaggttcattagcaaacacactattaacatgctgaatctctaactttaggatacacatatcagtcattatttctatattatcagttaaccagcatattaatagaccctaaaatggagcatttctaagaaagataaagccaaatctaagctagagattttttttttcccccttgagaccgagtctcactctgccaacccagactgaagcgcagtggctcaatctcagctcacctgcatccttcgcctcccggttcaagcgattctttggcctcagcctccccaagtaactgggatagggtt

SEQ ID NO: 199660 - DNA, 596 bp, Homo sapiens
caaggacctgtcccatctcaattttaacacagcgaaagttggggctataaaaggttgtgaaagtacattacaggcaacccctagtttcacagaagacaaaacagaggtcaggagagtttaaaacttcgctatgcaattttagccaaattagtagcaaaggaaaaggagactcatctctattcctcgtaagaatcaagattgttgaagttcagatttacatgagccattaataaagttcagaatggggccaggcgcggtggctcacacttgtaatcccagcactctgggaggccgaggcaggcagatcacccgaggtcaggagttcaagaccaacctgaccaacatgaagaaaccccatctctactaaaaatacaaaatcagccgggcatggtggtgtatgcctgtaatcccagctactcgggaggctgacgcaggagaatcacttgaacccaggaggggggaggttgtgatgagccaagatcgtgccattgcactccagcctgggtgacaagagcgaaactccgtctcaaaaaataaaaagttcagaatgatactgtttgaatccagctcccattgtaatggaaagccaagcagtc

SEQ ID NO: 199661 - DNA, 756 bp, Homo sapiens
gatggcttatgcctgtagtccagccacttgtgtggctgacgtgggaggattgcttgagcccaggaggtcacgtctgcagtgagccacgattgcactactgcgctccagcttgggcgaaagagtgagactctgtgtcaaacaaaaaaaagaataaaaagatttcagattgttaacagatgctgactggtgatgccgggggtaggggggtggaaagaagaaaaaagtggatttcggattggctgaatattttgttactaattttcactagctttttcaaaaatactataattcatataccatacaatttatccacttaaagagtacaagtcgctattgtttggtatattcatggagtctctacttttcatatactgtgctacatgattcagatcatgtagtgactgctagttaagtaaatggatttatttccttctgcaggatccctctacttaatgcagtagctacattcttgaaagttagcttgggcctggtgccatggctcacacctgtaatcccagcactctgggaggccaaggcaggcagatagcttgagcccaggagtttaaggtcagcctaagcaacatggcaaaaccccatctctacgaaaaatacaaaaattagccaggtgtggcggtgcatgcctgtagtctcaactacttgggtggctgaggtgggagggttgcttgagcctgggaggtcgaggctttaatgaaccgaggtcacgccactgcacaagcgagatcctgtttcaaaaaa

SEQ ID NO: 199662 - DNA, 514 bp, Homo sapiens
aagttcccacagcagcgacactgtttcatgggatctcctcaatggactgtgaaccctttgaagttttcctttcattgtagttgggtttcttgtttctatccagtctcccttctctagaaagctttagctgatttccaagtaagcgacaggacacagaatgacctaccccggcaaatagattcatttcaaatgtttccaaacctgtttccttgtgcaaaacaaaacagccttccttttaacgagaattttcattggcttttttttaattaagtttaaattggcaactaaaattgtgacattcccctgaagttgacaacacaatcatactttgcccaaagtagattgtagcttctcaaaattctacttgattgtatattttggaaactatcataaacactgcatcattgctactaagtgattcatgttttgagattatatgaaaagttctgatttctaagccatatttcttatgtggaatatttaacatttgaattcaatgtttattgacttgaag

SEQ ID NO: 199663 - DNA, 243 bp, Homo sapiens
cgcaaatgtcatagtgttgtcaaatggcagttcaggtactggtatactggataaatcatcttgtactgtttctaggggttgattctttttttttcttataaaatattcattatgaccgattcttgtttacaaatataaatgttttgatgatctacttgtttagccagcaatagaatttaccagtgtcttcattggagagaatttctcccagtggcctaaagtttactggagaactaatgaagg

SEQ ID NO: 199664 - DNA, 278 bp, Homo sapiens
taccaccatcctccctgcttatagtaagacgtggcacaccaggcactcccaaagctctggcctatatcatactctagacaggccctaaaggatggaggaggtctgtcaagagtagaccctatggctctcaagtagcctttagaaagaataaggggtcaccctgcaaggcagttatttggaaccaaaaggcaaaccaagtagttactaagcaggcctgattcagaagtagggctgaaacagctttggggtctgctactgagaggaagagagaaggcagg

SEQ ID NO: 199665 - DNA, 317 bp, Homo sapiens
tatattttccatttagataaaaatgttacctcttgaatagcatcttagagtcacaaataacctgaggttcctttagggaacaaacaatgaaagataagagcacattataagataatatatctaatagtttcccagaggcaacctttctatgactgataaacaaaaactgacagaacaaaatgtcacattttggcaacttattactttagaaagataattatataataggtatttggtaaccacaaggcattaagaacacctacaaatcggctagacatggtgggtcatgcctgtaatcccagcactttgggaggcag

SEQ ID NO: 199666 - DNA, 451 bp, Homo sapiens
tctgagaacattctccatcatagccaattcattcagtcagtggttgccatggttaatactgtagcctatttgattgtcataatttacataaaatatcaaatcaaccaaaaaaacccagatcatttatgttgtggtctagtcacatgcatgaacataaaactcaatctcgtgaccatgaatatgaataaagacaattttccttttggagtggtatcctagcatcagaggatgtccatttgcctggaacacctccaaaagcacctgctgttaaagtaggggttagcaaactatggcccatggaccaaattcatcccactgcctggttttgtaaataaagttttattggaacacaaccactcccacccattcttttacgtatagttcctttcacaaatgacagagttgagtagttacggcagggactaaaatatttattacctggcctttaaag

SEQ ID NO: 199667 - DNA, 450 bp, Homo sapiens
ggctaatggccgagggctggctccttctttctccctaatcagtgtccttatttcagtgtgctcacatgctcgcctaggactgctttagagtacaactctggacccgccctcatcacagtccaatctaccaaactgagtgaccctaaaggacatcatagacaacatttgaaagcaagaaatgcaaaatgttcccatagcatcaggtgagcagggagaggatgcccactgtagaccacatggaaatggcagtccctccacggagagggaatcacaggaacacatttaccaaagccttcccttccattcctggccattccagtagcatcttcctcatccagaagggcttccaatactctctggaggatcctgactcgtttggagtattatccttgtaaaagatgctggcacattgtaggtgctcaataaatgtgttcaattgaaaaatattga

SEQ ID NO: 199668 - DNA, 392 bp, Homo sapiens
tggacctgaaaagaatcccaaagataaccctggacaaagttttttagtttagctttccgaaacaactaatcttattggagaattaacattttgaaccctataaaacctatctgtttggccaggtgcggtggcatacacctgtaatcccagcacttagggaggccgaggcgggtgcatcacttgagaccaggagttcgagaccagcctggctgatatggtgaaacctcatctctactaaaaacgcaaaaattagctgggcgtggtggcgggcacctgtagtcccaattactcgggaggccgatgcaggagaattgcttgaacccgggaggcggaggttgcagtgagctgagatcgtgccactgcactccagcctgggtgacaagagtaaaaac

SEQ ID NO: 199669 - DNA, 368 bp, Homo sapiens
acaagataaataaaaacaggtcacaaacaaattggactcgtgtcagagttctcatcagtactggagatgatcagacattaaagctccgaagataaactattatttagaattctatacccagtaaaactatcaagcatgaggatggtataaagcatttttccacatgtgagaattcataaggcataccactcttgcccccctgttttagaaggtttagaatatagttcaacaaaatgtgaaaactgtgataaaagggaaaaaatgagatcagagaaacagaataatcacacaggataacaatgaatagaaatgccagaatgacaagcagttctcaaaacaggggtgcagagccagtgcggattggagca

SEQ ID NO: 199670 - DNA, 374 bp, Homo sapiens
aaatctttaatctatcttgaattaatttttgtataaggtgtaaggaagggatcattgttaagatgttctactagctctccattatcccttctttgaacttataatcaggcaagtgtctataaaaattgtgtaagactttgaaatggaccagaaaaaaaaagattgtagtctgtcttgcctagttcacccttccaagttctcacaaactttccttgtctttgagctattttacaactgtaaactgtagaaaactgatagtaatgcaggtgatttgtgtccatagaaatgcaaattgtgtttggtggtgatgcacttggttacttctcctgggatattgaccagttttatatctatttgtaaatttacttcagtgt

SEQ ID NO: 199671 - DNA, 2463 bp, Homo sapiens
  misc_feature (49)..(49): n is a, c, g, or t
  misc_feature (488)..(488): n is a, c, g, or t
  misc_feature (908)..(908): n is a, c, g, or t
  misc_feature (1013)..(1013): n is a, c, g, or t
  misc_feature (1692)..(1692): n is a, c, g, or t
  misc_feature (1882)..(1882): n is a, c, g, or t
  misc_feature (2334)..(2334): n is a, c, g, or t
agcaataaaacaagtcatatgaatgttttggtttcccagtgcatataangttttgtttacactatactgtagtctatttgggtgcaatggcattatgtctaaaaacaatgtaaataccttaattaaaaaatactatattgctaaaagatgctaccaatcatcgctgagccttcagtgagtagtaatctttatgctggcagagggccttgccttgatgttgatagctgctgactgatcagaatgtgtttggtgaagcttgggctggctgcagcaattttgtaagacaacaatgaagtttgcctccttgatggattcttcctttcacgaaagatttctccatagcatgccatgctgtttgatagggttttacccacagtaaatcttctttcaaaattggagttgatcctctcgaatcctgctgctgccttatcaacaaagtttatagaattttctaaaccctttgttgtcatttcaacaaattttcacancatcttcgccaggagtagattccaggtcaagaaaccactttctttatttaaccataagaagcaactgctcattcattgaagttttatcatgagactgcagcaagtcaggcacatcttgaggctccacttattctaattctcttgctgttgctaccatatctgcagttacttcttcctctgaagtcttgaacccctcaaagttattcatgagggttaaaatcaacttcttccaaacttctgttaatgttgctatttttacttcctcccatgaatcatactattattattattatttttcttttttttgagacagagtcttgctctgtttcccctggctggagtgcactgtcatgcttatggcttactgcagcctcaactgggcccaagtgatccttgcaagtagctgggtctacacctgantttttttttaaaaactttttatagagatggagtctccctatattgcccaggctggtctcaaacttctgggctcaagggatccacctgccttggcctcccaaaganctgagattacagacatgagccactgttcctggccacaaatgttcctaatgacatctagcatggtgaattatttccagaaggtttttaatttactttgccaaggtccatcagaagaatcactatccatggcagctatagccttaccaaatatatttcttatgaaacttgaaagtcaaaattacttattgatccatgggctgctgaatggtggctgtgtcagcaggcatgaaaacaacattcatctccttgtacatccccatcagagttctgaggtaacattgtcaatgaggagtaatatttcaaaggatttttttttctgggcagtaggtctcaagagtggacttaaaatactcaccaaaccatgctgaaaacagatatgctatcatttaagctttcttgtttcatttctagatgaagggcagtaggattttggaaatggtcagtgaccattggcttcaacttgaagttaccagtggcattagctcctaacaagggagtcagcctgccctttgaagctttaaagccgggcattgacttttgctctctagctatcaaatccctgtatggcttcttccaacagaaagctgatttgtatacactgaaaatccatacactgtttagtgacttccttaatgatctcagctagatcctttgaatatcttgctgtaacttctgcttncgtttttatgctatagagatggcttttttccccttaaacctcatgaaccaacctctgctaatttcccacttttcttttgcagctccctcacctctctcagctcgcaaagaattgaagagagttagggccttgctctgggttaggctttggctcaagagcatgttatggctggtttaatcactcaaacttnctccatatcaacagtaagacttttgttttcttaccattcatgtgttcactggaggagcaattttaattttctttgaaaacttttcttttgcatttacaacttggctgtttggtgcaagaggcccagtttttggcccattttggctttctacatgccttcctcactaggcttaatcatttctggcttttgatttaatgtaagagacatgcaactctttctttcaaacttgaacacttaaagcccattgtagagttattaattggcctaatttcagtagtattatgtctcagggaatagggagtccccaagagagagatggaagaatggctggttggtggaacagttcacaacatttatggatgcagtttgccatctgatatgggccccaatataattataatagtaacatcaaagatcccggtcacaagtcactataacaaatataataatantgaaaaagcttgaagtattttgagcattatcaatatgtgacacagataaatgaagtgtgtacatactattggaaaaattgtgccgatagacttgctggatgcagggttaccacaaaccttcaatttgca

SEQ ID NO: 199672 - DNA, 479 bp, Homo sapiens
acatcatacattttcccgtgcgtcatgttatcttgcctggaattttgaaaatctgtgagtttctggtttttccatggcaaggctcattcctccagaccttagtcactctgctctggctgcctggactgctagagaggggcctcagggcgcacctggagaaattcactggggcccaggtcagagggatgggtgggtgagagcaaccccttccttaatagttcaaaatggccctctggcttaaagagaccgaagccacgtaacaaccaaatgcaatgtgtgggccgtgtttggatcctgattcaaacaaaccaactggaagaggagatttggggataatcaggaagatttgaattgggactgcgtagcagaaaatagcaaagaattattgttaattttgatatgtgcgataatggtgtggtagttatagaagaaaacatgcttatcttttaaatggtgtatattaaagtatttaagggtga

SEQ ID NO: 199673 - DNA, 363 bp, Homo sapiens
ccggagaggccctaagcgactgcatagcgcgcacacctgtgaggccggccgagcagatatcaacatcggccacgggttccgacagggagagtgccagggacttcatggtcttcactgtaagggcctgcaaggtggccagaaagaagtacagcatcctggaaagacttccttgaaaagaggctctcagcccagccctcggtgccctcccagattcccacgctcttggggtttgggccgacttggcagcctctaatcgtttgatttgactcaagcgccacacttggtgggttcagtctccttcttgtaggttgtgtccattcctactcttgagattattttcatcaatctgttttgttattggca

SEQ ID NO: 199674 - DNA, 148 bp, Homo sapiens
ccatcccaaactacttgtggttctcaatgtgccatgtctccgtgcttttccttggacctctgcttgtactgtttctgcttaaatgtttttcctacttcagccatcatttaagatccagttaaatggtgcctcctctgtgaagcctctc

SEQ ID NO: 199675 - DNA, 535 bp, Homo sapiens
tgagccaccgcacccgacctaaaataatcaacattctttattttacttatcaatggtgaaaacacctttatgatctcattgaaaaaaaatagtagtacatttagtgatggtgttgtcattacttcatttagaatatatttgctagactgggcatggtggctcacatctgtaatcccatctaatttttgtatttttcgtggagacggggttaaatcatgtgggctaagctggtctcgaactcccggcctcaagtgatccgcctgcctccaaaagtgctgggattacaggtgtgagccaccatgctggtcccaagttattatatttttatattttcaacaaatgagtaaatcaaccactggaattctgtctgaagatttttaaacaggttagaaaatttggtgtaagtttttaaaatgtgcatacacgagagtttttatggtgccacacttttattgttttggataacaaaatagcctaatgataagacatttccaaatatctcatttcaaaatattttctccactgcataggggta

SEQ ID NO: 199676 - DNA, 477 bp, Homo sapiens
tgcacactcaaataatacctataatgttcaggcagatagttgagatacttggagcagggcaagtgttagattctggaaattagtgaggatcatgacaaattttcatttcatgtagaccaatgaaaactggcagctggatttggtgtttaggttatcaatctgtatttctgccttggatgaatcatataagctttgtatcctgggtttaccttgcttcaaaatgagtgagttaaattagacaccctaaagctcttttaaactctgaaattttaggggcatcttgacagtgattttgaagtgttttggaagctacaggtagcaactcactcaaatcactactggtcccttaatcacaaatcagcagccttctcttctcacactgcccagcttctgtgcagcagttgacactcttatcagccgcttccatcctgaaatcctctggttccttgtttatatatcctgattctcctctgactt

SEQ ID NO: 199677 - DNA, 447 bp, Homo sapiens
ataattttggcactatacatcaagaacttttacactctttgacctactattgttgcttctatggttttcattcctaaaactattggaaattcaaacaaacaaaaaaaagtgtaggaaagtattggcaatattgcatttctaatggtgaggaattagaaacaccctaaatatctaacaataagagtgtttcacttgtaccattttccacttacaaagtaccatacaattattaaaatggtggttatgaaaaatatttcatcacagaggaaaaatttacatatttgaagtaagcactattccaatatgatatatactctcatctcagctgttagtttaaagtgtgtaccaggtgaccaagtacagtggctcatgcctgtcatcctagcaccttgagaggccaaggagggaggattgagtgacagtgagactctgtcttcaaaaaaaaaa

SEQ ID NO: 199678 - DNA, 485 bp, Homo sapiens
ggccctagtaacttctgtaccttcctgtacaaaaaccaagatgaatatggtctaggttgggtgctgggattacaggcttgagccaccatgcccggccgcgtgttggtaaatcttttgagctggcagtctaattaatcctgagttgttaatataaagaacaggtgtggtttattactgtgtaaacccctttgtttagctagaagataaagccttctgctttttgatcatttgaatggcttatgttttggccctgttagggcctcatacaatggcttagcaattctgcaaaatcctgctatacccaggaaagttcttaggttttttttttgttgttgttgttgtttatagaggttttacttctaagtaaacttttgtttgatggacaaggtccagtttcctgagtttagaatatactacaggtatttcacttttggtagagaaatttgggcttggatggagagaactgattttttttaaggaagttt

SEQ ID NO: 199679 - DNA, 207 bp, Homo sapiens
gcgtgagatggtaaacacacatccaagccaggcagatggtggtggtgccaagttctggaaagtggtccatttattatgacctgtgtccccctcttagttagattttcatagtgatggataaagggaggtagaggaaaagattatcaagttccatatttgtggtctcctctctgtcttccctgccactatctcatctcatcttcttct

SEQ ID NO: 199680 - DNA, 295 bp, Homo sapiens
acactcactgttcctatcagctcgtgctgccagaggctgttgtcattgtctgttcatcaaagcataaagacatgcatggcatctccccgcttaccagttctggcacgtttgggctttccagctgaccaccaaggagcccaggctgtttagtttatgtaagtgtatgttggtaaaaaacataaaaataattatgctggatctgaggtgatatgtttctaatattagcatcatcaacatcagacgcctgcctatgggcatgtggttgcctgattttcttaagatgtttcagaaatga

SEQ ID NO: 199681 - DNA, 444 bp, Homo sapiens
tggggacagcttctggtaagccttctgagcctctgtttaggaccagcacgatgctaagaggacctccaggacaagagccggcagggaccacaagccaacaggcctctgacatcaccaggcctccaaagtcaggaatagataaaatacatcgaaacacggtcacaggggaacacaatgctggggaggacaccctctgaaggaaggagggctcggctcttttgaaacatggatggaaaactccagaagacagatatccttatttatgaggtgccccgatccctgagcaggcagtagaaccggccagccctcgaggccccccactgagcttctgcaagctgcatttcctgggcttctgcaagctgcatttcctgggcttctgcaagctgcatttcctgggcttctgcaagctgcatttcctgagcttctgcaagctgcatttcctgg

SEQ ID NO: 199682 - DNA, 242 bp, Homo sapiens
ttttacatatttttaaatttccaaacatccagaatttagaagctctactttcccttataattcttatgttctatggaatcactttgggaaatttatcgagtttttttttctataacctagtacataattgataaccatatttgttccaaaggaatttgaaaaatatgcacattctccatttggggaatgcagatatctatatttatttataatcaaagttattaatcatattttatgcaaat

SEQ ID NO: 199683 - DNA, 294 bp, Homo sapiens
tgtattgaatcaagaactccctggagctatcaatatttttttgttttgtttcagtagttttttgtttgtcttttttcctccttctcataatctttacttgggaaaaattacattgaattcagcaatcaggcttattctactcttcccaaaacaatagtggaaatgaaataatatgtatagcagcatattgtcaattcacagttacagtaatgcttatgaatgtggcatttagattcctgacagatgtttgcctgtgtaattgtttagaattatattttcaattgctttttttgt

SEQ ID NO: 199684 - DNA, 425 bp, Homo sapiens
tacatggtaaaaagttgcactcaacttgaactgaactttggtttccaccaacttccatgggttgttcctggccctgcgtctagaactacacagattctgcctgcaatgtctttcataacacatcctttcaagtgtttaaaaagctccaggtcctcctaaatggcatcttatcaaaaataatcatttcaaatgtggcatcattttgagatgctgtacctgttaacactttttcaatcacaattctatccatatccttgtttaaaataagaattccaaaacctaaaaaaacggtatatatttcatttctgtcacatcagagcaattaaggtagagtgagatttttcctctcttctctattaatggagccttaaccccttagtttctggtttgtttttcatacccataccacccaccctattagctta

SEQ ID NO: 199685 - DNA, 167 bp, Homo sapiens
ctcaactctctggagacctgactccagcctctcatcacactggctagaagtcaagcatgaatggtaacgccctgccctgaacactacttaagacactcaccgctcatccacagcttatcctcaaagctagcctggaaagctccttctggagctcagagtgctctctt

SEQ ID NO: 199686 - DNA, 503 bp, Homo sapiens
ttacaggcatgagccaccgcgcctggcctggaatggaccactttgtatttccattgccattatcctagtctgaaccaccataaccacttgcctggactatttcaacagcctcccatgtagtccctctgtttccatttttggtctcttaccctcatctctaccacaattcattatcaaaacaacaacaaccagagtgccccttttaaaccacaaatctggtctcacaacttctaggttacaaccctaactcttcaagatttcctacctctcttgggatacatccaaaatagtgattatgacctactaggtcctacaagatgtaacccctgcctccatctctctctacgacactttctcacaatagatttcccttcagaaccccaaaggagctcagctccttcctcagcgtcttaacatgcattggccctgctgcccttcccctaatgcctactattttagcctttatatcagctttaagaggttgtctccaatgcctcacagtc

SEQ ID NO: 199687 - DNA, 467 bp, Homo sapiens
agtcaaatgtttccacttagcacagtaatcttcatcctcaactctcatggtagaataataacaacaacaataataataaatagcattgccaggcactgttctaagtgatttacaatactgattaatttaagtcattaaattattttatgggtaatgtaattaatgtgttctaacaatcaggccgggcacggggtggttcacgcctttaatcccaggactttgggaggcccaggtgcgtggatcacctgagatcaggaattcgagaccagcctgaccaacatagtgaaaccccatctctactaaaaatacaaaaaaaattagccagatgtggtcgtaggaacctgtaatcccagctacttgggaggctgaggcaggagaattgcttgaacctgggaggtggaggttgcagtgagcaaagagagtgccattgcactccagcctgggcaacaagagcggaactccatctc

SEQ ID NO: 199688 - DNA, 311 bp, Homo sapiens
taagtaagcgtagtacccaagtagtgctgagagaacaggggatggattggtcagactgaacatgctcacaaatagccccaaggaagcccaaaccttctcagtgaggagacttttaaggccaaatttcactctatattctggaaaaacaaatgaaatatgtactagattagaatgctatttcaggaaattaattatgtacacagacagcaaattaaatatatggtcccatttggtaactacagaggtaagaaagtcttaagggattaaaccaagagaaaagctgctgcatttgggtactacgctttgggccc

SEQ ID NO: 199689 - DNA, 440 bp, Homo sapiens
tgcgcaggacccagatcacttagggcttattgatttttatgattagtacttaggtcgctgctaaaagcagatgggtttccaatacatttctgaaacctaagaggcccttcctccacaatccatcttcaagagcagtggagaactcactgtccccatttcgctgatcaggcaattagtaaagaaaacttgccaggcgcgtctgacgcctgtaatctcagcactttgggaggccgaggcgggcggatcacctgaggtcaggagttcgagaccagtctgaccaacatggaggaaacaccccctccatctctactaaaaatacaaaattagccgggcatggtggcgcatgcctgtaatccaaactactcaggagtctaaggcaggagaatcgcttgaacccaggaggtggaggttgcggtgaccgagattgcgccaatgaaact

SEQ ID NO: 199690 - DNA, 555 bp, Homo sapiens
cacatgcatgcatgcatacatgcacacacatgatcagaaaaaagccctccagaaattgacctaatttggttgtactttcaatttatgtaaaccccactttcatggacactgagggacaagagaaactgtcccatggccatccaagtacttccagattgtatccatgcctcccaaacccaccgcctgcccctctcagggtaaagcagagctaccctcactccagtactaactgcagccaggcctgcctctggccagctgcaaaacctagtgagagtccctttgcttctctgggcctcagttttctcatctgtaaaatgaaggggcgggcctggagagtccctggggccctctgcagttccagcatcaggactgaggaggctgctgggctctcaggtggaggcaatttcccagatcactgagccccacctggccaccattgtgtgaggcctcccctgggcattagccatctggaaatattgccatccatctttctgaatatctggttaaaacacttacctaatcctaacctaatcctttcaatttggggagagaatt

SEQ ID NO: 199691 - DNA, 125 bp, Homo sapiens
gttatcgagacagtatcagaagagaaattgaaaaatctctgttgagactctgtaatttgctaggttctgaggatacgacagtaaataagttattaggtcatatacctcagcttcccatttaatta

SEQ ID NO: 199692 - DNA, 161 bp, Homo sapiens
cttgaggttgttcccccagcagaagctaatgcaagtcaacaccctgaagctaatgaaggccaacacccttgggatcagagtccaaagtcctcaaggataaggatgcaagaagcatccatttatcagaggttctactcagaaaaggctgatgggagaagtag

SEQ ID NO: 199693 - DNA, 124 bp, Homo sapiens
tgtgccgccacctgatggaagattcgatgggcatgtatgtggacatgagccccctgaggccccagaactatcttttcggttgtgaactaaaggccgacaaagattaccactttaaggtggataa

SEQ ID NO: 199694 - DNA, 438 bp, Homo sapiens
tcagccaagcctccttgccattgctatttccactgcccaggaagaagaactcttgtacggtcagttttggatttggtgcagctactgggcagaacttaggagttttctgtaaaactactaggagcatggagacttcaaggcatgtggctgagggaatggttaataggtacaaaaatatggtaatgtagaatgcgtgagatctagtatgtgatagcacaacagggttactacagtcaacaatttattatagagttaaaaataactaaaggggtataattcgaatgtttgtaacatggagaaaggataaatgcttgaggtgatggctacccaatttaccctgatgtgattattacacattgcatgcctgtatcaaagtatctcatgtaccccataaatagatacacctactatgtacccacaaaaattaaaaactaaaga

SEQ ID NO: 199695 - DNA, 444 bp, Homo sapiens
ccccgtcacctcctacagtcctttttgtccacagcaaccagagcgatcttgctaaccccaccttagactatgacactcgcctgttcacttcttctcccttgtgatgcccctcctgggactcctcatcacactgcagtgagagcgagaatcctttattgagcctgctgctccatggaccctctaaacacagcccggcctctaggttcttgcctgtgctgtttcctctacctgggaagtcctttccccagatctgcccctggcttggtctcctcatcatgctttcagttctgtgctcaaattttcccttctcagaagaccttccctggccggccattattttaagccagaccatcccaaacctttcctctacatttaatgagactttctcaccactttaacaggacatattcatagaaatggatatatgggtgtattagtccattt

SEQ ID NO: 199696 - DNA, 221 bp, Homo sapiens
tgatactggaccccttcccactgtgagaaacacgtgatttgggagtgaccaaaggtggaataatatggtctggctttgtgtatccacacaaatttcatcttgaattgtaatatgaattgtaatccccacgtttggggagggaactcacgggtgcttattagatcatgggggtggttcccccatgctgttctggcgagatcttggctcactgtgggcaaggg

SEQ ID NO: 199697 - DNA, 432 bp, Homo sapiens
gcagccactttgttttggccaatttctcccatttgaaatgggtgtatttacccaatgcctgtacccccattatatcttggaagtagctaacttgcttttgatttcacaggctcataggaggaagggacttgccttgtctcagatgagactatggacttagactttttgggttaatgctgaaatgagttaagactttggggatctgttgggaaggcctaattatgttttggaatgtgagaaacacgtgatttgggagtgaccaaaggtggaataatatggtctggctttgtgtatccacacaaatttcatcttgaattgtaatatgaattgtaatccccacgtttggggagggaactcacgggtgcttattagatcatgggggtggttcccccatgctgttctggcgagatcttggctcactgtgggcaaggg

SEQ ID NO: 199698 - DNA, 836 bp, Homo sapiens
gggggacatcgaggtggagaagacgcagcaggcagagggggacatcgaggtggagaagacgcagcagagcgggggacattgaggtggagaagacgcagcaggcagagggggacatcgaggtgagaagacgcagcaggcagagggggacatcgagatggagaagacgcagcaggcagaggggaacatcgaggtggagaagacgcagcaggcagagggggacatcgaggtgagaagacgcagcaggcagagggggacatcgaggtggagaagacgcagcaggcagagggggacatcgaggtggagaagacgcagcaggcagagggggacatcgaggtggagaagacgcagcagacagagggggacatcgaggtggagaagacgcagcaggcagagggggacatcgaggtggagaagacgcagcaggcagagggggacatcgaggtggagaagacgcagcaggcagagggggacatcgaggtggagaagacgcagcagagcgggggaagacacagaggtgcagaagcctccaggagacacaggagagaggatgagaagggatcaagcccattgaccttttgtctgttcgcatctattttcatcgttaggtttttcactgttattttgtagcatgaaaaaaaagaagatctgagtgctaatttttttcattttacttgtccttgtgcgatttaactcatgacttctgtacctggctgctgtgcatgtagaggcaccctctgaataaactccctagacggcggccacatgagttgctctggaaaactaacaagtctgagtcaggcgagtgagaatgccgaagcgtaagacacctcgctgtc

SEQ ID NO: 199699 - DNA, 602 bp, Homo sapiens
  misc_feature (23)..(23): n is a, c, g, or t
tcctaggcaatagggagaccccngtctctacaaaaaatacaaaaatttgctgggggtggtggcatgcacctttagtcccagatactcccggacatcgaggtggagaagacgcagcagacagagggggacatcgaggtggagaagacgcagcaggcagagggggacatcgaggtggagaagacgcagcaggcagagggggacatcgaggtggagaagacgcagcaggcagagggggacatcgaggtggagaagacgcagcagagcgggggaagacacagaggtgcagaagcctccaggagacacaggagagaggatgagaagggatcaagcccattgaccttttgtctgttcgcatctattttcatcgttaggtttttcactgttattttgtagcatgaaaaaaaagaagatctgagtgctaatttttttcattttacttgtccttgtgcgatttaactcatgacttctgtacctggctgctgtgcatgtagaggcaccctctgaataaactccctagacggcggccacatgagttgctctggaaaactaacaagtctgagtcaggcgagtgagaatgccgaagcgtaagacacctcgctgtc

SEQ ID NO: 199700 - DNA, 386 bp, Homo sapiens
acagaagctgctcagtatcaggagctggagctgcctgcaatctggccactcagcaagaattttcagagactgtttctattccatagtggatgctccatccaacaccattcttttaaagtgcgcacatctgatcactttccaagtataaatggcctgaatttattttcctttctttaccaaaatccaacctaagtaatttttttctttccatactccttattcatgaactctaattgttggtaactttgagagcattggtcatcttaatttcttaccactaatgacatgacaagttaatttctgcaataagaacagctaaaattatttttatatcttctaacataatattttgtcatgaatgctttcctagaatcttccttctggaa

SEQ ID NO: 199701 - DNA, 236 bp, Homo sapiens
aaagcaaatgatatattgggggaaatatgatgaaatatgtgacaaagtatagtttcataatatataaaaagtgactgcagtcaataagtaaaaaggttagtaccctaacagaaaatagacatggcatataaacaagaaacaaacaaaataagaaatgcaaatgaccaataaacatacgtaagtaaatattgtttcactagtacccaaagagataccaactagacaatagtcaggtt

SEQ ID NO: 199702 - DNA, 277 bp, Homo sapiens
agccgcgaccccttcaacatctcatttcttgaggtgggagatccattccctcttttcagggcttggtaactggtaagttaggctgatgctcaagactgaacagagatggagccctttggcaacagtgcaggcatcagggctagagctgattcctctgccagcgtggaaaggaatgatcttttttgtgaatgtctgctcctcacccctacctcaccaaactggcaaagcttggtttccttcatctttctcctcttctgcccatatggatctgaagttt

SEQ ID NO: 199703 - DNA, 606 bp, Homo sapiens
gtaaccttggctcctgttcccagtaatttcctcattttcatctgagaccttgtaagcctggccttcactgtccatccttctgccagccttttaatcacaactattcaacaagtgcctacaatcgtccaaaatttctttcatcttcctgtcttctttcaagctctccaaactctccaacctctggctgttacccacttctgaatctgctttacattttcagctatctttgttgcagcctgacaatgtataagaaaaagaagtccattttcagggggaaacttcaagacggcttcagatatttgcattaaaaagaagtccagtgctaatagccaagacgatgggggaaaaagccttggaggcatttcagagatggttgcagcagcccttggtgtcacagaccctggggcctaggagagaagaatggtttccggggccagccacatggacctgctgctgtgtgcagcctcaggatactgctgcctgcatcccagcagacgcagctcctgatccgaccttggctgaaagatgcacaggtacagattgcatcactgcttcagagggtacaagctataaggcttcacggtttccacatagtcttaagacagg

SEQ ID NO: 199704 - DNA, 720 bp, Homo sapiens
cagagaaaacttaatggaagctatggaacttgagccaggaatcaaaccctggttgaaatttagataggctgggttgggggaggaggccaggagagattgtcccttgtacgaaggcatgttctgaaggtggccatgggaccatcaacccttaaagtaatctcagtcttcccagcctttggccacctgctgtaccttacgtctgtctgccatcattactgcctgaaagacctgaatattcctaccttgcataggtgtcaagaaaactcacacctgataaaagggcaggtagagagaggccacaggtcattttagggtactttgtaacttaaagaagagacaagtagatcaatcaaattagggaattcctgtccaggcagacataatagaagaaacaaaagagaacttaaaatagtaataaaaccttgaagcctctagaagaaaaataggagaactttcaaactcagggtaggcaaagatttggacagagcacaaaaagcactgtttgttttagtttgctactgctgccataacaaattaccagaaatttagcatgttaaagcaatataaatgtattatcttacagttcccttagattagaaatccagtgtgctcactgggtctttgcttagagtctcacaacaccaaaatcagtgttagcagggctggatttatttagaaggcctctggggcctatttcctatctatttccttgctcattcg

SEQ ID NO: 199705 - DNA, 855 bp, Homo sapiens
  misc_feature (597)..(597): n is a, c, g, or t
  misc_feature (822)..(822): n is a, c, g, or t
  misc_feature (827)..(827): n is a, c, g, or t
  misc_feature (830)..(831): n is a, c, g, or t
  misc_feature (839)..(839): n is a, c, g, or t
gccggaagtggaagtggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtaggacgagtaccgtaacaggggctttggggggccacaaaccgagaaaaacccccaaacacacaacacaacaaacaaaagggcatttaaagggggcaaaaaggaaagactcattccacacggaaaggcaagatggcccggtgcagaggacggttatgtctngcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgaacacgcatcttattgataaggtcagaggctatgacatcaagctgcttcgatanctgtnagnncaaatacntctgtgacctgatggg

SEQ ID NO: 199706 - DNA, 778 bp, Homo sapiens
  misc_feature (438)..(438): n is a, c, g, or t
  misc_feature (472)..(472): n is a, c, g, or t
  misc_feature (520)..(520): n is a, c, g, or t
  misc_feature (745)..(745): n is a, c, g, or t
  misc_feature (750)..(750): n is a, c, g, or t
  misc_feature (753)..(754): n is a, c, g, or t
  misc_feature (762)..(762): n is a, c, g, or t
gccggaagtggaagtggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtntgagagtaccgtacaggtgagcaagttgcaaganctcatccaccgcagcaagatggcccggtgcagaggacggttatgtctngcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgaacacgcatcttattgataaggtcagaggctatgacatcaagctgcttcgatanctgtnagnncaaatacntctgtgacctgatggg

SEQ ID NO: 199707 - DNA, 464 bp, Homo sapiens
atgaaacaatgtgacctaatttacaggactgttataagaattagaaatgacattttaaggcacctagaacagaattaacatatattaggcattaaaggaagatttctgctattattacattaaagggataaggtgcctgctctatcaaagcgtgtttgggtgttttcttggaaatcaagcccactctgcccactgtgtataatgctgtgacctgatcccacacatatatactcctaggcccttactctgctctttttattccatagcatttattaccttttaacccactatataatttacttatttttatgcttattgaaacctaacagaatacaaaccttataaaggcagagatttttgtttgttctgttcactgacattcataccacctagaaagtatatggcaaaagatgggtgctcagtaattatttgttgaataaatattgcaattctgtattactaga

SEQ ID NO: 199708 - DNA, 692 bp, Homo sapiens
cagatggtttgaggtcaggagtttgagagcagcctgaccaacttggtgaaaccctgtctctactaaaaatacaaaaaaattagcagggcgtggtggtgcatgcctgtagtcccagctactcaggaggctgagtcaggagaatcccgtagtcccagctactcaggaggctgtcaggagaatcccttgaacccgggaggcggaggttgcagtgagctgagatagtgtcactgcactccagcctgggccacagagcgagactccatgttaaaaaaagaaatgtttctgagcactaaagacaatttgaacaaggcagaaaagtacaaataggaaaacaataatcttactagattgtttgtttttgagacagcatctccctttgtcatccaggctggaatgcagcagcacgattatggctcactgtagctgcgaacttctgggctcaatcaaccctcccacctcagccttctaagtagctgggactattctgtagtgataatccttgttaaagttttggaaaataccttttttagagtctctctttctctctacacagacacacacacacacatacacacatgcaacttttatgtgaatgacggcatttacaatttacgtaaattactgcaggtgctatcatttatttttttcactcagcaatatgccttgaaattttcgctcagctcgtctttttt

SEQ ID NO: 199709 - DNA, 610 bp, Homo sapiens
taaccatctgcagagacatgtccaggctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgtaggggaggtggtcagggcagaatggcctgggtgtttagcagcttctaggggtgagggtggcaggaccccaaaaccaaggccctctgcatcgttgttgtaataatcagttctggcattgaccgttagcccccgagaagctgctggccaaatgactgttaccagaaggtgcccaggcagatgctggggctgaacaatgcatggcgtcttcccaccccagcccccactgctccaggctgagcccagtggctctccagggtctcagaggtcctcacgtggctgcccctttccagactgaggcagggaggtgggtcctaacagaggaggcccgcggggagaggaggaggcagcagggagaggaggaggcaggggggagaggaggaggccacggggagaggaggaggcaacggggagaggaggaggcaggggggagaggaggagg

SEQ ID NO: 199710 - DNA, 490 bp, Homo sapiens
ctgatggggttggtgagaaaatcgtgagggcgtgcaccaaggtcttgggagaaggggcagcgggtgcaccagctcttcatcttgagcccttaggaatgtgatttgcttctttatcatgcccttgttgcagggctcataaccttcagttgtttctggattcagtgtggctgtgggccacagataagcctttctgactactactactaaaatggggctgaggaggcagagcctcttttcccagtctagggcaggcaactctgtgttctgtcctctgttgctgggttgctgccactttttgtaagagggtggtgttcagctcgccctttgtgaaagcctgagtggtcatgggctgacggtggagctaccatgaaaagcacaaaagacactttctttgaggcatgcccactagcctgtggcaggaagaacactgctgactccacaacagtgtactgggggaggccaggagatgaccctctctccacgtctcttc

SEQ ID NO: 199711 - DNA, 668 bp, Homo sapiens
tgaatcgagctcggtaccgcatcgaagtctcttgcatcaaaagaaaaaaaatacaaaaacaaacgtagagggtggactcagtggctcacacctgtaatcccagcactttgggaggccgaggcaagtagatcaactgaggtgaggagtttgagaccagcctgaccaatacggtgaaaccctgtctctactaaaaatacaaaaattagctggacatggtggcatgtgcctgtagtcccagctactcaggaggctgagacaggagaattgcttgaacctgggaggcagaggttgtggtgagccgagatcacaacacttcactccagcctgggtgacagagtgaaactccatctcaaaaacaaaaaacacaaaacaaacaaacctaaaaatgcaaggtaaaatgtaacaagaagactttggaatacacgtgggaatgaacaagaaagtgagggaaattttcaaaagtcagaaatgggggcaactaaaatcctgaactggtaacactttaaggctgctgggacaagagattgaggtggtagttattgctgttgtataatagttttgaggtttgatacaatttaagaatagaagatgaggtcagaggtttgcctgaagcagttaggtggagctaagagccttgaagagctatcaataaaatggggaatttggaa

SEQ ID NO: 199712 - DNA, 442 bp, Homo sapiens
ttagaggaccccggattggcgaccatttcaactttgctgaatctgaaaattacgtgtcttggagttgctcttctcgaggagtatcttgtggtgtactctgtatttcctgaatttgaatgtggcctatctagctaggttggggaagttctcctggataatatcctgaagagtgttttccaacttggttccattctccccatcactttcaggtacaccaatcaaaagtagatttggtgttttcacatagtcccattttgccatacagatttgttttacttttatttgttttaggtatagaccatttattttgtgccttctgggttctgtgtcatacatagaaaggtcatatctagtctcacactgcggtgaaatcattcatgttttcctttaactgtttcacaatttttttgttttatgttgaaatgtctgacctacatgtaaa

SEQ ID NO: 199713 - DNA, 442 bp, Homo sapiens
tctctgcctctcctctcctctgtataaggggacagtaattgtcctctctcccttagaaggcgatgccattgttaagtgtgtcaccacgtgtaaagcactgagcaccatgtctgcacataggaagtgtgcatcctattaactaaaagtcagtgcgggccaggcgcagtggctcatgcctgtaatcgtagcactttgggaggctgaagtgggtggatcatctgaggtcaggagtttgagaccagcttggccaacatggtgaaaccccatttctactaaaaatacaaaaattagccgggtgtggtggtgcacacctgtaatcccagctactcaggaggctgaggcgggagaatcgcttgaatccaggaggcggaggttgcagtgacccaagatcgcaccattgcactccagcctaggtgacaaagcgagactctgtctcaaaaaa

SEQ ID NO: 199714 - DNA, 685 bp, Homo sapiens
cttagttccatgtgggcatttagcaaatatttagcattcttgtattcaggagaacaaagctgagaaactcttgttatcatccacacacacttgatgagcacagtccagaacgtcagtgctggcccagctcagcagctggaggaacagctactgatagcactctacaggcgcttccagtactcgagaaacaggagagcggttagcggggcaggttctagagtcaaaaggcgtggggccaaattctgccatcaatagctgtgaactctgtgccatgatttcctcaactggaaaaatgggcagcaacagaatccatcttggaagatcagtgtgaggactgagtggacacaaggaaagcactcagaacggtgctttgcaccaagtgttcatgtgtgttagtgatcctatcattattcccatagtcagatcaggggccaaatgtacagaagtgaaaacttttctaccagagtgtgactggatacacagaatcttgtttctggaatttatttactagtaggtgaaactgggcaaatcgcctaaaatgaatcctagtttcctaagttcatcactgataaggttgttgcaagattgttcatacatatcacaaagtactaagccattgaggtactcaccctgagtcctttccttctccctagttttagctcaggaaataatttgcaaatatctg

SEQ ID NO: 199715 - DNA, 484 bp, Homo sapiens
catcaggttttttatgggtctatgaaatgggtcaaggggacttagctaagaatgaccgtgggtaaaatgcatgacaaggagggatacagacaggagatgaatctctcagggtccaagagaccagggtaagatgtgcagattccttcctgtgtatgatggaaatgttttacagggtctgaagggggaagtttagaaggacagcctgctgaaatggggacagcttgaaatgcagagcaaggcagaatgcagacaacactccaaggcatctaaggagccaaacagaggcagtgggaatagaacagagtgaatcagagacaggttaggagagaaaatgagcagcttccatgttcatatttgcttgcatatgcataaaatgtcactagaagattctcagttaactaacactggttacctgtggattagtgaaatgggtgacaggggaatgaggatgagagggagtactttcactctagagccatgcgta

SEQ ID NO: 199716 - DNA, 207 bp, Homo sapiens
atacctgaaggcagagggcgaccctttgacgtctcagggccatatatcagttccctaacagtgaagcccacaacaagcaagaatttctgacatgacatgggaaaagctgaagaagtcagtctttggggtgtgttttcatctaggaggtggcttgagatggattcatggcaaatcacaataaattatttatcagataataaaaagtga

SEQ ID NO: 199717 - DNA, 434 bp, Homo sapiens
aggtgaaagaaaactaaagaaataccagtgcagaaaggaagttctttattttcaggttgctcaagctaaaacaataagcagcatttcatggatgactggcatgtcgccttttactcctcaaggcagactcaagagttttcccagaaccagaggacgagccccttggccatgcagccctaagccaggctgatccagccttgtctcgcccctctctgcaagagactcgtgggtacaggatgattgagggggccccagcctccccagcagctgctgacttgcgcttggaaattcaatcctctcaaggcaagaatttctgacatgacatgggaaaagctgaagaagtcagtctttggggtgtgttttcatctaggaggtggcttgagatggattcatggcaaatcacaataaattatttatcagataataaaaagtga

SEQ ID NO: 199718 - DNA, 264 bp, Homo sapiens
atgctttacatctctacattccagttacaacttcctgaggatagagcctacatagaagttcagcaaatatctggtcttttccacacctgggaagatgtgggtataggccactatgtgttttcctttcaaaatggcaagaatttctgacatgacatgggaaaagctgaagaagtcagtctttggggtgtgttttcatctaggaggtggcttgagatggattcatggcaaatcacaataaattatttatcagataataaaaagtga

SEQ ID NO: 199719 - DNA, 437 bp, Homo sapiens
ggctggtcttgaactcctgacctcaagtgatccgctcacctccacctcccagagtgctgggattacctgggcctgtcagattttagacacctctggtaatctgtcagtttcatctcttttagaaaatcaggaatcttatcacctgctctgatttggaagtggccttagcatttcattttcctgtcatcctggagaatccttttgtctctctcattttgagtctcttgtttctgaattcagtgcatgccactttttttattccattggttttgtaagtgcatactaggtgatagatgaataacatagtgaagctagatgacctgattttgaattcttgtctgtcattttctaacagcttacatatctgtaagcaaatatctgtaagtggggtgtaattatagtgcctgcctatgggaaagtctaaaaattaaatgcca

SEQ ID NO: 199720 - DNA, 659 bp, Homo sapiens
gctaattttttgtattttagtagagacgccctgttgtcccggatggtctggaactcctgagctcaggcaattcacccccctcagcttcccaaagtgctaggattacaggtgtgagccaccttgcccggcaatttttgtatttttagtagaggctgtgtttcaccctgttggccaggctggtctccaactcctgaactcatgtgatccacccacctcagcttcccaaagtgctgggattacaggtgtgagccaccgcacccggcccacttgcttaccttttatattattttgaagtaaatccaagatatcatttcatctgtaaacataaccatacacagtattattatcatgctttaaaaagtagtaaacccaggctggacgaggtgactcacgcctgtaatcccagcactttgggaggccaaggcgggcggaacacgaggtcaggagatcgagaccatcctggctaacatggtgaaaccccgtttctactaaaaatacaaaaagaaaattagccgggcatggtggcggatgcctgtagtcccagctactcgggaggctgaggcaggagaatggcatgaacccgggaggcggtgcttgcagtgagctgagatcatgccactgcactccagcctgggagacagagcgagactctgtctcac

SEQ ID NO: 199721 - DNA, 653 bp, Homo sapiens
gctcactgcaacctccacctcccgggttcaagcgattctcctgcctcagcctcctgagtagctgggactacaggcgcgtgccaccacagccgtctaatttttatatttttagtagagatagggtttcaccatgttggctaggttggtcttgatctcttgatcttgtggtcttcctccttggcctcccagagtgctgggattacaggcatgagccaccgggtccggccagaatctacatcttaaactgggtttccaaaggattcagatgcacatttcagttttgagaggctatgtcctaggttccctgttgatccatgccactgtgggtgatagcatttgcagatagtaaggattctgctaggcctaggaagcttcctttgatattctcagggggtcttttggctttctgaactttcctccttcctagtgctctggagatgatgcctttctacctccctgcttagcaggtaggaatagttggacaaaatgtttctgtggcccggtgtatttattcaagacttccccaggagcttctcctagtaggcttcaggcctctgggaagtccctttatgcagacttagagcagcactaaaggcattcatagtctgaattggggtggtagacaggtatgcaattccagtgcctttagaatt

SEQ ID NO: 199722 - DNA, 339 bp, Homo sapiens
tgagggagacagtgctgataccattttcaaatgaatatagagtttgtagaatttgtcataaaagcataatgcaactcatctgagaggggagagctgaaaaggaagttgaaagtctggttgaacagtagatgaacaatagactaagcagcaaaatgaccagtttggcctcattatcagtatttggcctctggccaagtcaaccaagttaagggcagcacacacagaaacagagctcggagttcctaattttcagtcctacagtcctgtgttttccttagataaccaggaggccactaataagctggttttattcccactttttctttttttttttttgag

SEQ ID NO: 199723 - DNA, 538 bp, Homo sapiens
attcattggcttcctggcccactccccatgccatttctcctggccttggtcagtttttaaattttaaactccagcctggggcagagcattatacaaggagttttgataattataacacaggaaactatccatgtgacatttaggcatttggattcctaaggtgccagaaagttatttgtattggaataggtcctaatgatttaattcacctaaaagagaaatagtctcggtccaaatggtaactatttcagaatagaattaaatctggtacctgaacccacagtagcattcacaaaagcctatacttttctggacagaaattagtaatggcaaaccaatcactttccttgaaatacatttgtttacccaatcataaatgaccaattaaattccttattattgagaaggtgaaggtcctatttcaacacccaaactactcagaattctaaggctccttccctcttttcatgccaggcattgacacacacaactcaatttacctttaagaacacttccacatggtgaaattgtcaaatct

SEQ ID NO: 199724 - DNA, 377 bp, Homo sapiens
tttgcacaggttattaatcactctgggctgtgatgtacacagaccaaaagaaagaaaaaaagtcagtgatggtggggggcagtgatggagtgatggggagccatgttgaacttcctcccttcctcattctttgttgatttgtaattaaatccagacttagcaggagtatcattacattgtgaagatgagctggaaactcttttcaagttaaatttcttaacattatcccctgcagtaggaagggcattcacactgtgaccaatctttaaaaacaaaacaatgctaaatagtgcttgcatatttcaagtaaagattcctccttcagaaagacttggcatttgttgtaagtggtgttatgacaccatggtatagaaaac

SEQ ID NO: 199725 - DNA, 526 bp, Homo sapiens
tctatcagaaatacttcttaacgaaaatttttgtttctattgatgggagaagccctaaagaaaatctcccagaaagagtaattagatcattttatgaattaaacttaatttaagcagtgcttaacctttgaggaaattggcaaaaaaaaaaccacattttttaatcagcccattgatccaagcttgcagagttgtaaatatttctatttcaagttgtctgtgtagtgcaaagcagtcatcttccatcctggaatgttctcaaggtgacatctagaggatgttgtggtgatatctcagggagttattgatacttttatattgcagagggaagttttggcaggcagctagtttaagccaggtcccttatcattgatggtactataaaagggagtatccagattctttagaatcacagtgagattcttcattcttgcataattcatggggataaaataaactttaaaattctggcaccaaaataaaatgattgaaatttccatgactgttttgcattacttaagaacac

SEQ ID NO: 199726 - DNA, 388 bp, Homo sapiens
tctagtattagaatatttttggctaaaaaattattttgaagcataaagaagcttttgtttgctctggtgattttcataacatattcacattcttaatgtatttttggtttttcagaaagttacttctggcctgtgttctttcagaatataggttgcagcttgtgttaagtgcaggaactattgatagactgagtttagaagaagggaaaattggtataaagtggttgtgtattttgaacattggggagcttcatagatgagttaaattgttaggatatggattaagaaatgttgggttaggccaggcgcggtggctcacgtctgtaatcccagcactttgggaggccgaggcgggcagatcacgaggtcaggagttggagaccagcct

SEQ ID NO: 199727 - DNA, 572 bp, Homo sapiens
gtgatctgcttgcctcagcctcccaaagtgctgagattacaggcatgagccaccgtgcctggccaggtcctgatacttctaaggccagccactgaagaagagcatgggtcaccaccacttgggaacttaacccacccctcttcttattaatacttacatcccaagaagtctactttctcctcttggggtggccacttcccttgcctctggaagctgtggtcttaaggatgggcaaaggaggccaggattcaaaacaccaggtctttttgccctttctaaacatgggtgaagaggaagaaagtggacactctcatataatgcttttgtgaatgaatctgttaccaaaacaccaggagatggatctaagtcctgctactctctgcacaggaggccaatcatggagatgagcattaccagggaagaggctttatttgggtgctgcagctgatgggagatcagtctcaaatccatctccctgaccaattaaaatcgggggcttatatatacagcagggaagaaatgtaactacgtgcaggtaaagaggaattagggagaagtgaagaaataatgag

SEQ ID NO: 199728 - DNA, 200 bp, Homo sapiens
ggaaatttttttttcgctattgtagttttagagcctggaacagtccctggcacagaagaattccattgaaagagggaatgaatgaatgaatgatgcttctttcttatacaacaataaaatttcctttagggcttgtgctttatctttaaaaggaacccagattttgcaaactactttataatgtatccaactttatttta

SEQ ID NO: 199729 - DNA, 214 bp, Homo sapiens
taacatcctattaatgtggcaccataaatctagcttgaatgtactgtgcttcaagtttgtaaatgtaagtagatgggacggtcagcctttcctaaggacaatgtaccatttgtactcattgcggtgaatccattttaagctaggtatctcgctttgagatgatttgatatgacaatcaaatctggacttaagaaataaaaacttctctccatat

SEQ ID NO: 199730 - DNA, 419 bp, Homo sapiens
ctcaaaaaaaaaaaaagaaaaaaagtttcaatgaaggtttcagagggtgcattctactaagatcactctgatgagagggccaagaaggaaggccacagaagcttttgtgctgttgtctgggcaactgattctcagagtccccagcaggtgctgaggttgggtctgccctagccaggatcttgtcaaggagggagggaaggagagcctggaggaaccactccggtctgcatccagctcctcccttttcactgctgtggttctgtggtttgggcagatgggacataccatacatagtcttcaggaggtgaactgtcactgttttgtatttagtacaagagactatacaggcccagaatgacctggtgtttgaggcagtccaggacaaaggcaacatggagcaggccatccttgagatgaag

SEQ ID NO: 199731 - DNA, 817 bp, Homo sapiens
caatgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgaaaaaaaaaaaaaaaaaaaaaaaaaaaaaaaaaaaaaaaaaaaaaaaaacaaaaaaaaaaaaaaaaaaaaaaaaaaaacaaaaaaaaaaaaacaaaccaaacaaaaacaaagaaggggggggcgcgcgcgcgagcccgccccccccccgcgcgggcggcccccccccgcgcccccccccccccccccgcgggaagagcaacgacggccgccccaagcgagtgggtgagtacttatcacactcaccacgcgcgccgcgagccgccgcactcccaacaaaacaggcgagagagtgggaggaggagacaacaacagcgcgcacgacagacactgacctcctgctgcacaagaacacaaccccctcatgaacgcggggaggtgcgacaccagacctagcgcgccagccacccccccacctcacgcaacgcttgcaagaccaccacacagagaaccagcgatacaaaaaccaacgtagccgagcactcgcatgacgagcacaacaaaccagcacacaagatctcgggcccagaaaaaaagacgacgccacccgcagcgagctcacgcacaacaaaaataacacgagagggagccataaaaaacacacaccccacagcgcaa

SEQ ID NO: 199732 - DNA, 217 bp, Homo sapiens
caatgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgaaaaaaaaaaaaaaaa

SEQ ID NO: 199733 - DNA, 402 bp, Homo sapiens
agttgcctccataaaggagaatgatttttcaccagggaaatgatttacctcctaaaaaaaggggtatacccaagaaagtgaggaattaggaagaaaatgccaacactctttaagcaaattcaattctataggctcaggttgttaagaacagtatacgtttcttagaaaagaaagtaatggtcaacaggggccagctagcatttactaaacttaagttatcctgaactgacctcattttctcattaagtagggtattattagtagttttagagagcaaactctagaaccactcataccctcttagtaattctacttcagggaattgttatttataataaagcttaagaaaaatattttaaaacgggagtaagagcacatcacagctgttttaaaacattagaa

SEQ ID NO: 199734 - DNA, 567 bp, Homo sapiens
ggcttttcccaggatgcatgtctaataattttcactgccatcttaatggggatccctctctgctaagccgaggaacacagcattattatcctttaatttggggcatactgactctgactaagtgaactatttccaagcactctattcctttaaaagaaggcataaagggatactgggtagacagctggcagtttctgtcacaactccttcttgaatgtttttcctcgagcagaaaatatgagctccatgcaagcagtgatgttgtctgtggggtatattgcaacatcatccttagtgcctactgcagtgtctgacaggcacaccataaatagaggtgcaataaacatttgctgaatatggagagagcacagttgtgggttatattttctaagatgatacttaacgatgcacatgcgtgcttcctgtcacattcaggctcttccataagacaggccaacttagtgtcaccattaagttattcacttctccactccactccctgggaaaacctacctgctttaaatctcagaaccacagtatcatccttaccatctacaaggacagtcg

SEQ ID NO: 199735 - DNA, 719 bp, Homo sapiens
  misc_feature (673)..(673): n is a, c, g, or t
tgcttcgaatcatcttgctccttaattttttaacatatatagctaaaagtcacgtgcccaaacaatatctaactaaattcccactagctcccttacggataacatctctgatgtgtgcgtcgctatagtaacggttgcttaaagttgtgttttgggaacttagagttagctcttgtccattttaagccagtagagaccatgagcccttcaagtaggtctgagcgaatgcccgacttcagagggccaaaaacacctttctcggatcacgctaacaatgtctttttcttaaacatatgtcccacgaagaaccatgtagctcaatcgtgttcaggcaaagtccccatgccctcacctttcccaccagcagtcatctttcccacgccttagaccacccacttcttattcctccctaggccctactcttctgggaggcaagtttgagatttgttctgcagtctccttgctcagcagtcttgtgaataaatttttcctcttttgtgaaatccactgtcacagtgactggctgctgctcatgggcacagagcatctggctgggtgtcaccatcgcacccgcacagcctgcagcgacacctggggtacttttccatcaccaagttccgccccttcgacttcccacagatcatctgcatccatccacttctcacactcaccntatccacaaacagtgtccaagagacttcgatcgtccgactcgatct

SEQ ID NO: 199736 - DNA, 516 bp, Homo sapiens
atgttttcaataaattattaatgaaatatttctccaacatacataggacaactgagattcacttccaatcaaaagcaataaccctcatgctggacagttatctttcacattttatatgatagaattatgataaaaataggttttgaagcagccttagataagaatataactaaaagtatgccaaaggatttatttagaattttcagataataaaaaggtaagtttttggttgtgcaatgcacatccatgtaaatatatttgctttttcaaaagcaaatttagtattcttaagtttcctgagtgacaatctcataaattttggtggaaatgacagcaacattgggttatttcaattatgcatggagacctcataaaatgagttttttaaaatgctcgctcaacagcaggtcacctatctctatacaacatcagaaaataatagtacctctctcaaaattgcctcaaagagcaacagtaagaggaaaaaacaaccatgcaatggtttactcaaactgc

SEQ ID NO: 199737 - DNA, 1757 bp, Homo sapiens
ggggaggtaggaaggaccaggggcattcatgcttgtttctagggggccctaactggatctctggatcaagacctactcaggggagaaagactactctgggttccatgttaggactgacgggtgcatcttaactgagatgcagacagtggacaattcgaactctgacctgagagcaagccccagccttggtgctcataaatgctccgcttggtccttcacatttgtgttccacacaggagaagccaagttgtgagcagtgcaccttcacaagcaaagcctcgactgaaatcttctctaacaattggctggtcactcctgagcgtaatctaccccttcagaacactggggatgaatttagagacatcgaagcctcctgatgagaaatacgtgtccactcaccgggagaactgaaataccaggagatttctacacaaatctcacagagtccttctggcgtcctaggggtttgctcacatataagggactttctggtaggaagagagtctctttacattctttattatatgatcctggtggctttgtagagagatggtacagctgacagatcatgtcctgtggggccagggagttgtgtgtgtgtgaatgctctgtgaacttgggcaaactacttagcctctctgagccttagctgcatcagctttgaaaaacaggatgataaaatggagtcaccttatttgacttttataaatacacttacacaattacacaagttgtggggatgggaagagagagttggggaaagagaaatgagagagagagagagagagaatgaatgataaacaatttaaacaacagtggggtgtagaccaacgcccagcctggcaagggtgagcccagagagccttccctcctggctattggcagcctccgcatggaagcctgtcgttgacttcttaatgatgagagatgttctgggggcactccaggattcttggacatgggatcgtcttcacagctgtgtctattgaaagctgaagtttcagtctcccctgccccctgccccctggagtggcttcccaggggaaattcaagggcacctgtgactgcatggctgctttcctttcctttactcaatgccgtcctttggtgacagccgtgtctcatgccaggatacatgaggtgctctatagtagtatgttttccctcctgggaggtaattttatttaaatgtgaagtcaaaaggatcactaaatagaaccatgaggcaaccactctgggcacctgcctggtgatatccacaagagctgaccacaggtgccccctgtgcccagcaagtccttggctgggcagtcacacaacaggcatggggatgtgtggccaccaagccctccagggcagtgctatttgtaatagtcccaaatgggagagatggcaaacgcccgccaatggggcagcatggataaatggatgctgcacagcaacggcgatgagtgagccccagcacccgtgagctcaccagtgtaatattgggtggaagaagccaggaggaagggcattcacattctgtgattccagctacactatgtttaaatatgggcagagctaggctgtggtgctggaagccaggacagtgggatccttgcatgggggtgatggtgctggtaggttctggtaatttcctcttcttgatctgggtgtaaacattttgtgaaaattcaatgagctgtacatttatgactggtacatttatgactttgtatgaatattatactttcataaaactactttaaaatatg

SEQ ID NO: 199738 - DNA, 715 bp, Homo sapiens
agtatataatacacattacaaatgacaaaagacaataaagaatgtgtaagcggttgaacaaataatggattattgctcctcatttagctatcatattcacagtagaagatatcctaaaaagacatgtagtcagtgaggaagaggattaacagagaccagatcatcttcagctccaactaagatggcagagagctgccacctgtggccctttgatgccaggtaatttctctctgatatcctttctagtcatgcaggacctttttgccatattatctatacatatggggcaggatcctaacaggacctttgctctctagtggtaacctgtcactgaaatgggaggctccagtttccagcagggagagtgcctggaaggcttggctcttctggtacagttatctttgtaacttgagaaaatttattccagacctactacaaacattcgtgtgctcacaagcaccacagacagagcagcagccaaagctagctgcagcctgagcatgggtcagtgtagggaaagaagctaactgacctggcctgagtcacctctagaggggaagaatgtaggacttgtcccagcctttgttggttagtttcccaaatggaaaacagggaccagagtaggtggggtactttgaggtcctcatacctttcagaggactggatccttgttttcattcttgttcttattgttaataagtgtaataacagtatt

SEQ ID NO: 199739 - DNA, 341 bp, Homo sapiens
gcattaatgttctccaaagatctaggacaaggctcagctcaggtcttcctgccttaggaacctgcactgacctcgctcccagggttggttccaaaggtgcagtaattgcaccgtgccagcctcttggcactctgtggagttagggtatgtgccttggcttcctgattagagtccaagctcctggaggctagacagtgcagcccagcacttagcgataggaagcactcagtaacatttgatacgcttgaggaacatgaaagaaccatacctgcttcatgggtcagaacaaacaggaaaggcagtcatagaaggagtccagatttcatacacacacacacaca

SEQ ID NO: 199740 - DNA, 385 bp, Homo sapiens
ctttaattaaggagcttggctgccctctcccatcctttcaccttcccctagaggtagagagcatagtgattaagggctctgagtaaaaagcggactcacagctgggtactgtggctcacgcctgtaatcccagcactttgggaggccaaggcagacggatcacgaggtcaggagatcaagaccatcctggccaacatagtgaaaccgcatctctactaaaatacaaaaaattagccaggtgtggtggtgcgtgcctgtagtcccagctactcgggaggctgaggcaggggaattgcttgaacccaggaggtggagattgcagtgagccgagatcacgccactgcactccagcctggcgacagagtgagactctgtctcaaaaaaa

SEQ ID NO: 199741 - DNA, 645 bp, Homo sapiens
ccggttggctgggcatggtggctcatgcctgtaatcccagtactttgggaggccaaggcgggcggatcacaagctcaagagatcaagaccatcttggccaacatggtgaaaccccatctctactgaaaacagaaaaattaactgggcgtggtgctgcgtgcctgtagtcccagctactcgggaggctgaggcaggagaatcgcttgaacctgggaggtgtaggtttcagtgagccgagatcgtaccactgcactgcagcctggcaagagagcaagactccatctcaaaaaaaaaaaagacacccagttatcctatctgttagaattaactatttcctaatatgtgatatccagtgagggtttacattttcccagttgtccccaaactgtttaatagctttttaaatattaaatcagaaagccaggcatagtggctcacacctgtaatcccagcactctgggaggccgaggcaggcggatcacctgaggtcgggagctggagaccagcctgaccaacatggagcaaccccgtttctactaaaaacacaaaatttgctgagcgtggtggcgcatgcaggaaaatcacctgaacccgggaggcagcggttgcggtgagccaagattgcgccattacactccagcctgg

SEQ ID NO: 199742 - DNA, 409 bp, Homo sapiens
tcccagtcaggggtgtggctaaggcaacttcttctaaaagatgaaatattaggtagccactacaatgatgtaacttgagagattttcatgacactggaacacagtgatcctaggtgaaacatgggaacacacaatgacattagccatatgacctccgctatgtttaagaaagcaccgcctaagactttcaggaaataagcccaaaggttaattgcacttctctctaggtctctttttatttttttgacgttatccaaaattttctacaatgtgcaatgaccacttttatcactggaagacgcttcaaaacactacaaggtacatttttttaaaaaaagttaggaacatatcacaaaaacaggcttagttttcttaaataaacaaaatgaatttaccatgaatctattta

SEQ ID NO: 199743 - DNA, 195 bp, Homo sapiens
aataataatacctatccatatggtttttgatgagaaaaactgagataataagtgcaaagtgattagaacagcccccaaataaggagctgaggtgtttctgggtcaaagttagcaacattattctactcctctaagccagtttgttttccatggtaaatagaattccgaccattgttttgggtaatatatttagtt

SEQ ID NO: 199744 - DNA, 496 bp, Homo sapiens
ttcattttagggttttatgtatcgagaactcagataatatttacatgttttaatctggcttcaatattcctttagattatttgttaatgaggcaaatactggaaatactaaaaaaatacacacgaatgtggttagtcctagagttgcacacacatgcaagatgcattcctgtgtttacagcaattaaagttcatagcaattacttttagtaaagattttttttgcctttcattacaaatttgattaggttgaacaagtgaaagtcatagataatctacctttcttaaatagtttgagatttaatgcttacattctgcaaatataacatatttgaaagcaaaaatcatcttaaaatatatttacctgaacttactttagtattaagtttagctttaaattaaaattttagtttgatttaagcattattccccattcaaaattaaaatatcttataggagatagaacaccttaaaacatataattgagttgaaaacag

SEQ ID NO: 199745 - DNA, 403 bp, Homo sapiens
actggagcagacctgaaactgctttcaatatttgcaacagttttaagctgtgcttctctggactgcttacccacttggttctcaaatgccccaggtgccacagcaaattcacacggtaccatgggatatttaagcaatacaagagaaacagtggtattcaccatctgtcagacactgcaggaactaccagtgaaacaatcaactcacagtttcaacattagatcatgctacattcctttggatgataccatatttttgtgaagctgatattttagaggttgctgtgattaaaaaaagtatcatgtgaaagtcaatttgaaacaagaaataaggatgacaatgtcaacttccaagattcgaaaagatgtgtacacatcctactagtaaatatttgtggttattt

SEQ ID NO: 199746 - DNA, 409 bp, Homo sapiens
ataaagcttaagtcaaatgtctttctagtctttctgcagtattcctccccaaccccgtcccccagaatcttagagcaatctcagcttatttctagagtctctaaatgattgctcatggatgtgaaatgtgtgaaatttagaatgtgctccatgtatgtgttttgtttaaagaagcttcagtatagagattgagcctaacatttacttgttgtgaagaagttttgacacattgatgagaagttctttccctaataatatgcttaatagtgtatacagaacatccttcatggtctaagcagaagaaatgatggagttgggggaagaattcgaactctttggtgtggtttcctgttatttatcctcaaaataatttattctcattctttgcttgtacaccattagccttagg

SEQ ID NO: 199747 - DNA, 458 bp, Homo sapiens
gcagtgtgaaaacggactaatacatatgtacatgcatatatacatatatacagatgcttttcacttggctttcaacaaagatgtatttatcacatttgcttttcatgcaaaatgttgtgaccaagtgaaaaaagataataaaatagaacaaataaaatactgaaagaaaaagctcttgaattttgctgaaatgaaaatttaatgataaatgagaaggcctctatttaacataaatgtaaccctgaatgtgttaacattgtcctctttgacataatagataaatatattgagctgtaattactatacataccatactaagtgcttgaattttaatctaatctctgcctacaaaaaaaaaagagagtataaaattgcttcctggtgttcttagaagagagaattaaattcataacacaaccttctgagcactgtgccctgcgtcctgcttccccttcctt

SEQ ID NO: 199748 - DNA, 194 bp, Homo sapiens
gagggaaggaaggaaggaaaaagagagagaaagaaaaagaatgaagaacgaaaataaaaattttttaaaaacctaaggttaaaataaaccctttttcttcatacataaacacatgagttcaaattacagctttgctgcttaatagcttggtgacctaggacaagttatataacctctctgtgcctcagtttcct

SEQ ID NO: 199749 - DNA, 397 bp, Homo sapiens
gtacaaaatacaatatattattatatcataataagataatagctattctttactgaccattttgtagtcatccttttaagcattttacatatattatttcatgtaattttcacatcattcctgtgatgtaggtagcagtatctctacagatgaagaaatggctggagagcattatgtgaatcttctaaggtcatacagctagtaaattacaaactggaatgtgaatctagtctgtgtgattttaaaactcttgcttttgacctctgtgctatacttagtgcttgtgtattgcactcttaaaagttgattgattgttgatggccattactaccctataagtttactgggtaaaagagattttggtcttattactcttaaatatttgctaactatattc

SEQ ID NO: 199750 - DNA, 229 bp, Homo sapiens
attgtggcctaaaagcatacctaacaccagttcctactctcttttaatgaccctagtgtggatcaagagctagtaaatcttgtaaaatagcgagagttaatgacttatgtttatggttacccagttcttccctctcaagtcttcttttttttttaccagaatattagttctgaacaagtcaatatacttgttcaggccaagatgtgaactaaagattgtatgtcctttg

SEQ ID NO: 199751 - DNA, 650 bp, Homo sapiens
ttttaatatataaatatacataaactatttcttaaaatttaagtgtgcttgctttggcttcacatatactaaaattggaacagtacagaagatgagcataaaaatttaaaaataacaaaatacatagtcaagtgcgaacacacaaacatggttgtgtgtcagttgatcatcagtggaaagacatggagacttctttggaattttatattaattttcggaggtgctgcccataactgtgatcatatggaaatggtagctccttcctgttgtgtcactgcttcctggtccagttcctgacacagtataggtgctcagtaattatttgttgagtgtaggaatgaacaaacaaaacatggaaagatttttggaaaagtgtagagttgccaaaattagtcctaggagaaatattaaaattaactttgacttttttttttttttttttttagaacaaattgaccacttgcatctgagtactgccctgagcagtggagattttttaacttcccattaaagacagggatgggtgcagtggctcacccatctcagcaccttgggagggtgaagtgggagaattgctggagccaggaattggagaccaccccgggcagcatagcaattcctggtctctacaaaaaatttaaaaattagcc

SEQ ID NO: 199752 - DNA, 416 bp, Homo sapiens
ctgccttactgatgcccaggttccttctttaatctgttttgctctttgcctacctttgctggttgttgttgttcttcatctttctcttttttttaaattttattttaaatcataccctcctatttgttccaccaaactcatatactactttgcttttgcagctgctgctttgaatctttactcttgcttttttcacgtgttcccttgccttgcctttggtatgttttttgttttgaggtgacatccagtcatgtaatattctggaagtccaagagatccagaaagtcaaacactagacaacttaaggtttattactcacaagtcctttctgtgtagatatttacgttttggggtcacaggcttcgttagtaacctgttatcatatgaatcatacattgaagtgtttgatgaactat

SEQ ID NO: 199753 - DNA, 820 bp, Homo sapiens
tctttgaatttcttttgaataaataatatgaaatgttctgaattatcttactgtcttgcctcacattagacagtatccgtgagatacacaggagtaagctaaccacccatcccaatttgctaaaccaggacttttagtgctaaaatcagcaaagtctggagtaaaccaggacagttggccaccctgtgaggtagagggaaaacagtaccctgtttaatgaaggggaatcagcagtgacacacataactaggaatcaagtctattgaggccaatcaaaataatattttcctgagatccctggcgtttagacaatttttaaaaactattccttgtttttttcttattcccccagtatatgtctctcccttaaataatgagtgaatttaattcccaggtaagaacattgtattctgttgacagtgataggtagtagataggtcccagtatcagacctataatcaggaggaataaaatacgtttaagaaattttattgtagtggaaaagtagtaaagatgagtatcaacagaagaaaatactaggataacttgcataaaagcataataaagcatccccaaagaagaaattgtcttgttgattgagatctcatagttgtttgctgccagtgacttttatttttaagcctttctgccaaggtttttaataggactctgtgcaggagacacaagtttgtagagcaaactaaggggtgactagactgcaagctttcatgatccctaatttctttaagaatgctatttctttgaaacctttaagaaaactgaaattggttcctaaattgttccagagcagtgagttttc

SEQ ID NO: 199754 - DNA, 519 bp, Homo sapiens
ggagtgcagtggaagcgattcaagcgatctcagctcactggaacttccacttcccggattcaagcaattctcaagcctcagcctctcgggtagctgggattacaggcactcgccaccatgactggctaatttttctatttttagtagagacagagttttgccatgttggccaacctaatctcgaactcccaacctcaggtgatccacctgccttggcctcccaaagtgctcggattacaggcatgagccaccacgcccagccaatacattttcatcaatacttcaaagctgtagacttggctctttcaatataaggaaaacgccctccatgcaatctaactggcaaagccaatatcagtgccaaatcagcagcaatatcagactttattgcattcagaaagcggctgactttttacaattgtatcttcacatgtattttatggatattattaaaatactgaggtagaaactaccgaatatattttgcaaactagattacttgtttctgcagccaagatt

SEQ ID NO: 199755 - DNA, 506 bp, Homo sapiens
ctttagttggagaaagactggaaagtacttgtgcaaaaggagatgtggaaactctcagaggtttcattttgttattctgcttgtttatttgtgagtgtttgcaaaccgagtggggtgacaatccccttctcctacctccttttttcttggaaggaggactttttgttgcagttttagacatttctagcagcagaaattgtgggatagggaagtgaaagtgttggtgtcggtggccaccagagtctttctggattccttcctgccaagatctgcaagatcaacactgggattgattgctagagcagcagcccgagtttggaacccatcaatacattttctgtggtacaagctaggtgttttgagctaagagttaccaactaagacagaggttcatcggaaaggaaacgggagtaaaagaaagggaggagggagggaggggaaaagagagatgggggaaggaagagagacagggaaggagagagcagggtttcatttctgtccttctg

SEQ ID NO: 199756 - DNA, 505 bp, Homo sapiens
aaccctatctatatctatgatagaagtcacaacattttttccagtttgtcattttacttttttatcgtttcttcatacttttttatttctaaaatagcaaatgtgtcactcttttctgttattgctgatgggttttgagtcattattagaacacttcctctattcccaaattactaagtaattcacccatgttttcttctaatacacatatggttttgcatttatatctcggatctattaggaatttatcctgatatacattgatctcgcataattttaaaatgcaaaacaaaatgagatcctatattctcgtatcaaaatagaaaatattaagtgcgatactatccagtgcaagcaaaagaatgggaaaactggcaacctctccctctgctgatggcaggctacgctgatgaaactctttggaaggcaaagtagaaaaaactagcaaatatatatgcacgtcagaatttctcctacatgtgcttgtaggatacttacatcacat

SEQ ID NO: 199757 - DNA, 899 bp, Homo sapiens
ccctcccactccccattgtcctcttcccctcctccccctagccttactccttctcctcttctctctccctctgaagcccctttccctcctctcccttctctctaccctcctcaagcctccctcctgctctcaggcctccttggcccactccccttgctcactgacatttggtctcctcttccaggaaactgcttcccttgtgggaaagggctcaggccctaataagtagaagaggatcaggcgagagggagtcagaacccctgagatgcaaaggcagcagaggggcagagaccaagagcaagcagtgaagagacatttgcagaaacagtcttggagactgaaagaacaacatctctggtccttcctttagccagatctgattctctgccccttccccaaaaaatccctcatataagaaaacggcacttctcaccatctaccagggcttaagccagacacccaggagtatcccttgacaccttgttctcaaatccacaccccagtccaacagcaatcctgtctgatccacctgcaaaatagatccactatccacctgcccccaccatgacccccaccctggtcctagccaaccccagaagcaaagaagaaaaatgctaagaaaggtccctcaacaccttacactaagtcatagcttggccctgaagaggaggagcaggaagacctgacaaaggacatggacgagccctcaacaggtccccaatgtagaagaggtgacacttcccaaaacagacaacacaaagaaagacgtcagagtcggacccagtcaaaggcggcaccatgaccgacctggactaacagggaagatgaacagccatgaagacgacgggcaaggatgaggatgacaacagtacgggaacaagggagagcagaccaagaat

SEQ ID NO: 199758 - DNA, 127 bp, Homo sapiens
ctgtaagccaggattcctgatccagagacaatggccccgatgggatggagcccgaaggcgtcatcgagagtaactggaatgagattgttgacagctttgatgacatgaacctctcggagtcccttct

SEQ ID NO: 199759 - DNA, 505 bp, Homo sapiens
gtgtgctagatgttttgttgttactatttaatcctccagatctattctccatcctttaccctgtgccctaggaggctgcgtcatgtactacataaactgggctctttgttctctggctttaaatcgggttcaataaatgagaagcaacaaccagggtctctctggactcccacaactactctctccctttgcccttgctgggccaaatatggtgcaacttcctatcattgctagtccctaggtgctgcactattccttgctggattcccgtaacccttcccataccattgtaaatacctgcttcattacactctttgacctaattaagagtgttacttgtttcctatcaggatactaatagagagggacacctaactcagtctggggaagcctgggaagaattctcagaggagatgatgcttcagctacgttttttggttggtttgtttttgagactgagtctcaatctgtggccccaggctggagtgcagtggtgtgatctcgg

SEQ ID NO: 199760 - DNA, 272 bp, Homo sapiens
cttcacagctttgtaaggcaggagaaaaatcacacaaatttactgactgtacttaccttaaatccatgaccaactattaatatattcagttaggttcttagtgttgcctggcaacttcttgccttttgcttgtctattcactctcccctctagaggactattttatctcttctttctccttagttatctcacctctcctcccagttaaaaagataacttctgcatgcccacagccatttcatctactagcctacctgcatttgcacccatgt

SEQ ID NO: 199761 - DNA, 499 bp, Homo sapiens
gaaaggttcggtgctggaccgcggggcatccaacccgggaccgggggcgacccacggacactgaggaaactaccgcctataagcctatcatcagaacctctggcacaacacaggccagaaacaccagcatccaagatgaaggcaattttctgtttatggactgagtaccccacaaaagatcttattctgaaggccatggaacatgtctacccacatggatcaagtgggcagactggaggagaaacagtttaaaggccctgggggaaggagggagcgccagggagagctcctgaagacaacaggaattccaagtctggcactcgggagaaatcctcccttcagacattattgatgtctggccgaggagttaggaaaaacttccttgaaggagggattgaggttgagatgggcatggaacccagatcttaggcagagaaagcatattcctgtttggaagaaccctgagtacagaagtcagctcaaagatatcagcttggcc

SEQ ID NO: 199762 - DNA, 351 bp, Homo sapiens
gttatttaggttggtatcaggaatggagcagggattggaactcaggtctctctggcttgagataggaatctacagttttctaactcttgagcccacgtacccatctgttacctgccagacaccgcatctgacccattctcatctccagcaatcattcttaaactccatcaagcatcagaacagcctacactgcttcttaaaacacgatcgcagacccttccccagtctcagacttttagattcaatggatcagggatgtggcctgagaatgtgcatttctaataagactctcggtaagtctcctgctgcagctccatgctggaccatgctttgagaaccacaaacaccagg

SEQ ID NO: 199763 - DNA, 572 bp, Homo sapiens
agtgtaaaacccactctcagagcagccttctgacatgcctgaggctgaaccccgaagaggaatctactgaaactggacttgaaagcctttgtcacaatgaaaagcaccttctgtgactgacattcttttgtgatctcctccaaaaaagttatcataattattgaacatttcctctgtagcttattctcaatccaatcagttataatgaaaatagtctgcttgctttttatattcttaagttttcaaaatgattagtgcttccttgagatatcccattaattggacacacaacccagatgaaaaggctgaaacccaagagtatataaaaaaacataaggttgttgcaatttaagtgccttcaaaagatctaatttgatttctaaaagcaattttgcagatgtgaaaattaaaggcacgcagaaacaagatatgatttaatgaacgtgtaggttaagaaacatttagaggtttcagtagctttactctgacgtttttgtttgtttgtttagctgttatgttggaaagattgagtccacaacacaataaaaattactgaattttaaaaaaaacta

SEQ ID NO: 199764 - DNA, 520 bp, Homo sapiens
aatcgagcgctgtaccactatttgtctttggaaatgggcactttagaagctaaacctggaattctgccacctgtaatacaggccaagcaatgaaatctgataggtggagtcaaaggggtccacttttggaggttcctgtgtcacttctccccctcccagatgtctcctcatcctgagtgtcatcaccaagttcttgggcctgtacttaaagcccttccttcaaagatctgctgttctaggccgggcacagtggctcacacctgtaatcccactactttgggaggtcgaggcgggaggatcacctgaggtcaggtgtttgagaccagtttggccaacatggtggaaccctgtctctactaaaaatacaaaattagccgggcgtggtggcacatgcctgtaatcccagctactccggagtctgaagcagaagaatcacttcaacccgggaggcaggggttgcagtgaacccagatcgcaccattgcactccagccagggcaaaaagagcgcaactccactca

SEQ ID NO: 199765 - DNA, 681 bp, Homo sapiens
tgtcaaacactgccattctggctccatctatctcatctgccttggattggaaccagactcccttggggagcaacactgtgtttttaggtagcatattggaaaccacagagaacagtttatttatgttaatttgtgggggaacattttaaagtagtaattttctgtgacctccacaatgtacagccagccaatttgatacatttcacagtaatttggctatatcataacctgtgttattttgttttcaattttatcttaaatgtttttttccctgtgacaaattgaattatgataatcttgcagtatttctaccttgcttctttgtgtttttcaatatttctcgtgcctttttccttttaactttggcattaaaaaaatcacgtacataaataagtttacatgctttaatgatgttttcatatagaacactgaattttctagacaaaaagtgctgagaatagcagtgttcatttatagttatgtttatgccatatttttaaaaagtatattctcagtgaataaaactgatgttcatgtcattgttctgtttgggggagttgattttttttacatgttcagatttcttagatcattccaaatctttgtggatttctaatttttgctatttggagaacttcaaaatgtttattgacttgtagttgttacggtaatagttatctg

SEQ ID NO: 199766 - DNA, 355 bp, Homo sapiens
acacaagggaggaaaatgaggttaggccataagcagatcctaactctccctcctccccacaaatcaaactcttctagatatggcatttgtattccactaaagacacacctctattagcctagagaaagaccataggaggagcaggaattagaaggcatctagagatctgatcccctagaattacagggaagctttgcaaagctcgctacggaactaccatagctactgattatgcttctccatcgtacatcactccacaggttaagtcacctgactgaggtgacacaggcccctctagggcaggatccttccataccctcccctccacccccagtccctttccacttgaatattt

SEQ ID NO: 199767 - DNA, 881 bp, Homo sapiens
agagagagagacctgctcacgccatttaaaggagattgccccctattctcttatctctgccctgcctctgttttctttatagtctgtattacaaagacttgcacatatttatttgggcttttgggttttgactgtccctcttgagaaactctgaggacagagaccatatctatcatttgctgttttatcctcagtgcctaggatagtgcttcatacagagcaggtatttattagattggtgcaacgttgcagctttggccattacttctaatgtcaaaaaccagaattttgcaccaacccaatatttgttaaatgaatgaataattaattcatttgtatttctcctgtctacccacaaaagtcatgaaacccttattgcttgtccttctaaaatctagattgcttcacatatttccacaatctcccacttattctatgaaaaaaaaagattaacctgacatgaattattcttggtgaacccatgctggttcctggagattacactttctcccctaaatactcacaggccctacctttaataatccattgcagaatgctgcccaggatgatgtcaagttcatcagtctgcaggttgtggaaccacctgactccccttatttaaagataagaatcacctctctctggtcttccagcctgcctttcatttgcctcagcacctctgatgacaacctgcagagactttatttggagactcttagttctctggaagaaactaatccaggccaggatattgtaacatacttatagtaactgtgtttttttctagaatcccttcacccattcagaccgttgattccttcttgccagcttttgttctgccttttcccagaaaaagtagaagtgtaataggaattggatag

SEQ ID NO: 199768 - DNA, 501 bp, Homo sapiens
  misc_feature (488)..(488): n is a, c, g, or t
  misc_feature (493)..(494): n is a, c, g, or t
ccattttaccctctttgtggcagggaaagacgtttgctccatttgactgatgggaaaattatggccctagaataggacagaggtgacccaagactcattgttgaggtgtggtctggtgtaggtttggggatttttgccctgtttgaaggtttgaggttttcagagtgagcttccagaatcttttctcattggtaatcagggaggatctagggaagtgatttttcatctctgagtacatgttagagttacatagcggtcttttaaaaaaaatactgatgtccaggcatcctctcactaatgattcagttggcctgggttgcccagtcctctgtattgtaaaagctccctgggcgattccaatttttaaccagggttttttttttgttgttgttgttttgttttttgagacagtcttgtactccagcctgggcaacagagcaagaccctgtctcaaacacaacaacaacaaacataaaatgttactgcancaaannataccat

SEQ ID NO: 199769 - DNA, 698 bp, Homo sapiens
gcagccagtcctcatctctctaccttttccctaactccccaaccttaggcaaccactaatctactttttatctctagggatctaccttctggaaattccatataagttgaatcatgcaatatgtggccttttgtatctggcttctttcacttaggatcgttttcgagattcatccatgttgtagcatgtctaacaacttcattcccctttttttttttgacatggggtctcttgtctaggttgaagtgcagtggtgccatcatcgctcactacagcctcaacttcctggattcaagcagtcctcctgccttggcctcccagtagctgggactacaggcgcccgccaccacgcccagctaattttttgtatttttagtagagacggggtttcgccgtgttaaccaggatggtctccatctcctgacctcgtgatccgcccgcctatgcctcccaatgtgctgggactacaggcgtgagccaccacacccagccacacctggctaatttttagaaagtctgtagagataaggtcttgctttgttgtctgggctggtcttgaacttctggcttaagcagtcttcccacctcagcctctcaaagtgctgggattacaggtgtgagccaccatgcccaaccagaactttattcctttttattgccaaataataatctattgtatagacatatctcattatctt

SEQ ID NO: 199770 - DNA, 348 bp, Homo sapiens
tgagccaccgcgcccgacccacagagctgattttcacttggataatttttaagcctgtatccccagaatattatatacatatgtgagtaccaattttaaatgttaggcttcagtagtatttgctatataaatagaaaataaacatagaggcttcagtgtttgctcctcacaccccagggggcagtgtggcagaccccgtggggacgttcgcaccctgctctggaggttgctgctgtaggcagtgagtattcattgaaggacttttggcaggataatgactggagcacattcacgtttttaaaattccgtctggcagccatgtggaggacgagcaagggatggaggtgg

SEQ ID NO: 199771 - DNA, 461 bp, Homo sapiens
cagagacacaggattggtaagaggcagccccaggggagggccaagctgtgctctcttggcctggcctctgcttcagggctagagcctgatgtccacacagccacccctttccaccaaggaggctggggaggcagccggggactgtgaaaggcagaggggagttgggagcatgcagtgagcgattcactttgtgcaaagaaaggtctggctcttgcctggctcctggtagtctaagcccctagaatatcccgcctgataacagtgtctctgttccagcctgggcaacatggcgagaccctatctctacaaaaaataacaaaaataggtggcacgtgcccgcagtcccagccacttgggaggctaacgtgggaggctcacctgagtcccggaggttgaggctgcagtgagccacgattgtgccactgcgctccagcctgggtgagagagtgagactctgtctc

SEQ ID NO: 199772 - DNA, 303 bp, Homo sapiens
tgaaattgtaatttggttcctgtttttatgtgaacattaaagacaacattatttagtgaaacactaaaggacttaaagtcagaagccttgagtttgagccttgattactcattagctgtgtgaacttagacaagccatttagcctctctgagctgtaaaataatgatgatactacctataattatttttattgaccaaactacaatacaaaggtgacagaaaggctgtaaaacaatgtaattaaaacagtgtaattaagagagtgaactctcctttgaaattctggcctcatgacttgggcgt

SEQ ID NO: 199773 - DNA, 207 bp, Homo sapiens
tcactgaggaatgctgcattttcttaatcttttggtaatgttacattttttaaatgaagcagcttaatgttatctggctaaattatggtaatggctaatcctcgtaggaatatcattttgtttttttgttttttttttcagtaaaaatgagctatcaattttgattttgagttaatttaatttttggggggagggtggggggaggaa

SEQ ID NO: 199774 - DNA, 118 bp, Homo sapiens
aggctggtggtggccactgccacctctcggtgatgtcactcaagacaccacctctaggcatccccaggttgtggtgtcaaaatggtctgtctcagtgcttcttcctcattcctagaag

SEQ ID NO: 199775 - DNA, 493 bp, Homo sapiens
tccttgactgttccatttgttattgctttttaattttgtaaccgtattaaaaataattctacctagacccttatgcatggaggctaaatctatatgttacaaagacattcaagtgaaactctttaaaaagagtcctattgttttcatgtatgtggctccaaaaactatatatttggataccctgagtatagaggtttttaaaaaatatggaattgtttaacttcacataatagagcctaagactttagagatttcaaaagacttatttttcacagagttcttttcagatcttttatctctacaggtgttggggaacatacctatataaattattactctgaacttaaagctggagatgagtacagcactccaaggtcattagctatggacgatggtagtaaacaatgaatatttgcatcatgctttacagttcacaaggccttttcaggagcatgtatgtaatatggattcttaccacaacctgtgaagcagg

SEQ ID NO: 199776 - DNA, 319 bp, Homo sapiens
atctgtttttctcctgtgtgagtaaagcttcacaaagagattacatattaacccaagacatgtaagtgctccaaaaagaagccaaatccaggcacacagtgcctttacagaatgtgcctgatacttataatttactgatttaatctgaagtgaacataatacttagttgttttttttttttttttttttggatccccttccccctggggccctatactttctccactgcaccctatcaagtttgggccaaaacgcagagtctttcgcagcccttttctgtggccaaaacctttctcccttaaaacattccgtggttaac

SEQ ID NO: 199777 - DNA, 352 bp, Homo sapiens
gttaggcacagttccagtggcttttacgctgaagaattcagaacattctctcagaaaatgaggccttttgtcatctaacccaaagaaaattaagcgggtggatggctagaaagagttcatctccaggggggaccctgaaatcctttatattcttcccggttttctagggaaccatcccctacatagatgccccaggcatctggggcttttctggcagctgaagctgccttcagaaggccagggttattttccagttctggggaaggtaagttctagttccacctaagtcaaagcccagccctttccttctccccacccttccccactccagccatctctaaaagcaaaaaaa

SEQ ID NO: 199778 - DNA, 468 bp, Homo sapiens
aaggaggttgtataggcaaatgggagtaattatctctgatcttgatttttgtaggaaataggcgtagattaaggcatagataaatttgaaaaggcatagatacattaattaattaattagagatgaggtttcactctgtcgccctgtctgaagtgcaatggcgtgatcaaggttcattgcagctttgacctcctgggctcaagtgattcccgcaccttagcctactgagtagctgggaccacaggcaggcaccaccattcccagctaatttataaattttttttgtagaaacagggtctcactgtgttgcccaggctggtcttgaacacctgggctcaagggatcctcctgctttggcctcccaaagcactgattggcaggcatgagctgctgcgcccaaccaggcatagataaatttaaagacaccttttactgtagacaatttggaaaatagagaaaaccagaggg

SEQ ID NO: 199779 - DNA, 501 bp, Homo sapiens
ccggtagcacttcctgtacaatcttccttacacacacaaaacaaaacgaaacaaaagttttccccttggccttcaaatctatttcccatctctactaaaaatacaaaaattagctgggcgtgttggcacgcgcctgtaatcccagctagttgggaggctgaagcaggagaatcgcttgaacctgggagtcggaggttgcagtgagccaagatcgcaccactgcattccagcctgggcgacaaagcgagactccatctcaaaaacaaaacaaaacgaaacgaaaaaccttattctggggtgggaggtttgagtgagagatggagaaaatgaaaaatcgttagggtaaggtaagcacacaaagatacacacacaccatgcaacttagagttacaatgaacctgccaaacaaaaattcgaaaatacagaagaaaaactaaacctaaaataaccaagtcaacaccttcatcagagggaaaagagaatgttttctgtgtactgata

SEQ ID NO: 199780 - DNA, 540 bp, Homo sapiens
ttaatgtgtacaatgtaatgatttgatatgtgtatacgttgtgaaataaaatatagtcaagttgatgaacacatctattaccttacatggataaccttttttttttatagtaagtatacttaaggtctactgttgtggcaaattttaagcatatgttacagtattacttactataaacaatgctatctggctaatctaatgctaatgtacattagatttctcagacttgctcaatttgtaactaaatttgtattctttgaacaacatctcatattcccaccctcaggcactaacaaccacccttctactctctgcttctatgagtttacatttttagattccccatctaattgagaacatacagtttgtctttctgtgtttgccttatttcatttagcataatgtcctccaggtgtatccatgttgtaaatggctagatttccttctcttatggctgaatagtattcttctctgtgtgtgtgtatgtacacacacacacaccatattttgtctgttgtaaacaatactacaacgaacatg

SEQ ID NO: 199781 - DNA, 352 bp, Homo sapiens
ggctgtcagaaaacttctggtaaaataggatgctgaatcagacatttatttttaatggcaattgctgaaacatagactagcccacccagatgaaaatatgccatatcacttgactttatggataaaatgtgctgaagtagtctttgtcattttccatttgagatttctgttttagttttcttaatataccctgattcccatcgcttctgttttagcaacttgtttgttgtctgaaaactattatactatactttccattttaatagatacatcttcatttttatttctattatttgtcaagaatcatctagcacagagtagttgtatcaaagttataggcatgtactccaaa

SEQ ID NO: 199782 - DNA, 256 bp, Homo sapiens
gaaagtgaatggaagggaaaggtaagtagcagtggctgaggctcgagttctggatgtgcgcagcaggagaagtgaatgaggaaattgaagaaagtaaaagaaagatgaaggatgtctgcatgcaatgggattgttagaggcatttaaaacaaatatctagacattcaaaaagatgtgccaataactagcctagattatctcctatgaaatgagatgttgaaggtgctactagggctaccttagtcttagagagtgg

SEQ ID NO: 199783 - DNA, 531 bp, Homo sapiens
ttaattgacttacagttccacatggctggggaggcctcacaatcaaggttgaaggccaatgtgaagcaaagtcacgtcttaaatggcgggaggcaagagcgcttgtgcaggggaactcccatttataaagccatcagatctcatgagacttattcactaccatgagaaaagtatgtgggaaactgctcccctgatccaattgtctgcacctggccccacccttgacactagaggattattacaattaaaggtgagatttgagtggggacagagccaaaccatatcagggatattgacctttaattttcttttcttgtagtgtctttatctgactttggtattatggtaatgctggtctcataaaatgagtttggactcaaataacccttcaatttttggaaagaattcaggaaggattgatatctttttatgtttggtagaattcaccagtgacaccatctggtcctgaacttttctttgttggcaggttttgattactgattcaagctctttactcttagtttcattgat

SEQ ID NO: 199784 - DNA, 272 bp, Homo sapiens
cccttatctgtacagattgagtgtcccttatatgaaatttcagattttctagagttttggaatatttttgcatacataatgagatatcttgaggatggaactcaagtttaaacacaaaatttatttgttttatatacaccttatacatatagccagaagatagttttatgtaattttttaatacttttgtgtatgcagccaagttttgactgctttttgactgtgactcatcacatgaggtcaagtgtggagttttccactttgtggtgtca

SEQ ID NO: 199785 - DNA, 259 bp, Homo sapiens
gcgatggtagtggcgatggtagtggtgatgacagtgatgataatggtgatgatggtggtgatgatgtgatggtggtgatgatggtgatggtgatgatggtggcagtgatggtggtgatggcaatggtagtggcaatggtggtgatgatggtgatgataatggtgatgatggtggtgatgatgatgtgatggtggtgatgatggtgatggtgatgatggtggcagtgatggtggtgatggcaatggtagtggcgatggtg

SEQ ID NO: 199786 - DNA, 775 bp, Homo sapiens
cacagatgacgaccagacgcctctggctcctgccctggagggattgtgggctgcaggggatgcccaccaagccctgtggcacctggctttgtctggaccctgctcggggctcctggcgctctccattaaagcctcagccctgggcaaaggctgcagaatcttggaaaatcctcttttccaatctgatttgaatcacacctgatattcactccgcattcatcccaaatgtgtgagtgtatgtgaagtagaacacgggctaggggtgtaaattctttgccttattaatatccatgccagatgtttccagactgtgttccttgcaactggaatgtcacttgaaatttaaatagatgtttttaaataaaagattatctggtcaaatttaagaaatactacatagcctcctcttagagatgcactacacacttaagtatattaaaatacctgagaagtctagcagattcttcagttgcatttgttttcttcaaacttatttggccatttgacattttgaatcacttcttttttatcttatatcttgtaggacactgtctcaagtgtacaatttaggaaaatattgttctatgcacctctgctccctacctcatatctagaagggacaagatcagattgcagatgtgagtttgagtcctgtctctgcctcacgccagctgtgagaccttgcaggaatctctgagcctcagtttccccatctataacaaggatacaaccaaaccaaccagtcctcaatttgcaagtgctacctgttgccagt

SEQ ID NO: 199787 - DNA, 364 bp, Homo sapiens
ggaggcttcacattgatgaaaccaaagtctccacaaccccttaactgacacattcctttctattggctccaggtctttagataataactctgccaactaattgccaatgagaaaatctttgaatctgcctgtgacctggaagcacccctcccccaacctcacgacattatttcagttgtcccacctttccagactgaaccaatgtacatcttacacgtattcattgatgttttgtctccctaaaatgtcaaaaaccaaactgtgacccaaccaccttgggaatgttctcagaatcccctggggctgtgtcctaggccattggtcactcatatgtggatcagaataaatctcttcaaatatttca

SEQ ID NO: 199788 - DNA, 289 bp, Homo sapiens
tttaatcagtgccctttcctcagagtacatgagacagtcggagctggccagctggccttctgacactccatgacacagagggaaccccatccaactccgcttttcatccatctatttttgaatccttttaacactttatgagagagaaagaacagaacaggcaggcaggctgtgtttaaccccacaacaccaccatagagcctaaaagcttgggagtaaatacaatttctttggcaccttgtaataaaacatgaacaatgagtttctcaccatgttattagtctctgga

SEQ ID NO: 199789 - DNA, 561 bp, Homo sapiens
ttcaaaatggccagtttaagccgctgcagtcttgcacatgcaaatctttgctgtgcaaatcttaaacaagctgatctctctggatcagtgcttgactgtgcaaatcttcagggagtcaagacactctgttctaatgtagaaggagcatccctgaaactgtgtaattttgaggatccttccggtcttaaagccaatttagaaggtgctaacctgaaaggtgtggatatggaaggaagtcagataacaggaattaacctgagagtgactaccttaaaaaatgcaaagttgaagaactgtaacctcagaggagcaactctggcaggaactgatttagagaattgtgatctgtctgggtgtgatcttcaagaagccaacctgagagggtccaacatgaagggagctagatttgaagagatgctaacaccactacacatgtcacaaagtgttagatgagaattttaggggctggaggaacatgtacaagatgaaaatgttttccttatcacttttctttctccacccgctcagttgtctagaagaaataacactgtaaggaagtta

SEQ ID NO: 199790 - DNA, 906 bp, Homo sapiens
gtatgtgtatacaatttttgatagatggtattttgttatttcatatctgtgttgaaaacagtcttttagtttgtcagacatctttttcagtacctgctatgtgcaggcaggtattgagaaaggtctgagaatactgagggttaataagagatggtatattctccagagaaataaataccactaaagtataagagcagatgtcctttttggaagaatgcctgtggtgatggaataagaaaagccatatagaggggtgaggaaaagcttttcttaccaagtgtgtgagctgagttttggaggatgattaggcaagagttagttggcctggtggagaaacaggagccagacattcagctggaggaacaggagtgtggaacagtgtgggtaacacaatggggtgtgtctggtttcagaattataagaaatagtctttagggggaacagaaatgaaggagactaaatagatgatgataaattatctgtgaatatgtactggttcctacatattcaaagtgtgctaagtttgtacagccattacttgtaaggttctaggagttgtctctctaggggttggtttgtaccatagtccattatgtacatctagaacaattctttctttcccggaactgagcccaaggtgggctttctacagtgcacctctggctctggggcagctcaagcaatcagaaagaactgaggcactggtagaaaacaactctgaggatgaacaggataatgttcctgaagtggaatgtggtatcccttcatggttaaatggttgcatacttcagggtcacctatggaaaggtgtcctcagggtagctaaaagtggttaatttccttgtgttttgacttacagatcatttctaggtggacttggggaaaataaagttacttataaaaata

SEQ ID NO: 199791 - DNA, 364 bp, Homo sapiens
tacctattaccaagtcctcactgggtctagactaggaatatgagagtaggggcttgtggtggtaggtaggaaaatggaaactgaggaagctaatctacttcctctttctagtcaagatcatgtattttttttttttcttttcagacgctaactctttcctgaactgtcagccagaaggtagtgtttgctagttaagcacgggttttctatttcactgtatcattttctttgtggctctctaggtacttaacaatgaatcaggcacatagtagatgctcagtaaataatcattaattcatcagccacctgggaagggagtgcaacagggacacttctaaaatacctgaagtaagagccaaggtga

SEQ ID NO: 199792 - DNA, 581 bp, Homo sapiens
  misc_feature (3)..(3): n is a, c, g, or t
  misc_feature (33)..(33): n is a, c, g, or t
  misc_feature (422)..(422): n is a, c, g, or t
  misc_feature (455)..(455): n is a, c, g, or t
  misc_feature (478)..(478): n is a, c, g, or t
  misc_feature (487)..(487): n is a, c, g, or t
  misc_feature (489)..(489): n is a, c, g, or t
  misc_feature (503)..(503): n is a, c, g, or t
ggnccgctctagagtatcccctgcacacgccgngccaccatacctggccacagggtacttcttgccttgtagaatgagtttggaagtattccctcttcaattttttagaataatttgagtagaatttatattaattcttcttcaaatatttggtagaattcagcagtaaaaccatcaggtcctatgcttttctttaaagagatacgtttaatttctgctttcatctcattactcatagttggcctgtttaagttttctgtttctttatgattcaattttggtaagttgtatgtgtcaaataatttatctttttagcttgccaatatgctggagcgtagttttccataatagcctctaatgatccgtgagccaccatgcctggccacggggtacttcttgccttgtagaatgagtttggaagnattccctcttcaattttttagaataatttgagnagaatttgtattaattcttcttnaaatatttngnagaattcagcagtnaaaccatcaggtcctatgcttttttttaaagagaaacgtttaatttctgctttcatctcattacctcataggtggcct

SEQ ID NO: 199793 - DNA, 147 bp, Homo sapiens
atttatcaagcaaaataagacataggcaagttgctggaatctcaacaaatatctcttaaaggggctgggaaaaattatccttcagggggttgtagtaaggataaaataaaataagtcacttgcttaacaaagtatctgtcacttata

SEQ ID NO: 199794 - DNA, 124 bp, Homo sapiens
tcagcctcccaaagtgctaggattacaggcgtaagccaccacgctcagcctctctgcctttttaaatcaaaaactagttctattttaagaagcaatcaaagttttactctgatgagtttttgtt

SEQ ID NO: 199795 - DNA, 492 bp, Homo sapiens
aaaaaatggaataagaagtatcattatgacttaagtcactacttgtaatgttttctattatatgcaacctaacagttcttatgtgttacacaaactaacctgatacatccagagctaggtttataatctatcagccctgaggcaaatcccatttcttatagtcagtagcctacagagagtcaccgggcctggggaatgtaattctttggctgccaggtcttctgggagcagagaacattcattcatgtgctgctagatgaaaaaaatatatattcttaagattgtggcaattaacccatggcacaaaaatggggaaaaggtgaatggagagaggcataagatttgaaactgtttcttgtattttcttattctctaattaaactattctgagggatgacagaacaagtggtttcctatgagtgagctcataaagtgaagtttgctgctgaaactcattggcatccaaaggcatttttttggtatctaatactg

SEQ ID NO: 199796 - DNA, 445 bp, Homo sapiens
cagaacttatgtgttccaggtactgcactaagcacattaaaattagtttgagcattttattttgaagaacagccatatatgaagacccttgggataaatgtttaagcaaatatgcaagataaaagttctttgtatatagtatctatttttctaactagaatttaaaaatgtaaataaaatcttgaagagaatacatgttttactctgtgattatgtagttattttagttgattttatttcttctatatattacctttaactttttataatgaaaataaatgaaaattaaagctgaagttttttttaataagactcgtatttttacattttaaaacatgaagcacacttacaaatatatgcttttgaaaaagataataaacaggacaagatggagaaccagcataggccattaactctctttcaaacactgctagagaatatttaa

SEQ ID NO: 199797 - DNA, 424 bp, Homo sapiens
gattgaatgggtttgacagcagattaggtacagtgggtgagagaattagtgaatggaaaacaactctgtccatgataaagagcagagaggtaaacaaatggaaaatacaaaatagactataggctctagagactatagtagtgataaggtctaatatatgtttcattaagaatctcagaagaagaggagaaagtgaatgggcagaagatacaagagcagagaatttgttaaatttgatgaaagacttcaatacctacctatttaagaaactcaaaaaaactccaaagaagataaaacaacaaaagacacattggagtacaaatgttgaaaaccagacaaggatctctaaggtgacggggacgagggcaatgggcagttactttcacagcagcgacaataagactgtcagcagctttcaggagga

SEQ ID NO: 199798 - DNA, 1922 bp, Homo sapiens
ctcacaggacgagtggggacttcttgatgaggctcagagactcctgtaccttgaagtgatgctggagaactttgcccttgtagcctcactgggttgtggccatggaacagaggatgaagagacaccttctgaccagaatgtttctgtaggagtgtcacagtcaaaggcaggttcatccacacagaagactcaatcctgtgagatgtgtgtcccagtcctgaaagatattttgcatctagctgatctccctgggcagaaaccatacttggttggagaatgtacaaaccatcaccagcaccagaagcatcacagtgcaaagaaatccttgaagagggacatggacagagcctcatatgtgaagtgctgcctattctgtatgtcattgaagccctttcgcaaatgggaggttggaaaggaccttccagccatgttgcggcttctgaggtccctggtctttcctggaggcaagaaacccggcacaattactgaatgtggggaggacattcgcagtcaaaaaagtcattacaagtcaggtgaatgtgggaaggcttccaggcacaaacacactcctgtttaccatccaagagtctacactggaaaaaagctttatgagtgtagcaaatgtgggaaagccttccgtggcaagtactcacttgttcagcaccagagagtccatactggagaaaggccttgggagtgcaatgaatgtggaaaattctttagccaaacctcccacctgaatgatcatcggagaatccacaccggagaaaggccttatgagtgcagcgaatgtggaaaattatttagacaaaactccagccttgttgaccaccagaaaatacacactggagcaaggccttatgagtgtagccagtgtgggaaatcctttagccaaaaagccacccttgttaaacaccaaagagttcacactggagaaaggccttataagtgtggtgaatgtgggaattcctttagtcaaagtgccattcttaatcaacaccgaagaattcacactggagcaaagccttatgagtgtggccagtgtgggaaatcctttagtcaaaaagctaccctcattaaacaccagagagttcacactggagaaaggccttataagtgtggtgactgtgggaaatcctttagtcaaagctccatccttattcaacaccggagaattcatactggagcaaggccttatgagtgtggccagtgtggaaagtcctttagccaaaagtctggtctcattcaacaccaagtggttcacactggagaaaggccttatgagtgcaacaaatgtgggaattcctttagccaatgctccagcctcatacatcaccaaaaatgtcataacacatagaggcctcatgaatgcagcaaatgtggaagcgccttcaactcaagatctatcatcatttagctcctgaaagtccacacttaagtagagccttagacctacagggaaagtgctgtctctgtagtattgtagcagtagagagcctttgtgagggagccatctgcctgaagttgaacctcattcttccttgtttctctggtagaaaccatctaccctctaccaccttgcacagtgggcactggtcactcctatgtgctaagacaaggcagacatctgtgtgttctcttaagtctttggaggaaatcttgagcagtctaagcctttagagaaaattcattcttttttctgactgatcacagcatacgtgtgacccagtttgggtcaggagggcccagccttggttctgctggacacttatgtgcaaggattcccttcatgtaaattcttggtctcacatgacacttggtcattcttccagcctccatgtcaccacgtggtgaatggctgcctcacattgctccagtttgtgcactaataaaagccttatatttgaatctaaaaaaaaaat

SEQ ID NO: 199799 - DNA, 1061 bp, Homo sapiens
aaacataaaaatagatcatccacacatattttaaatgagcattattctatccagaaagagaaatgggagctttgtaaactctgtgtgaacaaattgttttatattccttgtggttgcattccaatttacacttgcagatgtcttcacttaaaaccacatcgtgtgggtatcttctccctattgcaactgtcccagcttccaaagaaactggagcatcaaatctcgcctttgaagtcagctgcagtgtcatagtctcattctccattaattaactgagtgctcagttgatctcaatgtgctttctcctgccagctctgcaaggccttgccctctgcagctggttctgcacagaaccagagtctacaaaaaattaaaaatcaaagctaaggaggttttaactttgcctgatttttcttacctggaaaagaagcagacagcacaggctgctttatgttccacatgaaatggtaaaaatagtatgagctgtaaagcacacaaatgaagttttgaatcatggttacctgctagctcttacgttgaagaagttttgtaacgtcgagatcttcaacatccttttccataaaaggaaagaattccatttccataaattgttttgagaattaaatgagttaatgaacttgatagtgtcaaacattactcctaacatgtaatacatattcagtggaaattagtttctttctttctatttgttgagatatcttgagtaaaatttaatttcttctcatcctcacatttgtggcttttgaatatcagttaattacttttctaaagtatgaagtcagctgggtgcggtggctcacgcctataatcccagcactttgggaggccgaggcaggcggatcatgaggtcaagcgtctgagaccaggatggccaacatggcgaaaccccgtttctgctaaaaatacaaaaattagccaggcgcccagctactggcgaggctgaggcaggagaatcacttgaacctgggaggcggaggttgcagtgagttgagattgtgccattgcactccaacctgggccacaggagcaagactccatca

SEQ ID NO: 199800 - DNA, 479 bp, Homo sapiens
actttggaaagtagaacgacagctgtaggtttccagagctcccctaattgttgagtctcaaacaggcatttatatgataaaggaaaatgacttcagggtcattaaatcgttttgttttccactgagggcccagagaagtaaatgtaattaaagaatgtagcaccagattgatctaggcacgtcattcccctgttgaatctgggagtatttctcgtttgtttctggaactttggttcctgatttccatcaggtggttacttcaggtttatttcaggctaccgttgggagaccctgaaaccaaattcattcacagaaaatgagtttctgttctgtttataatttgcagttgtccagaatggattaacgcatctggaaacaggacaggtttctgtaattcaataatacaaatttgtactaggcatgtgtcataacattttcttgtgttgactcaccacatttgaaaccacatacctctgtag

SEQ ID NO: 199801 - DNA, 167 bp, Homo sapiens
gaggtacaggatactgttggggacatttaacagggagtgaacttagtctggggctcagagtaagctatcttccaagagagagatgatattagtgctgcaacctaaagtatgaatacaagtcagctggaatagagcagattcaggtagctgaaaaaatatattcaatg

SEQ ID NO: 199802 - DNA, 193 bp, Homo sapiens
gactctagaggttcccgtgcttacttgaaggcacgatggtctcgatttcttgacctcatgatctgcccacctcggcctcccaaagtgctgggattacaggcttgagcaccgcaccctgccatttagtatgtttaacgaaaggaaaagaaaggaaactgtaatcgagtagtagcctttagcaggcttttggagt

SEQ ID NO: 199803 - DNA, 347 bp, Homo sapiens
aaatagctttcctgtcccggcctgcgtggcgtgggcttgtgggtctttgagacccgaaaattgagagcattttcgcaccccaggggctgctcctggcggctctgcggccgtcaccatgccacagaacgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaacataaacagcgccatgctgagaaaatataaatgaaaaaaagactatcaaagatgcatgaaaagaaaaacaccaaacaaaaga

SEQ ID NO: 199804 - DNA, 507 bp, Homo sapiens
gcgtacagccatggaaagaatgacatcatctgagggaaatggaaaaggaagtgacaagggtctaagaacaagacctgtgaaaatccaacatttacacttcgaaggagtcagcaaaggagacagagaagaaacagttggagagttgcttcatgatcttaactaatctaggcttgtaacttttttgattcacctctttctagtagcccttcctgattggcctgaattaattctgattatatctttagcccttgaattcacatttctccctattacttgcctgtatggtgccttttactattttgagctattcctatacactgcttagccaagcataagttttcctgggttgctattggaaatagagttgatagaagtattcaagcctggagtttaggaaacagtttttgtaggagaaatgtgaaaacccctaggaaaaactgattgtctcccttctccacaatgtttctgctatcgatgaaatgtgacagtaaagtttagaagcagcca

SEQ ID NO: 199805 - DNA, 363 bp, Homo sapiens
ctcgtgaaagcagccttatttggaaaaaaaatctttgtaaatgtgtttaagttagtgatcttgagataaggtcatcctggataactggtggccctaaatccaatgacacctattcttttttctttttctttttcttttttctttctttttttttttttttttgggatgggggccttcgcagggggcttataaatttgggggccctttcaaaaaaccgacctccgggatctattatttttgggaggggtttttggggtcttattttcctaagggtcggctggaatttaggttttttatggcctcctgcgagcttggaatggtggtccccttcctttttcaggttttttaaatggggaggtgggg

SEQ ID NO: 199806 - DNA, 533 bp, Homo sapiens
ccactttggcctccagccgtctgacccgtccctgaatcgagcaggtcctgtcggagctcccaggagtgagcgagcttccactcacagggtcacagccaggtgtgcagcccccaggcctgggcggttctagggcatgattttttttaggctggaaatgagctctcacttgagatgcacccctcaaaatactgaacgtactgcttctgtgagaatttcccctccttgtgtctggtgtgattgacaacgggtgcagccagtggaagcaggaatgtcggggagcgcggggtgcagggggtgccctgtcacagtcagcggggagcgcctgtccctgctgcgtggtgtggggttcccgtggctggcatttgctgctgtgtggagtcctcaaacccagcgctcgccctgcctgcgttcagaggacagaggcaccaccgggaacccaccggatcctcactcaggctttggaaaggccgagtgatgttttgtgtttgtgaattccacacatactgtaggagtatcaagaacacgtaactgtt

SEQ ID NO: 199807 - DNA, 811 bp, Homo sapiens
caaacctatggagaaaaatcttaaacaaaaataaaagttccaattaatgttgattgcattcttacctcatatacttgttaatttaagggatatgtttaggttattatttagctatttctaattttactgtaaaattcttgtgaaatttttgtttaaaaaaaagtattatatagttcttatctttgccggggcacagagctaaggctatcatctctaaatctgattaatgtatgcaaacacacagaatgaaactagctcagaatatctcttttaatctccctctgaagtagagtgattttggtaaagttttcattatctgcggaaacattgtttaagccaaagctatacaatttccagctgagttgctctgaatttgaaactttaagttgacaatcttcgtgcttgttagcagcaggatcattaatatctcgtctcaatggcccagcccacacatatggatgaccactagcaagtgtaatgatctcaatatttatttctcattcagttgggtttccttgtatttgccacattagtgtttaccctgttcctaatggcaaaatattctgtcatctccttgccttttataaagtttaatatactttctcattttaatctgtccccacagatctctagtcatcactgtttttatttgaatgtctctcatccctctcaactcttttactgcccaatttctgtgattcctgaagacttcaacaatcaacactctctttttttgtttgttttgttttttttttttgagactccgtctcaaaaataaataaataaataaaatgaaatgatgtacactggg

SEQ ID NO: 199808 - DNA, 1307 bp, Homo sapiens
gtgagggtgggtgggaggctaggtttttggctaggagttctgaaataggctcaggccacttttttcagacttttaagtgtgtatgtaagtgtgggtatgtgtgtttttaagtgtgtgtgtttaaaaataatgttttatcttccctccctgttccttaccgttttcattttccaacagtctactagagaaaaacatggttggccttgagaacataaaggaagaggcatgtatttgacatggtatttttccctttctttatgttataattgagtagtagccctctaatttgtagtttgggcaagtacagccaacaccctgactcttaaccttattatgagaacttcctttttacccctttttttgttttgtgcaaaacagagatggggttgaggaaggagggttggcgagcaaggccagcttctgccctacagaattgggtgtgtcttttttttcaagtgaggctttgggaaagtgttcaaatgagagcagtcttaaggtctctaagagatggggaatgtgctatgtatatcctgcctgtgaaagcccaaaccatatgggagaagctagaggatactaaaaacaatgaaattgtgatttggaagtttagaacatgttttaaaaattacattataaatgtaagacatgctttttatgtgtatatccgaagggaaacagctacatcctcaagtttttgcagcctatatgacattgagattggagcttgtgaatttaacagtactggtgccatgagaatgagcaaagcctagccaatggatactattgtgtttagattgttcatctttggtagctttaggttcttgatcgaggttcttaagatttctaagtcctttataaaaataggtcaagagtcctgttgttatggaggcttgattatcccagatattaggagtgaacatttttaataaatctttcagaaaatcttggctagaaagaattctaagttagttgtctaaccactgaaaactacctagccagagatcatttaatgagatattctttgatcttcattgcattttttttgctctggaaaaggtggttcaatttgagtttgttttcatgatttgattgcagcttacttcatgccaaggattttttagggagaggtcgaattatttttcatttggaagtcatagggagacaggagttgtacttatgctgctacttgccaggaacaggttgggaagaaaattgtggctgttggaattgatgatgtactggcctaatatagaaaggaatttgtaggcaggagtaaacgttaactgacggtgggttagtgccctgcatct

SEQ ID NO: 199809 - DNA, 232 bp, Homo sapiens
ccttccccaggtgaaatgagaaaaggaggtggctgtggcagtgcagcctgcaagccccagatgacccatggacactcctaccagcaagatgcacggcacctcacagcacttggtactgccagtctttttacttttcgtcattctggtttgggtgtatgatcgtaaatttttactgaagttaatggagaaaatgacaagatgatagcaagtagtgacagacatcactgtaaac

SEQ ID NO: 199810 - DNA, 526 bp, Homo sapiens
gccaagggggataagtggaaagagatgaaaatatagctgctgttgcatggatgaccccattcactctgactccttcagcaagtttcatttttccttataattctcggaggaatgctttgcctaaccacctaccccaacatctaggatttacttttaagatggtcagttaatattgcttgaacataaacttttggccagagtaactggaaatttaagtttattaaacttttacatacttaactatggtctacagggtattttaaactctgccatttgggtttagatctgcttttttacccccacccccaaatgtgcagcagtgtgaaatgtatgagaactaattggataaagtaatttttttaagaccttggtatcttatttctgccagataatagagaacaaatataaaatattcccatgattaaacacaccagatacagcttgaatttttagaatattaaacaggagtgataatgaggaagaacttaggtccctaattacaaaaggtttacacacacacagacac

SEQ ID NO: 199811 - DNA, 374 bp, Homo sapiens
aaagtgctgggattacaggcgtgagccaccgcgcccggccgccaggcatccttctaagcactcgagaaatatcactgaaataaacaaaggctacttcccagtaagcactctttttaaagtaaaatatacagtatattagaagatagaacatgttatggtttttcaaatgtgcagggcatgggagtgggctgcaatgttaaatgtggtgcttactgagaagatgacacctgcaatgtgatctgaaaatgagaatctaggtatttggcatatttgggggcagaagagtcagcacagaagctctaaggtggagatgggagtgtgcctggaatggctttgaatcagcaggagacagggaagaaggaaggagctgaggt

SEQ ID NO: 199812 - DNA, 164 bp, Homo sapiens
tttatcagccaggtatgatcactttaagctcacctagtccagatcataaagacagcttaaacagatttgatcaaaaccatgaagaaatgggaactagcttgacaatcaaaagagatgagattgacatccattccatagactgaaaataacataactcctattac

SEQ ID NO: 199813 - DNA, 395 bp, Homo sapiens
ttagagaggaaggaaaatgtatgattcagaaagaacagcatacgcaaaggtccaaaagtaaataagagggcataaaacattaagaaaagagaaagtagccgagtatggtatcattttcaagtaatgagaaaagagaaagggagaatatggtataatggaaagaaattcaacctgaacaaagaataccaggtgtccagtctttgttctactgcttagtagtataacgttagggtaagtaattttgcctctatgagcctttatttcctaatgaaaaaaaaaatggggtgctaccatattccccctcaaagggatggctcaaagatcaatttttatctttttttcttaaaatgaagtctcactctggaaggctggagtgaagtggcacaatctcagct

SEQ ID NO: 199814 - DNA, 382 bp, Homo sapiens
aaataattccattaccttctttgcttccaactatgttattaaagtagacaatcttaagataattaaacaactttacaaattattcttctatatgatcttttgcctctaacctgctcactttacaagggaactgaagctcaagcaggcaaatgccttgtttaaagatatacagctagaaaggagcacagcccatgttatgtaaacaggacaatatctgatgcaagcagtacttctttacatgacagcagatgtcactataagcaaatacctgaattcacttaagctgtcaaatatcaagaactgatgcagggctgaaaacaggaacagtaagaccctaagagatgccacatcatcgctatcttgcacagtaagatagagatgt

SEQ ID NO: 199815 - DNA, 282 bp, Homo sapiens
caggatgaccagtaatggacccacaaagtctaaagacagtctacaaagctctgtaactatgctaaatgaaagcaggcttccctggaattttttcttttttgagaacagctataaaaatcccaaatatcactcagtatagaaccctatggcaaacaatggttacatttaattacaggcaaagccaagaaagaacgaaataaaaatgttcatttaatcaactacaaagacatctcctgatttcttatgtttatgttgctttacacagcaaacttaatattggtg

SEQ ID NO: 199816 - DNA, 501 bp, Homo sapiens
ggaagtccagtgagcaagtgaaacacagcagcccttctcaacctcattgtgaatacacatggggagcttgttaaaatatggattttgatccagtaggttgagaatgggccacaaaattatgcatttctaagttcttaggtgatgtctgatgctggtctgtggaccacactttgagtagctaggaaatacgatattcagagggtggcagcaggtatgaggatatcaaggcaaaaaattgttgtcagagagtaaaagtgtgatgggaatatttgtataggtagtgaaaattagtaacaggtgcaaggagcaggtgacattcagatggagagccacagtgtgctatgcctgcatgggatgctattgggggagctgatgtggtgtggaaagaacatagatattgaagccagatggctttcagtttgatgtctgggtcagctttttactggctatttgaccttgatcaatttagctaggctctctgggggagagtttacatattgg

SEQ ID NO: 199817 - DNA, 335 bp, Homo sapiens
atgaagacagagaagaatggttaccagaagctgggaagggtactggggggaacaagcgggggtgtgaggtttggtaatgggtataaaaaaatagaacaaatcaaacctagtatttgacagcacaagagggtgactctagtcaataataatttaattacacatttgaaaatcactaagagtatagttggatggttggtaacacaaagaataaatgcttgagggtatggatacctttttccatgatgtgattattacacattgcatacctgtaccaaaatatctcatgtaccacatatataatatatatactgtatatatatagcatatatatacta

SEQ ID NO: 199818 - DNA, 406 bp, Homo sapiens
actggctggggtgattccctgaataatccctttgcggtgagtgtgggcaggacctacggatatgatgagacagtcacttctatggttacagttaacctatctaagactccatctgagcagacttgagagagagattcttcttctgaccatgaagaagcaaatatctgtgctgggaaagaggcttgagcatgctgtgtggtaggggcattgctggagctgggagcgatccccagtggacagacagcaaaacagccatcttagtcagacagctgcaaggaaacaaactctgccaaaactctgaatgaacttggaagtggattctttccccagtgcctccagatgagaacacagtctggctgacacctcaatttcaattttgtgagaccctgagcaaagaaccctgcca

SEQ ID NO: 199819 - DNA, 823 bp, Homo sapiens
atattggtgctcagaaagttttggagcatttcagatttcagatttttgggttgggtaactcagcctgttgtcttgtgaggagagggtaggctgctaccatcattttatagataggtgaggaaacaggcatagatatgaggtcacacagccagcacgtggtgggctggggcttaaccaggcagcctggcaccgaagtccatgctcttagccacttccagagtctgcctcccatatcaacctcacagggttgttaagaggattgagtaagatgtaattccatgtgttcagtgcttagtattgtgccagcacacagtaggtgctaactgagtgattgtagttggtaatggggataagatcagtggcctttttgggccaagagatgggctggagttgggtcaacagtgactcctctgttcacaaagctggatgcgtcccacatctggttgggcatcttctctcccagggaagttagtgagattcttagttcagttgggggctgaggaagtgtctcacaattaaagaaggtctcattctggaaacctccctttaagcctgacatctctggctcctgccctccaaaggctcctgtttggcaggtggggtggggatcctctttgctctttgggagctccagctctcacaagtaagacccatgggtttgtagcagtagaaaaccatagagcagttgtgaagggggcccacgttagtcacagaataatttgttggctcattgagcaaatatttgagtgtccactgttaagtgttgggggtacagagatgaacagaataatgcacttgactgttgagcaagggaagacagatg

SEQ ID NO: 199820 - DNA, 448 bp, Homo sapiens
gtgattacttttagaaatcagaaaacctctgcaactccgaatggcattcagctcttgcatttggcgcatcatcgggctgagcggaccagctacaccaaggacattagccaagccacccagaggggtggctttgccacaccagttgtcaccttcccatagcaagtggaagagcgcccacagaactctgggagattgcaaaggtcacaatgtgcatatttaccagtgaatggccccgggtggggccacgtgggggtgttcaaagcaagccaaacgctgcaatcattctttacagacacttgagactgacttttttatgaattacttagtcgaaaccaaagaaactttttctgcacctacttctgcaacaaacaaaactgtcccattaaaatgaataaataaatccgtaaatcaatggaaatcaccaccaataagaaggaagcacgccaga

SEQ ID NO: 199821 - DNA, 453 bp, Homo sapiens
tattcatgcttttaaataatggctaattcagtaaatcaactttccaaggatcagtgatagccagcaataacttattttgacatacagagcccaaatgaacagtaaattatgacgaagttatgagaacattcacctcagaacctactttctctggattcctctcactgcatatttcttaccatttttctttttttcagttttttaatttttttatttttaagcactttcatgtctatcttcctatttttcgttctacttcctgttctgtctccctctgcctctctctttccccgtattgtctcacaccatgcaatagagaaaatgtcttttggtattgattttacttaatgtataaaatgtaaaatcttccttcttcaaatattagtagtttttcatttaaatatatgaattttcttccaagtaataaaatgatattctttggaaacaaattat

SEQ ID NO: 199822 - DNA, 506 bp, Homo sapiens
taagtgatgagaacaaaggttaaaaacttttatctgtatccttttcactagcgatgctcccattgttttgaagtgttaaacgttagctattaccacgcatctgcaagtgcagggtgtagaagattagcttgtttaaatcagccaaaaagttggtgatgcaccctgatgacccacatctgttcttctccttgagccaataatgtgcatgagtcagagaaaaacacactggttcagtcaacagcagctctttttcttcattttagaaatgactgggacttaagagctgggaatggcttaaaaatatgtatctagtcctttccctgcccaaaggcaagcatatggtacacagtattttcattatgaaccatatcctagaaaaaaaatttttacagcttcctcgaacacattcaagtgtctagattccacacattgtaatttatcagttctttcttttgccactttatctaaatttttactgctgacatcactctactttgtgctgaaga

SEQ ID NO: 199823 - DNA, 448 bp, Homo sapiens
atacagtcaccactaggcatatatggcttcttaaatataaatttataaaaataaaaattcacttcctcagtctcactaacaacatttcaaatgcctagtagccgcatgtagatagtagctactgcattagacagtgaagatatagaacatttccattgttacacaaagttctattgaacagctctgctttaaagaatgtgttatttgggggatttatattgtcttctatgttgcacaaaaatcacattggtctttatgcaacttgacaacttaagaaggttgcccctcacagaatgatgattttactctgggtggtgatcatataagatcacttaatgaactctgatctgtaacaccttaactgaccccaagctgaattttatagggtgtctgtcccccaaaatgattccccaaagaagtaataaaatttgtttgaatcagaccttga

SEQ ID NO: 199824 - DNA, 430 bp, Homo sapiens
cctgaccaacatggtggaaccccatctctactaaacatacaaaaattagccaggcatggtggcatgtgcctgtaatcccagctgctcaggagacttgagtcaggagaatcacttgaacccggaaggtggaggttgcagtgatccgagatcgcgccaccgcactccagcctgagcaacagagactgtctcaaaaaataataataataaaataaaatgtagtgtttaagagctcagactctgcagctggacatggatttaaatcctagtttaagctgtgatcataagcaagtcaattaattgctgtcagtctcagtgtcctcagctttaaaagggggatcatctgtagctcacaagtagctgtgggaatcctaggatatttctcagttgcaggaagagcctttttccacagcgcctaatgtttcttccacag

SEQ ID NO: 199825 - DNA, 288 bp, Homo sapiens
tgtcttgccaacattcagtagtttctttggatgatgattttcacttcattctgtggctttggttaattgccagagttctaaaatggttgatttgagttggtttgaccatcttttcattgttttagagggaaagtgagttcatcaaagtcctcgctctgccattccatctatctactattactcctgtctttgaaaaaaactttaaatcctcttcatctcacatgcctttgcagttatgacttcatttctcaattcccctaacagcaaaactcttcaaagagttttcct

SEQ ID NO: 199826 - DNA, 333 bp, Homo sapiens
ttgtaactaggagttaatagtctaggttcaatcttaaaaaaatgtcgttaatggtaattggtaaagcctcaaacagtcttcatcctaaatacacatacacacagacacacacactaacataaatcaattttgtgacttcctggcaaataaaactgagtttctattttttatccattaaattgatgaaacagccaggcatggaaatgcacctgtagctggaactacaggtgggcaccaccacacccggctcatttttttgtatttttagtagagatggggtttcaccatgttcaccaggatggtctggatctcctgacctcgtgatccgcctgc

SEQ ID NO: 199827 - DNA, 382 bp, Homo sapiens
tctctgcatctggttttgatctatattttcaaagaaacctgctccccaaacttgcacaatgattccttcacagatgctgagtcagcagagagctagtgcatatttatccagagattctgatgaaaagagggagaaagaaaaatctaaaagcagaaaaatacgaagtatatggaaattttgaggtttcctgctgagttagggagaaggggttggggaatccttgaataaatcatagtgcctcacacaatggcctgctttgtctagtaaaagcacttttggttgaggatcagaaatacaaaacagtttaataatagtgagtgttgtgaggagtttcaagaatcttcgagggcatttgacttaaatgagctcagtgatggagtat

SEQ ID NO: 199828 - DNA, 481 bp, Homo sapiens
taggtagcaaatcctaatgattaatatttaagaggaaagcaaaaaggaaataatgaatcataccaaaagtaaaaactatagtgaccagataaaaatcctcaccttgaaactacaaatctagaaaagatgatgataaaacgagtaattctctgtactgtccattcaattgacatgacatgtgacatgctatttcacagtgggtccttcctggcacccaactccattttgtctgtgactaggctatgatacaacaaacaaattcaatgaataattgaatgtgttaccagaaaaattccctagtcctcccaaatcatcttgacttactcatggaacttaaataacccatcagctgttttgttactaagcaaggaagaagctttatcttccacctatctcctaaacctgtttctgctccacaacacagtttaatttctattcctcacctctgctctcatacacctactttttattctgatgtaag

SEQ ID NO: 199829 - DNA, 536 bp, Homo sapiens
aagcggttctcctgcctcagcctctcgagtagctgggattactggtatgcaccaccatgcccagctaatttttgtatttttagtagagatggggtttcaccatgttggccaggctggtctcggactgctgacctcaggtaatcctcctgccttgacctcccaaagtgctgggattacaggtgtgagctaccacgcctggcctcgacccccttttatgctagcctcagctgaccatcctgctcactagtacactgtgggtcatagggggccaaaaacatgaggctggtaacattccatccctgttattcatagatgatatttaagttaatggttgtttttttattgaatacatttcaatgccaggtattagatggtattatccccatgttggagattaggaaactaaagtgcagagagtttgaataacatgcccgagactataaagcaagaattggaagcctgttctccctgtctctaaaggcttctacttttggtgttattggaaagaccaacttaatgatggggcacttgtttgc

SEQ ID NO: 199830 - DNA, 447 bp, Homo sapiens
actcttctggccattggagacacagaagtgaacaagcatatgtcatccctgtactcaggactggtgtctactgggaagatgagagggtaaactataaatgaacatagtaatatacaatcaggtaatattcagtgcaatgttgaaaaaaatagacagtgtatgggaagagggtgagagaaagctgcatcagatagggtggccaggaagttcttccaacagagacaagaatggagagaaggaatcgatgtgaaaacctgggggaactgtaatccagacagcaggacagcaaatgcaaaggacaatttcaacatcttgtagcaggataagctgcagacaaaacctctcagacactgagttgtagaaggaagggctttattcagccaggagcgtcggcaagctactgccttaaaatctgagctccccaagtgcacaatttctgtccctttt

SEQ ID NO: 199831 - DNA, 312 bp, Homo sapiens
cattttagtttcctgctgtgagaaagctccaaatgctttggaggctgaagaagctgccctgacaaagacaggaaagcgcgggcggggctgatgggtctttttcatctcccccctttgctgatgaagaggcagtgctgtaaaatgacgaaatcaagaaagcacaggactctggctcagaactgttggcaggcacaactgagaagctagaatctaatatcattgttttgctttatttatgacaagcaatattggttttccatttatggtagagatattaagtttccctttgaaataaatgtatttttgaagtta

SEQ ID NO: 199832 - DNA, 1005 bp, Homo sapiens
agcactcttcctaggagagggaggccaggccacagaagagcagataaactcagagagtacttagtgaaacccagggcagggctggcctcagtgtagaacaatgggaacagaacagctggaagctgagcacaggagttgaaatcctgcatccttaggcaaactgcttcatctctgcatcttcataccctcacctgtaaaacaagggtaccaacgccccagagttaaaaacttcacccatcatcctgccactctcagagctatcagttttcatttatggtttattctagttcttatcaaattcacaggcaagtttcaaagttgtaagcagggcttatgtcctgggctagtgtttttgtttttcactggtctgctacactctgaccaccgtgaccactttttcatcctatttcagtccaaatacatataccagctgtttgggtgaaggcagagttagacaaattcttcttctgtaattcaccatatgaatatgtgtaaaaccaaatatacaggtgtggctttttaaaaggcaagatagggcgcacacgtagtcgtaccatcacccttctgtttaccactgtcaccacatttccatattccctagttcagcaaaactgacaaaggggagtgaaggaggcaggccaggatattgcaacacaacacagctttgctttctacacaccaaagtgtcccaacacatgggttaagcaagagcaatctgtatcatcggaagttcctaaggttcacgattgacagcgatccagtcccaggtaagccctcttctctctgaccgttaccagggggcccgggagaatgcaaagaaaaggagactgtgggcaccctgcacccagagcatttgcacctcaaggaaacttcaccagccgatatcaaatagcgaacactgcctgtcatacttccatagctagggaaaggaattttcccttttgcagcttcctggctgccaaccaggaggctacccctttcattaagctgaaatgagagaaaaga

SEQ ID NO: 199833 - DNA, 509 bp, Homo sapiens
aggtttcgcttctgattaaagagcttgccacatacatcacatttatatttgtctgctaaatggattatctgatgtttccttaagagtgagctgtaattaaaggctttgccactctcattacattggaaagatttttctctcatgtgtacttcctgtttttgtgtgagtaatgaagaattccagaaattattcccatggttattagatatatgggttttgggcctacaagaaattctttgggctgttgaaaccaaggaagcatcgtggacagacttcacaacttgattatcaattttctcttcggtctgaaatatgtgcatttcaggcagatgcgaatgaaagcttgatccaagctgatctttaataggcttgtttctagcatgactttgatcatatcgttctgtaatacctgtcaactttttgatttttgtcatgggtgcttcatggccatttctttcatcttcttgccattgaaattcatagtcatgaatatctttatcaacatcctg

SEQ ID NO: 199834 - DNA, 270 bp, Homo sapiens
aacattaagaagaacgtggcaaatgggagcactgttcataacagccacaagggggagcagcccaagtgtccgtcacatgaaaggaaagacataatatggtctatacatataaggtcatattattttaccttaaaaaagaaggaaattccaacacatactacaatatggatagcctcaaagacattatgctgagataagtcacacacaaaagggcagacactgtgtgtctccacttatatgaggcctctagagtagtagaattcaaggaga

SEQ ID NO: 199835 - DNA, 736 bp, Homo sapiens
ctttcaaaataatttcaaccgacggtacaaccagatctttgcataaatcatagatcgaatgaacaagaaaattcaacagttgcagaaatgtcactaactgtggttcatctgatcgctggatggattttgtcctggatagctttctgagacttttctctgggttcagtgtcctcctttctctgggttacctgtcctcctttctctgggtgcgctctctgttctctgggtgcaccgtcatcttttgcagtcttgtcacactcagtatcaaagtgccttccttcaaggacatcaccactttcaatatttgcaatgactgtggcgaatttatgaacgaacatttgtatagccaatcctttggttgttcgagcacattatttaggtattgtatgagcacaggatctgtagttacaagcaaggtgagtctgtactctgcactccaatgaaggcttcaggtgggtatgtgctgtgctgatataaaatgctgttgataccaaatgggaagaactcagccaggattccacgctcctgccagggtgattctctgctcctgggagagctgcatcgcctcagccaggcccacagaccaaggcacatgggtttccacttggccgaccaagagcgcagccgctcccccggcccctcccgcagcagttccccaccacggcttcatagaacttagttcttctgcctcactgaactttgtaccctttgactagcatttcttcatttgccaccc

SEQ ID NO: 199836 - DNA, 452 bp, Homo sapiens
gttactgaactgattactcgatccaaacacagctctaaaaatctttaaaatgtggaaccagtaccggtgcggtggctcactcctgtaatcccagcactttggaggactgaggtggaagaaccgattaggccaaggagtttgacaccagcctgggcaacagtttttgacttctcgactagatccctaaagtccctttcaattataaaatgttttgttataataatgttacatgtaccagactttgaagaattaaacataaatggaattttaaaagcatcttaggttgggcgtggtgactcatgtctgtaatcccagcactttgcggggccgaggcaggcagatcacttgaagtgaggaattcgacactagctggccaacatggtgaaaccccgtctatactaaaaaatacaaaaatcagtcgggtttggtggtgcatgcctgtaatcccaggt

SEQ ID NO: 199837 - DNA, 689 bp, Homo sapiens
aaggtagctgtactgcgacttcagttcttacctctggacggtgaagtagccggacctgaacacaagcttggaactgtgacaattcacctcaaaatttgaacaatccatcaaatgagatactggccactttggcagccaccacagatatagagactattcatccttccataaacaaagcagtgaccaatatggggactgccagttcagcacatgtactgcattccactctcccagtcagctcagaaccatctacagccacatctccaatggttcctgcctccagcatgggggacgctcttgcttctatatcaatacctggttctgagaccacagacattgagggagagccaacatcctccctgactgctggacgaaaagagaacagcaccctccaggagatgaactcaactacagagtcaaacatcatcctctccaatgtgtctgtgggggctattactgaagccacaaaaatggaagtcccctcttttgatgcaacattcataccaactcctgctcagtcaacaaagttcccagatattttctcagtagccagcagtagactttcaaactctcctcccatgacaatatctacccacatgaccaccacccagacagggtcttctggagctacatcaaagattccacttgccttagacacatcaaccttggaaacctcagcagggactcca

SEQ ID NO: 199838 - DNA, 843 bp, Homo sapiens
ggcggtggctcccgcctgtaatcccagcactttgggaggccgaggtgggtggatcacaaggtcaggagttcgagatcagcctggccaacatagtgaaaccccgtctctactaaaaatacaaaaaattagccgggcgtggtggtgggcacctataatcccagctactcaggaggctgaggcaggagaatcgcttgcacccgggaggtggaggttgcagcgagctgagatcgcaccactgcactcaaggctgggcgacagcgcgagactccatctcaaaaaagagaaaagaaaattaatcactcagctaaataacaataaaggcctttaagttaggtaatgagtacaaaaaagatcatgaataagagttagatttaagagacacagaagctgacttgatgtatcacttgatgaccaaggctatgtcagcgcgattggaaatggtatggtaactgagagggtggtgatttgggactattaaaaagaacactttttgtttgtttgttttgggggtgtctgagggggtagtgattgggactattcaaaggaacattttttgtttgtttgttttgggggtgtctgaggaagtcctattttagacaagttgaatctgagctttgtggggcacatgtagaagaaaatgtctaacaagcacctggaactcagcaaagcctggagaatggacataagtggcaagaaagtagatgagatccccagagaagatatcaagccaacgagaagcctgctgctaaaactctatggaatgaatttaagaataaccacaggaaaagaaaccagaaaaagagacagaatgaatattcatagtaagaatatcagggcagacta

SEQ ID NO: 199839 - DNA, 516 bp, Homo sapiens
ggcggtggctcccgcctgtaatcccagcactttgggaggccgaggtgggtggatcacaaggtcaggagttcgagatcagcctggccaacatagtgaaaccccgtctctactaaaaatacaaaaaattagccgggcgtggtggtgggcacctataatcccagctactcaggaggctgaggcaggagaatcgcttgcacccgggaggtggaggttgcagcgagctgagatcgcaccactgcactcaaggctgggcgacagcgcgagactccatctcaaaaaagagaaaagaaaattaatcactcagctaaataacaataaaggcctttaagttaggtaatgagtacaaaaaagatcatgaataagagttagatttaagagacacagaagctgacttgatgtatcacttgatgaccaaggctatgtcagcgcgattccgattaaggatagagagattaaggatagagcgagaaaggatagagagattaaggatagagagattaaggatagcggatcgtc

SEQ ID NO: 199840 - DNA, 497 bp, Homo sapiens
tttgaggaactgccatactgttttccatagcagctgcaccatttgacattcccagcaacagtacaaaagggttccagtttttccacatcctcaccaacatgtgattttggggagggggggcaggggttacatcaaacccaattttgttttaaattttaacatttgattagggatagcattctccctgcgtatctctagagaaacaaattttggaaggctgggtgtggtggctcacacctgtaatcccagcactttgggaggctgaggtgggcggatcacgaggccacaaattcgagaccaacatggtgaaactctctactaaactctctaccaaaaatacaaaaattagccgggcgtggtggtcgtgtgcctataatcccagctactcaggaggctgaggcaggagaatcgcttgaaccagggaggcggaggttgcagtgagctgagatcaagccattgcactccagcctgggcgacagagcaagactctgtctcca

SEQ ID NO: 199841 - DNA, 492 bp, Homo sapiens
cagtcgtctcctctgtgtcacagaccctgtgcccacaatcccgcattccatgccgccagcttcgttctgaagactagtcccagaggagggctgcaaagtgtggccgcaggaaggaaggctcgtggccctgcgggcggatcttgggaagagcttgttcacactcacctagtcctggtgaggaaggaaaattgcaaatcacagaaagtgaactgttcgacccacgaagggatagatgaatcagtgcaagaaagctggacttctttttagagacgagacaccttgagttgttgaatctcagtaacgctgcaggttccggtgccagtgtcccgtttgttctgcctacctgtcaagcgcaggatgccagtttagaggagactgacattgcttatgagatcagatgtacaccatgcacccccggcaccctgatacatgtgcctttgtcctttttaaaaatctggttaataaaaatgcatacgttttcatgtctcattg

SEQ ID NO: 199842 - DNA, 1094 bp, Homo sapiens
ctagtctttctgaaagactagtaaataatcaaaatcaactagtacaatgttagcttacagtgtattcatagcacatggagactctttttcaaagctaggaatttaaagttgaaagaaagaaaaataatttctaatgcaccttttctgctcaacacaaacttattgcagcatcattgggaagcatcatagatattcatcagtagagcgtgtattaaattatggtgtatctgtgccatagaatagtgtgcagccactagaaagtgtggctgttcattatttcaaatggctgtactttatagtactgaaattccatgttagtactatatgagttctaagtggcataggtatatatatatgtttaacgcaaggttttagaaaagttaatataatgtgctactgtttgtgtgataaaggaggaatgtatatgcttgaatacctaagtgctgaatatctctgaaaggacacttgagaaatggataacattggttacctttagggaggttggcaaattttggggttcatgcccattttacagttttatttttcccccgtctttaccacatgcatgttttcacttttttaaaaaatgtttggctgcgccaggcatggtggcttaggcctcccaaagtgcggttctctttatttgtagacagaaagtaggaagttttgcctaaggagttggacattttcctaataaccaattcaaaaaggaaatttaaatgtagatacttattttaaagtatatgatgactcaggtcttagtggttagtgcctgtcaaggtataaaaattagccagtcagaatctgccaaatctggagcaatacggtgcctcacacccgtaatctcagcacttagagtggctgaggtgggcagataacttgaggccaggagtttgagaccagcctgggtaccaaggcaaaaccctgttactactagaaatacagaaattagttgggcgtggtggcacatgcctgtaatctcagctactcaggaggctgaggcgggagaatccactgaacctgggaggtggaggttgcagtgagcctcgcaccagtgattccagcctagacgacagggccagaccctgtctcaa

SEQ ID NO: 199843 - DNA, 380 bp, Homo sapiens
tttacagttttatttttcccccgtctttaccacatgcatgttttcacttttttaaaaaatgtttggctgcgccaggcatggtggcttaggcctgtaatcccagcactttgggaggccgaggtgggcggatcacctgaggatgggagttcgagaccagcctgaccaacgtggagaaacctcgtctctaccaaaaatacaaaaaaaattatccgggcatggtggcgcctgcctgtaatcccagttacttgggaggctgaggcaggagagtcgctcaaacccaggaggcagaggttgcggtgagccaagatcgtgccattgcactccagtctgcaacaagagcaaaactccatctcaaaaaaaaaaaaaaaaaatctggaacg

SEQ ID NO: 199844 - DNA, 192 bp, Homo sapiens
tttattccttctcctggagtgccatgtgggagtggatcagggattcccatcactctcacatctgtcttcaacgtgtttcaggaaaaatacactggaattcagatcagaatctatcttcacctcagaatctgtgttcgccctctcctccttcttccctccaatgcttccgaagcacaaaatggtttacttcct

SEQ ID NO: 199845 - DNA, 425 bp, Homo sapiens
tcatctaatctgataaacaaatttatctttcttcatagtgtctaggcgtcggctgttcctaggagctatcacctcatggtctttattgttaaatttatggtttctggctaattttatacctcctactgagaaaaaagcgggaatgtttttattatgcataatatcatcgctcttagaaatgtgttttttattgaaatggtataatcttcttgctactgcagttccctaataccatgcatttcagactggttacatcattactcatgaccctgtatcatgtgtcacaccacctgtgagtactgacttttaatgactctctcaaaggttgttactatgcttctttgttgaggatgactactaacacaagtcttaaccagagtatacaaaaaaatgtgaccaatcctttgtactatggtcacattaaa

SEQ ID NO: 199846 - DNA, 230 bp, Homo sapiens
atagcaggatctcttatttattggcaggactttctatgccctttactaaaagctctcattgggagaagccagcaccaaggacatattattactcaaactgggcaactaagggagagattagtctaggaagaatacacagacggaaaatggtgttgccccagaaacatttcttgttttttgttgttgttgttccagtttcccaccactgatagctgtctgctctgatttat

SEQ ID NO: 199847 - DNA, 360 bp, Homo sapiens
ccacactgcacattcccctgcagagttaagccactatactgcatttgactcaaggagtcccagtctcaaccccaaggaggcctgtgtgaaacagttaccgtcctagaaaccaaatctatttatttcatccctcttctgcttaactctgtcataggacatcactgccaaaataaaacacctggctcctccaatgacacacacacacacggacacacatacacacacacacacacacacacacacccttaccagcttccgaaaggagagtctcgctcttctccgtgaggtcacaacactttgtagacacctcaatgtcttcactgttgtcatctcttgccaaactgggaggtccccagagct

SEQ ID NO: 199848 - DNA, 518 bp, Homo sapiens
cgagtagctgggactacaggcatctgccaccacacccggctaattttttgtatttttagtagagatggggtttcaccatgttagccaggatggtctcaatatgctgacctcgtgatccgcccgccttggcctccgaaagtgctgggattacaggcatgagccaccacgcccagccagttatacctgactttcaatgtggctgaaattgtagctcaaatgcagatctgaaagcataatctgacaaaagcattcaaagactaccagacaatgctgcggggaactgagctgagaaatcacttggactacaaagatggtttgaggcagactagttttttaccatagttgctgattattttgatcattaacaggaaacatctcagctgtccattacttctaaatttaccttcagcataataagaatgaccctgatggtggtgagaagactgtcacaggaagaattaagacatcctgcagcctgggtcgacgcggccgcgaatttagtagtagtaggcggccgc

SEQ ID NO: 199849 - DNA, 278 bp, Homo sapiens
ctgcacttcagcctgggtgacacagcgagactgtctcagaagaaaaaagtttatttacaaaattaaaaataaataaaaataactgagaaaatcagaatacctctttgcatgaataatagtttcaattatataaacagacatggggggaaaaatggaaggaaatacacaaaaataactggaggtagaatctttggtgattttttttctcattttgttttctaaattgctataataaacaatattcctctaaaaacataaacattaaacactttaatata

SEQ ID NO: 199850 - DNA, 504 bp, Homo sapiens
cagatttgggggtccgccagataggatcctgtgaagagacctcaaaggtctttagtccaatctataaaacatttttatgttgattatatcatttccacaatcaaagatgaagaatatatacagaggtgtatttagtgaataaggttgatggtgcacctgcgctaggcagtgttttagttcgttgagacaccaaggagttgagacaatcctttctttacctcagagttttgtgtgtgtaagtcctgctgttgagaggtgtgtgtgttaaaatgtctgatttgggcaggtgagatctgggccctctgtaaggttaggtaacaggaggttggtgtccagcaaatattcagtgccccatcaacatcccagttcttgtccaccaatcttccaattctaggactgatgcggaggccctcagagcgacttcagaggagaagtagtatgctctgtggctatcttgttttggagtgtaatttgtaaatcctctgcaaacaaaacgttggaaac

SEQ ID NO: 199851 - DNA, 469 bp, Homo sapiens
tctggcacctgccccgcagctccccggagccccgcgctgcgggactgcaaggcagagcccctcggatcccggtaccacccactccagcccgccaccaacatttgcgcagtggggcaggaggagaaatggaggcctatatgccatgtgcccaaatatttaaaagttataaattcagctgccaaagtgtgttctattctcacactgccaattattcttgcaaagctttggcgttcatatgaccaaatgtcagcaaaacatcaaaagtgactgaatttaaccattatcacagaagtctcactgttctgatgatgggctggtgatatctggatgcctaatattctagagacaagcaattcataaatcatctttatgttttttccacaaatttatttttctctaatttagcaaaatcccttaatgtagtgttgcaatcaagattatgctctaatgccaaattggacaaccttcc

SEQ ID NO: 199852 - DNA, 709 bp, Homo sapiens
ccttaaagtcatctcaactcaaaatttactcagatgagattcaaggtaggcattcttaaactgtagtttgcatcctgctatgggacatgaaattattttttattggtagataaaataggagaaacttattaaaagatatcagagagctttccttgctgttcctgttctcagctgctcatgatctagggagtgagttagctataccatcacaagttcttatttgagtagaatttatcaagaaagaagacagaggtgggccttccaggaagaagcttcaatttgagcaaaggtatggagttcaaaatttaaaaatgataatgaaagaatatattttatattaatgggtatacaagtatcaatggcagggcataggccaaaatacgtgccatggaaagatgtttgtattttctactatggacaatgatgtagcatcaaaaacgtatactgagactgagggtgattggcagtctgttgataagggataggtagggtcaggtttaagatggcacaaccctagtccaggaccagatggattcacagctgaattctaccagaggtgcaaagaggagctggtaccattccttctgcaactattccaatcgacaggaaaagagggaatcctccctaactcattttctgaggccagcatcatcctgataccaaagccgggcagagacacaacagaaaaagagaattttagaccaatatc

SEQ ID NO: 199853 - DNA, 450 bp, Homo sapiens
attgggatcttctgtgaatgcagctctggcactgatgccctcaagaagttggctgagagctccctggctgccacgggaaccaggcgccttgtgagactaggtgtggggctcactggggtccccccttcagtgagtctttgcagagaagcaaaaagccgaggcccccaggcacatggaccagagcactctttaagcctgggagtcttgcacagatgggtaagagagaattccctggggacttctctgttccagacaatgatcccttctctaagacacaggataggaccctttccatgagatcagacttctaacttccctccctaggctttcttggcatcaaaggctgcagccagcctatcttaggcctggccaggtgattcatgcaccaccaccaaatgagcaagaatgttcctatgttagatgtaaaacagtgagtgtaacccacaacca

SEQ ID NO: 199854 - DNA, 731 bp, Homo sapiens
ttaccagatccatgatctctgctaattcctcatggtaagcaactcctcacgctacactctctcaatgtaatttactatgatggcttcagacaggacctccatgctgatgattcccaaatctatacttgtagtcttctgccctctagaagagaggacattataccagaggtgtgtttataactgcctaaggttatcctcacgttgttttcctactgacatttgaacatcaacatatctgaaaacaaactcccccaccactgccaaatcttatgcattatatttcagttactggttctagtgactgcagagtcgtgaacactgtaaccaagtttacaacatggttttaaagaagtctgtgctcaacagagttgaaatgacattaatgaaacaacataggaagacagacattatctcatccttatacctataaaccaagttcatagaacaaaagagaagtgtggtctgcttttcttcttatattcctttactatcattctcagcttacattccagcctgaaaatccctttcatatgaatcccatttttaagagtacaatagattacacacaaaaaagaaaaaatttatataattcaacacctatgcccaattgaaaaagaaattaattttttaaaaacctgttgtgtttataattagtaagtaatctgcaggtgaatactttgagactgtgtgaatcacaaaaaaatgcttaaataaatagctctctgtatgtg

SEQ ID NO: 199855 - DNA, 416 bp, Homo sapiens
ggatagcacagcccctcaatctgagtgctcagcagagtgcttgtgaaggcagcaccacagcaacagttgctcagagggaacggattcaggagccttgacttagcaatagagtccagggttttcagctcagtgtctttagcctgtctctgctggtcatgtcagttacgtactattccatccaggaggtgctatttacattgtagtacatacacagtcattgcctaatgagtcatacagagagaaaagtaagttataaattatgtcccccatttgctgcaactctcagtgttaagaatgattcagtgcagctataggagactacttccattggcatgccacctgcgtaaaatacacaattttgttaagatatacaataaaattattatgctaatagcaaatattttatgtagctcact

SEQ ID NO: 199856 - DNA, 322 bp, Homo sapiens
tctcatgttggtggtgacaattctacagcacagtcactttttagccctctgtccggacaccacaatttagtacatcttcagctaaatcagagctaaaatgaggcaagaaaacatgcagtctatgtgagcaggatttgaaagctttcactgcactgatgtttcaatgatactttttattctgttgtatggaagtactcctagttttgaaaaacagagattctatatttctttctcaagacaagcatgcatggtcatatagtagcaagcccacaaatgtttcttttgtaactgtaaagagtaacattttagatttttacttttc

SEQ ID NO: 199857 - DNA, 143 bp, Homo sapiens
ggtgtggtggtgcacgcctgtagtcctatctactcaggatctgaggcaggagaatcctagctactcaggagggtgacggaggttgcggcgcagagatcgcaccactgcactacagtctgggtgatacagcgagactccatctc

SEQ ID NO: 199858 - DNA, 603 bp, Homo sapiens
gcagaaggtcataatatctccaacttaatctagaaaagttcagcaaaaaatgtgtatataaatggagagagagaatgataatgcagatgtgttaaaatgctaacaactgatgaatctaggtgatggttatataggagtttattccactcttactgtctttatgtttgaaatatttttaaaatgaaaattttaaaaggttaggtgactctttcaagagacagggtgctgtcttatgagaaatattatgggcttatatattttcagtttgcacagaatttatgaggctatttgtagagacatatgtgtgttatggtgccatttatagcattgtgtcttaccaaaagcatccgtcttttcaagttaacttatcccaaccatttccaatgatcagagcaccttgttgttttttttttttttttttttttttttttttttaaactaggactatgactttaggggcctagacaagtgtttttgttaagtgaataagccatatgaaaataaaggctcctgagaagacaaagttactctatttttcatgtacaaaatgactttgatctaggaattttggtttaaactagttgtaagaatcacagtgaaggg

SEQ ID NO: 199859 - DNA, 228 bp, Homo sapiens
caccactctgatgatactgcagaaattagaagtcacaaaggaataaggtaaaaagaggactgtgagtattaatcagttcaaaagcatgagtcaacaaagtggttcttaactgggagattctgacctgtgctggagccaacatggctgcatttctaaaggttcctccagtaatcctgatgtatacagctggctggaaccaccaatattcaacaatcatttatagctatt

SEQ ID NO: 199860 - DNA, 304 bp, Homo sapiens
ctgttattacaggatggacagaaggttgattttgatggcaaaggactctgagcatttcaaaggaatttatggtttatcttgggttatatttgcagttgataacaattgactgaagtattttgttgctctttatttaatttttttaattgagccttaataatatgacattttgtggcgctttcattgtgtagagacttcatgggcagcattagaaagaatgaattgaagaacaacaaggaataaaggaaagaagaacaattagaatttaattacaacagtctgagtggaagattgatgagaaact

SEQ ID NO: 199861 - DNA, 433 bp, Homo sapiens
gggtcagggcgtccactcctcgccctgggaactggcctgctccctttccacagatgccgcggctacgctggggagctccggggcctgccggctcacatgcccgcttgctaggttaagagctgcctgccgggcacagtttctcacgcctgtaatccccagcactttgggaggctgaggcaggtggatcacctgaggtcaggagttcgagaccagcctggccaacacggtgaaactccgcctctactaaaaatacaaaattagccgggcgtggtggtgggcgcctgtaatcccagctactcgggaggctgaggcaggagaattgcttgaacctgggaggtggaggttggagtgagccgagatggcgccactgcactccagcctgggcgacagagggagactccgtctcaaaaaacaaaacaaaaacaaacaaaca

SEQ ID NO: 199862 - DNA, 380 bp, Homo sapiens
ggtcagagtaaactcagccagctgagaagatgatgttcccctaagtggaaaggcaatgtttcttcaaataaacaactttctttaactttatgaaatttagaatttagaaaagttacaaagtaaacatatggtattaaatgttagttaaaatccttattttaggtactcctttttattctttttttagagatggggtcttgttctgtcctgtcaaggagcaggtgtccctgagaacccaaacattccagagagtatctgagaacctacctgggaaaaaagtcccataacacacacagtaggcaaagagccagaaaattagtttaaaagcagcatagggatgggaggcagcacgggcctctaaagctgtcctgctgctgtcc

SEQ ID NO: 199863 - DNA, 267 bp, Homo sapiens
acaaagatgagaaggtctggaaggaggatttaggataagctgagaggatccatcttgtaagactatactttcctatgaaatgctgtttcctccttgttgcctggaaaactcatcctcaatcttctagacctacagttgggttattcttcttcagaaccttaatctcttcaaggtggtgcctctgctacaccctataaacccacctctggcacagcacatatcacaccatgttagaattgcttccattggcaactccttcctgatctt

SEQ ID NO: 199864 - DNA, 475 bp, Homo sapiens
acttattctggactggaagagaatgtcggtagacggataatgacttaaaagcgaaaacaattgaattctttgagctacagtgctgtgtcctgagagtgcagttattttccactgcagtaatgctttcaaaaacatttatctagcttctctcactttctcatttgctgtcattggtgtgaaaaatcgagttaccagaaggttcacccatgttccacaggtatgaatactgaacgttttatttagtgtctcattaacagctggcctgtggctcctccttctcggcttgactctgccctgtccagggaaatggggaatcacgcctaaggattagcagggtgcctattttcacttacagtgcttcattcctgtgttcatgttacctattccctttacaaaatactcatgtactgtttttatgtgccaggcactattctaactactttacaaaaacgttatcttattctgtttaactcct

SEQ ID NO: 199865 - DNA, 173 bp, Homo sapiens
cggtactggaggaatcaaccccatgcccgccagtcaccgggttgtttgaggtcatggataaatacagctgaagctcctctgccccgtacgtacggctagcacgagaaacttactgtagttttagttttaacattctccataggtgactttaaacttcatttcttgaaaatggg

SEQ ID NO: 199866 - DNA, 693 bp, Homo sapiens
ctgtaccgtctgttgtcatgaacagctggcatcatccttaggggctcttcatcaagacactattggcagtgtgcatccatactgctgcatgtgtctagagtccactgccatactccatcatgtggttgaatcttggaagaggtccccctgagtctgagctagttcgttcctcaatggtgtcttcacaaaaacacgggactttggacacaggcaaagcagaaatttcctacttgacctgtgtaacgctggtcataccacataacatctatgagctgtaatttctggatcttttaaatgagggacataaaaataacacatagggatattgaaagactaaatgagtaacctctctagtgcatagaagatggtaataaatgttaactttctctacacttgcttcccttcgatattttaagatttcatttccctttttaagactacctatactcatatttcttcttgcaaaataccaacttttacttttctccattttctgcatctttaagtttgatcatttatttcccttcatttcaaggtatgaaaacaataacaaccttttctttgatcgtcctaaattctttatatcacgtctgcattgattggtgttcactttttattctttttaaataaatgttttctattacccgttcataaatatttgaatgctcaaagccatctttggagagaaagaga

SEQ ID NO: 199867 - DNA, 379 bp, Homo sapiens
ttaatgcatgagctttggtcaaagaacttaagatcattagagtcctaatctcgtgtttctttcagcagtcctctaaacttgcagtgattcctagcatacacccatatgtactgaacaagcatacccattaaatatttcgaggagtctgtctgaaaaaactgcatacatactgtatgtatcatagcacagaatgaaagaagaaagaaaaattctcgttttaaaattccagtacactagagcagtttcatcacaatagaaattatttttttcataattagcttaaattcttctttggagatatgaaagaatcaaaaatatctatgccgtgcagttgtgaaaccacacttcttcatatctttggaagtaaatcctttgagac

SEQ ID NO: 199868 - DNA, 743 bp, Homo sapiens
tcattattgttggtctgaaagaggtcctggtactgtgaacaaaggtttatattctattattattcttatttggctgaaagagctcccaggacctggagcaaaggtttatattctatcattattatcattattactactgttattattattactgggctgaaagaggtcacagtaccctgaacaaaggtttatattctattgtcattattattattattgttattatttggctgaaagacgttccaggagatgaagcaaaggtttatattctatcattattatcattattactattattattattattactgggctgaaagaagtcacagtaccctgaacaaaggtttatattctattatcattaatattattattattatttggctgaaagacgttccaggacgtgaagcaaaggtttatattttatcattattatcattattcctattgttgttattattattgggctgaaagacgccccagtaccatgaacaaaggtttatattctattattattaatattattgttattatttaggtgaacaaaggtttctattctattatgatgatcatcatttggctgaaacaggtctagtacctggagtgaagttttgtactaagagccaaaattcccaaacccctaaccaagtgactcctggaaggagaaacaagaagctccctcccacgtctcctgctgtcagaattccatgggattcccaggtaaagaaccgtccacacagtag

SEQ ID NO: 199869 - DNA, 506 bp, Homo sapiens
aaatacctgtaattaattttctaggcccatagtctctactaaggaactctgaagatattaattataaacttatgtaggcacaaaaagacacttaagattcctccttaagtaggtagtttctggactgtcctctggtgctcttgatacctacgtctcttaggagacaggataattcccattatacagagtcacaaagggcctcaattttcaaaaaaaaatttgtcttgtacaatagcatttcaaagtctgacaattaggaatatcagaattttagcattgaacagcttgattttgtattgactattatactttaccaggaaaaattagaatttagagaatttatactttcgacatttttgaagccatgcatgctgtagttctgtccacaatttaatactgtactagggaaactttgtcttctagtttccttttaaaaaaatcattctaagagttttaagtttggacaaactaacaagtttacatttatcagacaaacagttatttga

SEQ ID NO: 199870 - DNA, 330 bp, Homo sapiens
gctttaacctgatgtccccattataataattcagaaggaaaggcctgctcatataatttcctacggcctcaggccagagacagccatacttacaggactggaggctgccaccactgacatgttccaccagattcttgttgggctcaagaagcattcaagcttcatcccccttcgtatttatgaaatccggaggtactggagcagcgctgtatgtccagcatctggcattgttcaatcaagatgttagctgggacagaagacataagtcagaacgctggaagaaactgggtcccaatattataataatcaataaagacaaaatatatttat

SEQ ID NO: 199871 - DNA, 219 bp, Homo sapiens
aatctcagtgttcttaaagttttgttgaaacacagccacatttatccatttaaagcaacgctggtgttttcacactacaacagcagagttgagtagcagagacagagactgcacagcccacaaagcctaaaccatttactatctggtcctttacagaaaatatccgtcaatccctgccttaaaggctggaacaggtcaaggtcatacataacagcattc

SEQ ID NO: 199872 - DNA, 594 bp, Homo sapiens
gttggaaggaccccttttggtttctttttgctcagagctttcttttaataaattccgctctcctcacctttcaatgtgtccgtatgcctaatttttcctggtcctgtgacaagaacctgattttagctgaactaaggagcgaaagatcctggatcattttggtgacccatactggtacatgaggaaaggggtccattccaactaagaaactatgggggaccaggcatggtggctcacgcctataatcccagcactttgggaggccaaggccggcagatcacgaggtcaggagatcgagaccatcctggccaacatgacgccacaatcaagaactcagaagggtagaagaaaaagatagtttcccttccctacacagggtccatgcattcagtggagtaatgattcctgtccatgaaaaaaaaaaaagaaagtagaaaatttcagagaagagaaaaattttccacttgggagcaagggcatgagggcagcggggaagtggtagatatactgacatgttaatatattaggtcttgtatttcttttgtacatagtctttcttctttgactgcctcgttcatgcatctccactacttg

SEQ ID NO: 199873 - DNA, 237 bp, Homo sapiens
gtccattctctgtgggtccagccttgtactctatcagttcattctttgtactgctgccagtgtaagcttagtaaaagataaatatcagcttgtctttctccaacttaatgtactagagcatcttcctgttgcccaatggactgagtccttccatgacacatactctgtctaccattttttgttgccacataatccctgtgctttttcccccaaacatcccagctatcccaaaccata

SEQ ID NO: 199874 - DNA, 213 bp, Homo sapiens
aaagtctaacatcaattctttcttgagtggtttttgctttctatgacctaagaaacctttacctactcctaagtgggaagagattctcttgttttcttctataggctttatggttttagttttatgtgtaggtctatgatccatcttgcataaaagtttgcctgtgatttgaggtagaggttggggttcattttgttttttcctaatggaagt

SEQ ID NO: 199875 - DNA, 394 bp, Homo sapiens
attcttggttcagatgcttggcgtttcacttcctgtccactgagacagtcctaagtcatgcatgccatagcataattcattaagagattctgcctgttaaatcccagttttggtgtccagttgctgcaacaatccccttcctctctgcatttagaaaacaaccctacagggctgggtgcgatggctcatgcctgtaatcccagcactttgggaggccaaggcgggagtatcatgaggtcaggagatcgagaccatcctggctaacacggtgaaaacctgtctctactaaaaataaaaaaaattagctgggcttggtggtgtgcgcctgcagtctcagctactcaggaggctgaggcaggagaatcgcttgaatccaggaggcggaagttgcagt

SEQ ID NO: 199876 - DNA, 487 bp, Homo sapiens
  misc_feature (403)..(403): n is a, c, g, or t
  misc_feature (408)..(408): n is a, c, g, or t
  misc_feature (418)..(418): n is a, c, g, or t
cctgataggtagcatttggttaggctatgaaggatatgcaggacttcaacaagaagagaggaggtttaggctagacagggaacactgtgggcagaaggaacaacctgaggtggaaggatgttttgagcatagcagataatttagaatgatttaactgtggtaatgattttttttttattttgaagaggcagagtcctgctctgttgcccaggctgctggagtgcagtggtcatagctcctgggctcaaaccatcctcctgtttcagtctcctgagtagctgggattataggtgcacatcacttacaccttgctaatttattaatttttcgcagagacaaagtctcactttgttgtccaggctggtcttgagctcctggctagacccaggtcaagattctgccnacgtnggaagctgtngctgcctggggaacaaagtcgtggaaagcctaagagcacagatccttctgaagttattaccatgctgcc

SEQ ID NO: 199877 - DNA, 259 bp, Homo sapiens
atattaatttatagaagacattgttttacacttacctgtttaatatgatctgtacttagtttttaaaaatattctgagcaaaaggtgatctcagtgcactgcagactccgcctcctgggttcaagcaattctgcctcagctattctggaggctgaggcagggagaatttcttgaacccgtgaggaggaagttgcagtgagccaagaccatgcccttgtactccagcttgggcaacagagtgagactatgtctcaaaaag

SEQ ID NO: 199878 - DNA, 215 bp, Homo sapiens
aatctgccccctactctacacaaggatgaaaccaagtttctcatcccaacagcccagactccatgacaacactaacccctctcctaaatggcctcaggttgaagtgaagaattccaacttaaaaagtgccaaatgtgaaagcatctctcccagaccacctcaacttccactgaagctaagaagagagaaggcagaagtgaatgatgctggatgag

SEQ ID NO: 199879 - DNA, 305 bp, Homo sapiens
  misc_feature (15)..(15): n is a, c, g, or t
atgcagtttcagtgnggtagataaaaaagttctggaggtggatggtggtgatggttacacaacaatctgactgtacttaatgccactgaagtgtacatttaaaaatggttaaaatggtacgttttatgttatgtgtattttggcacaatgaaaacagctataaaaggcattcttgaaacaactggggatatctgatattctggaattattattacttttcttaggtgtaataaaagtattgtggttatatacattatataaaaagaggataatgtccttattcttaggagatgctttctgaacta

SEQ ID NO: 199880 - DNA, 493 bp, Homo sapiens
taattaaaaaagcttcagctttaaatttagctttctgactctgggcttgtgccttcaacattttcacgacgacattctgctctttgaaaggaaagcatgcttggtcctgtcgtggatacatttagcagtcatggaaacaccattggtcgtgctgacactttttaaaattttagacaacctcacaagaacttgaggtctcacagcataaatcccttgaagtctgcctgggcacacgccacatgcagacattggtgctttccctaccttcttgatataaaggtaaacaataccagggtttgggacagcctagttttgttagatgctgtgttgtagaaaagcctatgatggtgcgtcaaacactggatcatgctgagtgcctctagatagcatctctggaagaggaaaaacagtctttgctttaaaatgcatttaataacgagagcaacaccaacttttattgagctcttaattctgtaccaggcattttaatctc

SEQ ID NO: 199881 - DNA, 788 bp, Homo sapiens
gtgtcccctcatgggtgctaccagagtccctccccagcctgagactcctgaagccccagactcagggattttctttccactaagctctgaacaagaagctgaagctcaaggaaggaggttctgggactcatctcagatcccatggccaggaagcggtggccactctggaattcttgaccctgcccagaccagcaccttccacagcagagaccccctccaaggagcgggcgacgtgtgacttccccatgggtggactctgggctgcagtgatcggctagcggtgccatctttagtctgggagctgtgtgaagcctgctccccaccttccccctcctgcaaatattgggggaggggcatggaggacaggaagatagaagcaaaagtggcagtgaccggtgcatgagagattgggagatacgtgctggggaggggttccccggagcagagctggctgcccttggcactgggcccaggcggaggagtggcaagaccaacagttcctggagcacaagtccctcagccggtgcccagtgccagccatcgccatgttctcatctgccagcagcaaaatgagaaaaataaggacaatatagtgaggttttactaaagctaggtttactcaatccaaaagactgtccttttatctgagcttgtattttcaatcgtgtgtgtgtctgtgtgtgtgtgtctgtgtctgtgtgtgtctgtgtgtgtgagcacaaaaggacctttccttggacatttccttttaatgacctcaaactcagcaaaataaaaaaactggtgac

SEQ ID NO: 199882 - DNA, 353 bp, Homo sapiens
cctgcatggaccactagaggctcccttgtcctttgcttttttttttggtttagccaatagggtgcccagacagaagatgagagggagggctgagagtgaggctggggatttattctgaatgcttgccctgcagcattgccttaggctgtcactattcctccccagaagctttctaggagactctccttctgtgttctggaaaactactccctaccctcttcccttcaggcttaaggacaggtaacagccctgccattactagctccagggcagagcatcatctctacaacctgccacatctttgcaaataatccctttattaaactttcctaagaaaatcccaatttaaaaaa

SEQ ID NO: 199883 - DNA, 343 bp, Homo sapiens
tttgggcttggagttgggccctgaatggcgctttgctgtgaatctccgcggggaggctcttccaaccaggggctgagcttctgcgctgtggagaagccaggtgagacactgaaataacagaggtttgggtgtgaaaatccacgcttctgcactcagcctggagtctgcgggagcccagagaagaggggagtggaggttaattccaatatgaccgcatcgaggacgctttccgaaagggatagcaccccaaatctcactctattgtaacttaatcttttaaattggaaggcctgtagctattggctcgaaaagatatattaattccctgatacagtaaatttga

SEQ ID NO: 199884 - DNA, 2253 bp, Homo sapiens
ctgtgagatactaaagataaaatatggatattgatacatctatgtttttctacataatgataataataatgaaaatgtttgccagttatgtaggtgaaaattaaacaaatcatagttcttaaagtacccattttccccacttcacatacctctagaaaagttaaatgtacagaaaaccaagtttagatagtaagaatatattatgaatgatctttgataatgtccatgatttataaatgctgttatttcccagatgttgtaaatctgagaatattaattaaattgatattcctcctctgctagaacctgaaaggattatgaaggggctaccatagctctaaagtaagaagagtggtataggcaggaacagctaggtagtatctgtcctagcactgacaggttcacaggttgtcctttaggaatagacccatgagctttttcaactattttccagatttctcagatctgaggtaatttccacagtaatttatattagctgtcacattgtgtcttattgctagaataaactttgcttggaatgctaatgtctaaaagtttttgcttcattaaaaggctgtgtaaccaaaacttggtattatactttcttcttagtatcttgaaatgtttgttaaggagttataattataccactctctactgagagtttgatcagtgctacaacacacatagccctgtacctacatagggattctcaatgaaactcagtgaggaagatacatcatcatcatcatccctactctatcgatgaagaaacctgatgagccttctagcaccaggtgtcacctagaaaggacagaggggcctggcctcccctcccacaatgtgccaagtggagtttgagctggcccacactgccctcaagcagctgaagggtactgtgtgcgatcaggagaaaactgctggtgtacagcttctgcaaacagcccacccagagcgactgcaacatccctgccccttcagcctcagatgtgaaagccaaggccaagtaggaggcatggaatgtgaacaaagggatgtctaagatggacaccatgaggatctatgttgccaaagtagaaaagctgaagaagaatgaggctggctaaggacacattagcaaacacaaggaaagcagcatggctcctctggtacagaatgctcttccttaaaaaccttgatggctgaaatgtcctgaaaccaaagcaagtttagctgagacatcaataaatcacttaaactgcatgagagtgactgtctgctgctggaaaagagaaacacagtgactgtgagtgctcgggaggtgtccaaatgtacaaactggttttttgtatggttttgagtggagttcccagctttcctattataagagttaggtaggcatttggcaggagtagaggggttagggggaaaatgtgctatggaaatgcccaagggctgaggtcagtgagaccattctccagtgacagcctcttgggaggctgaggctccaaccctttacctcttcagggttgattcactaataacccagcactataaggggaaagggactctgtcctccaaaaagctgaagtcaagtccaaaaggccccattggcacacaggccctaagaagttaatgtttttagggagaccaagtttttagtgataatgtggtgaaacaattgatgcagcacaatacagcagatgagaaacaatggagcacatagtgtcaaaataccagcctcagaaagacgcatctatggcctagcaaccaaaattttcttgaggttattctgcccctaactctggtttctgcttggggatgtttgtggaacaatatgcatatgtatgtatatgtgggatttgttacaagaacacaacatacccctcgacctatgcaagagccagagtgtctaagcccaacttctactcctcactgttagttatcgtggaggcatcattgcacaaccaatatgcctggtggctggagtatagactgctaaatggtattcagcgaagcaggtctatagtgacatgagatttcctggtacttcttccttaattaaaaattatattcatagatcatgacatcaggtcagttccagttcttgctgggaacaataatagaaacaacaaccgtaaagacttcagagaacagaccgggcgtggtggcttatgcctgtaatcctagcactttgggaggccaaggtggatggatcacgaggtcaggagattgagaccatcctggctaacatggtgaaaccccgtctctact

SEQ ID NO: 199885 - DNA, 544 bp, Homo sapiens
ggcggcactgcatctgcaggtcgagctagaagaccccctaggaactcgtaccagtccactgactcaaatgtcaatctcctctggcagtaccctcacagacacccctagaaataatactttaccagctatctaggcatccttcaatccaaccaagttgacacctaatattaaccatcacagattttttaaaagataagactcaagtcaccaacatcaaaaatgaaacaaagacgggggacgattgcttgagcccaggagttcgagaccaacctgggcaacatagcaaggcctgtctcttaaaaataaataaataaataaataaacaaaaattttaaaaaacctatctcaacagaatctaaagacaataaaaggataataagggaaaattatgaataactttactgttatgaattcaacaacttagcaaaactaatcaatttcttaaaaaaacacaaactgcccaatctcaggcaagataaaacagatcacctaaatagttctataactactaaagaaataattctgattttgtcattaaatatcc

SEQ ID NO: 199886 - DNA, 354 bp, Homo sapiens
gcatttcctaccttttgacatatatatatatatatatatttttttttttcaccttgaggatatcactattccaattgttcccatatgaatacaggtgtggtctctattgcatataaatgcatcttttattcaattttaggtgcaggacttggttttctgtcccaactgcacacaaatgtcccttttttattatttgtttattagttgtgtgtgttttcctttttgcataagaaatatgtccgtttagtccagaggctcttgctttatccagatgatggagggtacgggaaggcatccgcctcagttccctatgaaggacgtatttgctgaactaggacaagcccactcctcccc

SEQ ID NO: 199887 - DNA, 385 bp, Homo sapiens
atggcactcactgctcaggatctgagatcgacagctgattctgcacatgcaaagccctgctgccatttgtcatttcaggaactgctttatttttgtcaaaatggaaggaaaaaaaaggagagagacattatacagacatcagaattcaaatcatttgcaacctgatttgggtaatgaaggctcaaggcggagttgagatttagggactaaggtggttgtataagtatgtaacttcacaagaatctgttttagacccagagcagattaatagccagattacaatggcatttcctgggcttaggaatctcattatcctcttctttcatatttctttaaagtggaagacccttccactacggtggtgtcatttgaactcaagtgtcag

SEQ ID NO: 199888 - DNA, 724 bp, Homo sapiens
gaaaaatttgcagacttaatcacttaaacatcttacaatactttcaaaattaagaacattaaagtaatgcataattatctagtcttttaaccaaagaaaattagtttattaacattaattaagtctccaactgacactaaaagtaaattaagaatattattaaattgattttgcaagtggataaactgagacagagaaatatcaactgaatttcccagggttatattcaagtcagtagaaattggaacctgtggattttaattgatttttgtatggttctaatgattattaaagtatgtcttcttctaagtataacagttaatgacattagttacataaaaaatctttacaagatctctcttttgaaaaattatgtttcttctgattaactcttacaaaagatttaagaagagcaaaaattaatacatttctcatgcaaagtaacaaaaatagatattttaaaaattatttgcatacataaaataaaaatagtttgtgctgcaagaatagaaaatactgattggagcctgggcacggtgtctcatgcctgtaaacctagcactttgcgaggtcggggcagttggattgcctgagctcaggagtttgagatcggcctgggtaacacggtgaaaccctgtctctactaaaatacaaaaaattagccaggtgtggtggcagcacctgtagtctcagctactctggaggctgaggcaggagaattgct

SEQ ID NO: 199889 - DNA, 253 bp, Homo sapiens
ttagcactcaacaggatttcagtcactcactcattcaattaatttaacaaataatatgagccaggaactcttctaggtgttggagagacagcaaagaacaagacaggtatagtcactgctcttacaatgttaacatgaaggttcacgttcatgttaaagggattcaccaaatgactaaaaaagtgatgaagaacccttctctgtatataatgctctcaactttataaaatgaagggccaacccctattactac

SEQ ID NO: 199890 - DNA, 359 bp, Homo sapiens
attgccactggattttgagtaccctgcgggtggtgttgaggctggtccccaacagttctggggtcttggagaggggagaaaagtttatcacagagaaaaggaagaggagaaaagtggaaacaattagaatatgtgtatccatcacttatgaaatgttagtgaatcaataacaagaatacagtataaaatttggattcctgtgcctctaaaaacagtcgggagatgaaaagttacagaaaattatgttcattgctactctagtcacaataccaaagacatggaattagtccaggtgcccatcaatggtagattgggtaaagaaaatgtggtgcatatacaccatggaatactacacagcc

SEQ ID NO: 199891 - DNA, 734 bp, Homo sapiens
gaaaaagaaatgtcaccatacacattgtatttcctgaaatttaattttgtcttggtttgggtctcttctgagcaaccctcttggattattgacatactacctcacattgtattgaaatttaaaaggtcttaacaaggaaataccacatcttcgcaccctggcttaccaacctaaggaaagcagtttcctaaattcacctgggactagatgccctcgatgacactttctctggaagattttaaagcagcagaggacaaagaaacccctaaaggagccatattcattgtccaccttccctacctcacttaaaagtacctagcttaacatgcctggtagaattgcctggtagaaattagaaaatgtgtctatgaacagggagctgagcaggaaaagagtgctgaggcttcagggctcacccctaggaggctgttctaagcactgcgctgcagaggggagtggggccaggactggactggacctttgttacttgtagggtcctatcctgactttcccacagaaccttgtggctgaggagtatgtttgttgtttttatttttattttttgacaagatctgcactccagcccgggtgacagaacaagaccctgtctcaaaaaaaaaaagaacaaaataaaataaaagtaatcataagacaagagaatcccatcctgacttctgttttattgttcattggagaagattctttctataagtcaaggaaattttgctgtgaag

SEQ ID NO: 199892 - DNA, 201 bp, Homo sapiens
cttggtcgatgtggctgcagcttctgaggtctgccagagcctccaggagccttctactccccttcaagctctgtctggccccctcaactcctgagggagcctgtgagatagtaagtcagcttggagcctgcctcttgcagtctccagctcactcagaatgaaagctagagtctggcctgcacggtggctcacacctatgat

SEQ ID NO: 199893 - DNA, 491 bp, Homo sapiens
tcagggttgaaccacagcgcaaagccactcaccgcacttcaaactgctaagtgggaaatgtccagtagtgcatggaaacacactgcatgccaggctgctcggactaataagtttactacaacaccgagggaccccagcgttatcttagttgaaactcacattccttgtaagtcactaccgaacaattatgtccacggctaacaacatttttaaagcgggattatttgcatttggcattacggcatgcaaaattcttgctcaattacgtctcccgtttattcattgagactatttaaggtgctcttctaggcacaagatacaacagaataaaacaggcaaagccaagcaaacaaaaccctgccctcatccaacttacattctggttttgttttttgttttgggacggagtttcgctcttattgaccagactggagtgcaatggcatgaccttggctcaccgcaacctccgcctcccgggttcaagcgattct

SEQ ID NO: 199894 - DNA, 398 bp, Homo sapiens
taaccagtaaaggggtactggttttttttatttactgctgatgaaactgagtatgagagtaaagttatttcagggtcgtagggttatccattaccaacgttgggcttcatatctgagaagtctggctactcagttcaggccttaaattaaccattagacccaactacctttaaaaagatccctcttaagcagatagatgtttgagaactacttggcctagtctgttaactctgaattaaaatacctactcttcagtttctattccttctcactgccaaaacttcatttcataacttactccaggaaagtcttctgtgacttacacatggctctgttcctttctctgctgggcatatatgtatctaggttgtatagtatttgcttgttaatatggtctg

SEQ ID NO: 199895 - DNA, 620 bp, Homo sapiens
tctcctcccactagaacacagctccacaaagggtgaaatgtttgcctgtttcttggttgactgctgttacccctgggcctgcatcagcacctggcgtatagtagactctcaagaacagctgtcgattaaatgactgaatatagcacatctgggaaaacaaaggcttgatttggtccctgttttcaacactagctctccctcccccaggactggtcctctcctagcactgccagcctctgccagtccttagtgggacatgacctgcccttgcccacacacctactcgatcctcactcagtagtcagcatccatatcccactgtgactgacccaggcacacagtgccagcagctcgtccaaactggaaactcttcaagtctcaaagtcttttatcagtctattacttgtccctgcattctctcttctgtccccctcactgtagaccttcagacactcaccaatttcctgttccctctctcagtccctgggaagaccggcagtggggtaggacgccaatctccccagctgctcttccaggctcccctgccagaggaggcctttggtctgtgatttttctgccaattattagaaagaaataggcctgggataataaaaacaacc

SEQ ID NO: 199896 - DNA, 960 bp, Homo sapiens
ctcagcggctcagcggctcagccgtggtggcatctaccctccctgtttaaagaaggaatctgagatgtacttctggactcacgggcctggggcccacccagcacagatctctgctgagcaatcttgtctccactctgttcctgccctttgcccagccctgggcctccaatctgcattgattacctggtctgatctctctcaccatcactaggtacttaataaatatttgctgttgatgatagcaatgaccttgagactgatgaacagtctggccaagaggatccttgatgtggaagatagaaaaagcctttggggtcaggcagacttggattctaataccagccagttctgcttgctgtgtctgagcctcagtttactcatctgtgaagaggaggtagcaagaatgaaaatgcctgccttgtggtttgttgtaaggacagacactgccaacgtagagggcccagcagctcacagaccagttgctctgagagcagaccactcttgccttgatggtagggaactatttttgtgcgtggcaagtgggaccttaggaaggaaggcaactgtgaggcttctgagaaggaccctacacaagggagtttcctcccagggcaggtgaatggagagggtggcagaagcctacgggaaggggtcacagggatcagctagagagtgccaccacccttcctggggaatgcagggcaaggtccctggtgggagttttcctgggaagccaaagaagcgcccaacaaagacagaatcaacatttgggtacctttggtacccagaggcagcaatgccaactacaaccacactggaagaagaagaccttctccgcatagattctctgatctcttcctccttcatggcaccagccctggggaaccagcatggtggggaaataatgaagctggaatacaaccacttacagacttcacaacctcctcctgtagataccaa

SEQ ID NO: 199897 - DNA, 507 bp, Homo sapiens
gagcgaattattattatctttataattagagtaattctctgtgttttaaattatatttattattagagcttggtccagagtcaactagaaatggaaaatcctcaaggtattataaacttgtcatttaaaggtgccagtaggatcacagtcacattccataaaaacacggctcagatgttacagacatgtttttctctcacattttttaacctggttagagtaaatccagtgccttaaagtttttaataagtcaggtaattaaaaataaaccactggaagcctcaaaaagtttgtatcaggaattgggtgaataaaatcttgtatattttatgcaagaggagtaactttgaaagaaaacacaccaaaatgccaatggtggtaattggtggtatctggattggtgtgagtaggaatgattattgtctctctactttttagattttttataagaaggttacagaacttttactacaaatatgtataataaagtatccgttccttagttct

SEQ ID NO: 199898 - DNA, 140 bp, Homo sapiens
tttggtcgtggtgaaggttagtttgtttgtggcaatgcttaggtttcaaaaaggagtttaaaagtcccaaaagactaaaaatatttatggggttcaatcaacagtcctgaaggcaactctgaaattaagatgttccatct

SEQ ID NO: 199899 - DNA, 877 bp, Homo sapiens
aaccattcctctactaatcgtgttttttttctcaataaggataacctcaataatctacttattttggttacaaaccagagttaagactaactgttacataacacttggcctgacttccaagaaagctaatgttttgcttaagcaaatgaagtaatttaataagtactcgaaaatcttgctctaatttcatgtgggagggcagcttaatcttttttgccccatacttctgatggtgtttttgatgactacccaaaaatctaaccaaactcatttctgatctcttctacatgttgtgtaacttacgtgatgtcttatccttttaaatgccaacgaaactaagttgatttttgtccatcaaatatatctaatccattcactatgaaatgattgtagttcctgtgaatttaaacacttcttatacgctgatacatacaccttggtgtcttaaagacagatgagcccttggggatttctttactgtatatgattctgtagggactacatttggggagtggagacaatttcccaggatggcataccaactagaagcatattaccaaaagaagcaagtttttttcatagaaaaatatctccattcagggtcagctctggtttaactaaggcatctcacaaaacattgttctctaagagcactaaattccatcttgcatgccagttgagagtggtatgttagctgggacttgaaactgggtatgtgagctgagtaatggtatgaacttacatgttatttaaaacagctacacttcttctggctcacgcctgtaatcccagcactttgggaagcccaggtgggcggatcacgaggtcaagagatcgagaccatcctggccaacacggtgaaaccccgtctctacta

SEQ ID NO: 199900 - DNA, 685 bp, Homo sapiens
tcagttcttccctgaaaagtaactgataattgggggaggaaggggaactcctcctgaaaagactttgttctttctgaactcagttgagctaacttgtgacaagctgatagtggtttatttccaggctgacgtcttgtggtgtcagtgtgatgtagcggaaaaaacagaactgaaatttaggtagttgtagttcagtttgtctcccactcccttgctctgtgaacttgggcaaatagcttcatgtctctgagtctcagtttttctcaggagatctagcttccacattctgtatttcattgctatcccagcagttgtctaccaaattgagcagcttattgtaaagccccttaaggctactccttattttttgtctgcttcaactatgttctttgaattcctcctacttccctcaaaacccacatttttcttagctaattactcactctttgtttattctctcttagaaaccccttcccactctttctccttcccaccataagcaagtctataattgtgctagtgtctagaccgagtaccacagcagttagtgcctttctgatgacttcttcctttacaagctgataataagagtttattggtgaaacaagttttagctccagtatgaacagaaatccattcagagactttgcaagagtggaaaaactttttctgtttaaaaaaaaaa

SEQ ID NO: 199901 - DNA, 548 bp, Homo sapiens
taaggaactgtgggtagatggtttgcaggaccacatacacacacaaaatagccgactaaagaaagcggtggagatcgagatcagtaagtttgatttgggaacaaaaccctggagactctataggtaggtgactgttgggggtggacaggcgctgaagacttggattggtttagacctagaaggaagtggcatttgattggttattataagtgaaaagggcccctccccgggtgagatatgccagccccataattaggacctgaaaatctctgccaggcctgcctttgtgacgtggcccagtctacctcagctatggaacaggccttgactggtgaggcccaaagccggtggccccgcagaggcgggagtggggccatggctgaggcgcctgggcccagtggcgaatcccgaggacactcagccactcagctgccagcggaaaaaactgtcgggggaccatcgaggggctgctcaagctccgtgctcagagtgtcccagttggtgctccaggccatctccactcacaaagggctgactctggcagctct

SEQ ID NO: 199902 - DNA, 187 bp, Homo sapiens
tgcacatagagacctctacagctcagaatagggggtgcttacaatacttgagtttcactccagccctctcagcccttctgcctttgaacacaatgacatgggattattcgccttgggtattcccaagaggagtttcataactgccactttgtctctataaaatgactatcttaaaagtttactccaa

SEQ ID NO: 199903 - DNA, 654 bp, Homo sapiens
caaataatcacacaaatagtgagctagtgccctgaaagaaaaggcctttgagaacgtatggcaagggaacctcattttgcctgggaggccagggagggcttcttcagagaggtgatgctgatctgggatgggaaggaagagagagggtaagccaggtgaaggggagatggcaagaatgctcctggcagcaggaatagcatgtgcaaaggccctgaggccagaaagcacacggattgctggggaagagaaagagtgaatatggctggaatgtcagtgtggtgtgagatgagaccaggcaggaggcagggcctggtcaggtaggactttgtaggctgggggaaagaggagaatttttaagatcccaatcctgtgttccccacccgtgggccccagctcctctcccctctgaccaggttaggtttgttaatgaccatggggtctagccgaggccgagagggttgcctagggcagcttgtgtcctggcgtgtcagctttctgggtcgagcatctctttgttccctggaaacctgtcaacagaccctctatgggcccaggtctggctttattcagcagctgttccttagcggggaagaggcttttagctttaataaaaaagggactagagataagaagactgcctcgtcagggagagca

SEQ ID NO: 199904 - DNA, 387 bp, Homo sapiens
ttccacaatgtgagtgagagatgggacggaaggtggggggagaaacttgagtaagtacaaatattaaccaagaatattgactaaacataggaataaaatacccagacatgacaacagtaccactaagagtaatatattagttgaaagtatgtagttacatgctttaaatccctctgctggtttatgcttctctttggctcttactactccttactcaagcatcttaaactatgagttagctggttgcttaagaaaactaatgtgctgttgctctaaagcaaaaaagtaacaggttcaataagtacttttttgaggcagtcactgcttttgaatctgcaaggtaaatttatccaaaatcatctgctaaaggatcatcacaacataaag

SEQ ID NO: 199905 - DNA, 658 bp, Homo sapiens
gtttaaaggacacagggtttccttttggagtgatgaaaatgtttggaactagagatgatggttgcagcactttgtgaatggactaaaggccactgaactgtacagtttaaagtggttaatggcgaattttgttatgtaaattttaccacaattaaaaaaaatttttttttaaaggagagaggagcccctcagggaagagaagagagagttggagaccaagaggagctcactcccctagagactctccagggtccctccaggtgctccatggagctatggtctgtgtctccttctctccacactatactggaactcatgacagatagttctgccctgggatctttgcacttgctgtttcttctgcttggaatgcccttccccagatgaccacatcacccactccctcactcccttcccacatgtcacctgtgatcacaggtagtaagccctttcctgactcctgatttaaaactgccatcctctcaccagctctccccaccccttttctgctgtcccttcctttcttcacgacactcagcaccatctaacatattatctcattacttaattattacatttattgtctgactctcccacctaaatgccagctccagcaggaaagggatgtggtcttttgctccatcccatccctgcagca

SEQ ID NO: 199906 - DNA, 474 bp, Homo sapiens
gaagccatgttcagagaggttcagctcgttacccactcaagcagccctgaacaaacacccttttctgacctccagctgctagtaagaaagtgcagggaggacacaacaaaagctgagggcagactgtttcttcccccacacctccgcagtctcttccctttggggaatgtgggccctgcccactcactgcccacttacctaagtcccactgccaccccactgcctgtacaaaagcaggtgagaagcccctcccctcaaagagcctttccccaggccctgctgaggtgacccccatatcttcacctcccaggacacagactgcttggatcaggggttcccagtgttttggaatgagggtcctttgtaatgtcaacacatcttgaagactcatgggataggttggtatttgttggttgagaaaataactattgtcaaataggtgttataaataaattattgacccttttaaggcaa

SEQ ID NO: 199907 - DNA, 277 bp, Homo sapiens
cttcatttctcttcctatgagaagtaatccattactgaaagcctttcatggtatcctgcattgtaccaacatatggaggaactacatcagtgattaataatatagtggaacaggcatgaactctgcagtcttggactcaaattttcactctggcaatttactagcagtgtgatcttttggaacttcactatccttgtctgtaaaatgggaataatgcccagcttagagccttgttttgagaattaagtaaagcaaataaagtacctagaaactgtta

SEQ ID NO: 199908 - DNA, 465 bp, Homo sapiens
cttgcctctctttatgcttttgaacaaactagccaccagctgggctttccagatctctcagtggttaaagagctggggaagtctcgggaagaaggtggtatgtttagcctggggcacggggaaagtaacatggctgctggtagcaggcacagtggtaggggaagccctacgtggattacagtgaaatggagtttacctaacaaattaacaaataatatgttcaatttctgctttcggcctacctgtctggttggttctgagaactcaagttagttcttccttatttcattcgccaaatttgacaagtccctgaaattcatcactggcaacttaacccagtttgtttcttctaccaaatgcaaggaaccaaaacattttcttttcttattcccatttggcaatgacattttactttggatagtgggacatgtctaaacatcctcctacttattagttacaaaggtg

SEQ ID NO: 199909 - DNA, 364 bp, Homo sapiens
aacctgggaggcggaggttggagtgagctgagattgtgccattgcactccagcctgggcaacagagcaagactctgtttcaaaaaaaaaaaaaaaaaaagaaaagcaacatagtggggtttctgtcaatctgtcctcggctgcccttttcatttgttgatgggaccttgaaagcaagcttgctaggtgccctttgtggctccagcctttaccggaagtgtggtgcatgtttttaacttcagggaagcggtatcctgtcactggggtatgggatgagcatggagaaaaggcaccagccacgattccttcctaagcatttcctgttttgactggtcatgaattgaagaaactgacccttgtgttca

SEQ ID NO: 199910 - DNA, 1181 bp, Homo sapiens
ctggctacagaagactcccctggtctttatttttttccacgttcatttatacagtgaataatgtagttatcacttatagtaatggaataagcccttgcaaactcacctcctctaaacaaaaacaaggaccctgatggcagccatattgctccctgcctttcccctccttaccttgagtaatgtttaaagagcacagagatttgcttaagggaacccatccctgctgccagcacccatttcctctatacctgttgcccctgaaagtgccattctgaaatgactaccctagtggtgtgatttaggatgtcctctaacatccctccagctggggtatcatttctttaaggtttttttccctgttaaattcagtgcttctagagaaggaaacaccttaatatgaatgagttaggtgagagttccaaaagagggtaaaaccataaagagtatgactctggaaaccggcgatgagggcacaggaaggaagacccaaaaaagaggttgctgggagttttgccttttcttttttccttgttggacctggcctaaacttgttgatatttttcagcttatatctggaatcccactaaaacacaacatttatgtctgtccccagggctggatggtacccacaggacttagtgcataggcttgagtccaaactcaagtcatgtttgggaagaaacaggccagattccaccccatgagggcagggaccttacctggttttgcttaccattcaattctcaattcttggcacagtgcttggcacatagtaggtgctcagtgaacatctgatttaaaaaatgaaccaatagactgagtatggtggctcatgccagtaatcccagaactttgggaggccacggggagaggattgcttgaagccaggaattcaagaccagcctggccaacatagtgagatcctgtctctacaaaaaaatttaaaatatgctgggtgcagtggcttatgcctatagtccagctactcagcaggctgaggtgggagggtcccttgagcccaggaatttgagactgcgatgagctatggaaggcactacgctcaccactgtactactaatgctgcacgatgtagaccacggtgagctatgatcgcaccactttacttcagcctgggcagcagagtgagactctgtctcttaaaaaaaaaaaagaaagaaaga

SEQ ID NO: 199911 - DNA, 152 bp, Homo sapiens
cctccttgtgattagtaaattacactctagtgaatcttggtccaaggttcttgcccctattttgcagtgttgactggctgcaactgtttaggcctgtcactgtgtttaaaaaacatttctaaggtgttaactggtcttgctggtactaaaat

SEQ ID NO: 199912 - DNA, 503 bp, Homo sapiens
aaacagaacttcctcttcctgttgatgctttccagcatcacatgaatgttcacttaaaagagtctgttaaatatttaaagtatttatatttactctttgtgtatttttcaaagtgggttttcattttcaatgaaataatttttaacttttccaagaatacacttaagataagtattgacaatgcttatcttactttcttctggttatccccatttttttcctttcagggtgttttgcttctgagaaatcacttttacgggtgtggggataattgttttcctgcttcattcaattctcgctctttctgttgagcctgtaaacaaaagtcttgctaggaactaatgtaatgttggttttcattgcgatgctgaggtgtttaatttatggaaacagaacggactcattccacacacaagtgagtgaaaagccctcaagtaatggtttttcttcagcattgcttctcagggattttccttgtcttctcgttatcttggaaatagaat

SEQ ID NO: 199913 - DNA, 312 bp, Homo sapiens
tggtgtatgtatccctgctgtagtagacgtgggaaatgtgtttagtaactattttaccacatattatctcagtctctaagacttctaaggtcttaaacgtgttactaccttctgtgggaatgtttagctttattacagtttgtaaacatacttctcagaaattcacaagtgaaatatgtatttagggaacaccttccttctgatctccggatgggataattgtcaaaagtatgaggaagttgctggtactgggctactcctaatcactacgttcccttttctccccacccccaccccccaatctcctttctc

SEQ ID NO: 199914 - DNA, 361 bp, Homo sapiens
caagcacttcctgtcacagttatcgaaacagtcttttaaagaatgtctagagggccttacttaaacaaatagcttgtcttgactttgggaggaggatggttacctaagcccatgtgttaaaacagacagatgacacactgaaatgaccaacgagcataataaggagaattcagtatccttggaaaccctggaacggtgccataactaaactaaaaaaattttagcaggaaacagtacaaacaagaaacatcgtgagagaaggccttagtgttcatttctgtggttgtgaagcgctagtaggagtaagtgacaggacctactttgaatagccagagttagaattgaagggggagccactgga

SEQ ID NO: 199915 - DNA, 440 bp, Homo sapiens
agacggcagtgcagcttgttgctgaggtcgactcatacaggatcctcaagcttttaccgctgaatggttttggcacctttgtcaaaaatcatctgaccatgcatgcaaggttttatttctgggctctctattctacttcgctggtctatatgtctctctttatgctactaccatacggttttgattaccatagctttatagataaaacagacaattggacttcatagatatcagaaaattttgtacgtcaaaagacagcataaacaaagtaaaaatgcaatccacagaataggagaaaagatttgcttatatgccggttaagagaataatatccagaatatattgagaactgctaaaactcaacaacaaaccaaatagcccaatcaaaaaattgaaaaagcgattgagtagacatttctctaaaggcggtaaaaatggcc

SEQ ID NO: 199916 - DNA, 392 bp, Homo sapiens
gattttcagtaactcagaaggaagcagtttcccctatggactaaaactatcaggcaagggagttggaaagagtatctcaagttttccatattggttgaatgagccccaagacgttcataatatccacaggcatcttttgacaaaaatctcatttgtgctttcacagtttgtgctaagcactatggagaattttgaaaatatgtttcaaattgttctgacataaatataatatatttgtatctaatttgttgctagtacagtgttctgcctcacagtttcctgctcctggtattcccctccattcgctatgcatacacttaatacctactgagtctaacatgtttattctgtacctaattattacaaagttgagcaagaaccatttgttggtt

SEQ ID NO: 199917 - DNA, 485 bp, Homo sapiens
ttagtagagacggggtttcacaatgtgggccgggatgatctctatctcttgacctcatgatccacgcgcctcggcctcccaaagtgctggggttacaggcatgagccaccgtgcccgacccaggaattcgttttaaaaaagttcttaaagttttaaaaaaatgattctctcattttacttattttggaaaatctccgctggctaagctgccatctccaccttctgactcagtggctttcagcggctttaatctggcactaaaactgaaaaacctcgccctttcaaaatgacaaatgagagggggaaagtgtctcccacgtgcaagtccactcgcatggatcaagcgggatgcccgtgctgcaagggaggttaggacaagaaaccggaagtgaccatagcactgggtggggagagaattggggtatttggggcttgagcacagaagccttttttgctttttcttctggaaatatttaatcgtcttt

SEQ ID NO: 199918 - DNA, 553 bp, Homo sapiens
ctaatttgtctctaatgccaagccaagtatagaaatcagcctcatcgttcttttccctggatggctcgtggagagtcttggtgaatttccaacatgcatgtttgatttggtttgttttcatattgactcttaagagtcataccaatcacaagtttaaaggcagccattccaggagaatgagcgtggtggtccatgctcagcttgggtgcttgatgtcagatgatataagaagttgatccccgtcagttggacttggattagagttccatccaaggaacatggccggaggaagatcttttcatatacatatcataacaagtcataggaaaacagagtcagtccttctctttctgaaggtgttagaaatatttttctgaaactgttatagataggattttaaatttttatgtgtagttttcctcctcctacaaagaatttgaggctataagtaaggatctgtagaacctttcctgaggaacccagtaggcacagggaagcgcgggtgttctaacagaaccttctctcttgtgcatgtgtgcgcccctgcccaact

SEQ ID NO: 199919 - DNA, 425 bp, Homo sapiens
tgcatgaagaaaagaacacataattgccacattcaggagtgattctaggaaggactaggagagaaaactataaaggagtcagttagaaagtaggcatgtctcaaagctctgcagtgggaatttcctcagatccatatagactgatctttctgatactgaccatctcaatcagctggcagagtggttaatattaggtgtcaacttgattgaattgaaggatgcctggatggctgataaagtcttatttctgggtgtgtctgtgagggtgttgccagaggagattggcatttcagttggtgcactggaagaggaagacctacattcagtgtgggtgggcaccatctaatcagctgccagcgtggctggaataaagcaggaggaagaaggcaggataaccttgcttgctgtgtcttctggcttccttc

SEQ ID NO: 199920 - DNA, 492 bp, Homo sapiens
gcttgaggccaggtgtttgagaccagactgggcaacatagcctgacctgtttctacaaaaattgaaaagttagctgggtgtggaggcgtgtgtctgtagtcccagctacctgagaggctgaagcatgaggttggagaattacttgagccttggagtttgaggctgcagtgagctgtgatggtaccaccgcacccctgccctggcaagaacaacaaaacagcagtttcttcctttttgaaggaaattctaccttttaatcctttgagctaggttttgcagctttaatggtgagcaagactcctgtctctgccctcatgtagcttgtcatattgggattattgaaaagcagatggacacttaaattacagtgtaagtgatataatttaagtgaatcctgggaactgtgggagaggatgagaaagacctctgtcttgcataggaaaggaaagcttcttaaggtaaggaatatttaaattgacaggtgaaagacga

SEQ ID NO: 199921 - DNA, 503 bp, Homo sapiens
ccagccaacttcctctcctgggtctctactccaggccctgcccctccctacctgggtgaccttagacaagtcacatcacattgtttggcactgtcacagcttttggttggcgctcagtgatcaggaggttcagaccatcaccccaacccgcagtctcttcccaaggtatccgggccctgcatatctgcctccctcttcctctcccctgcagccggggtcaggctctccctgagcaccccttctgccctctccagattcactattgctgcctccctccctagaacccagggctctgctcattttcttcttcccaccgcattcctctgcttctctcaggcctcagctcaaacctcccttcctccaggaagcctcccctgattgcccccaagctttccttttccagtaccccataaaccccaggaccagtcccagctagggtccaaccggactcccctggaatactctcataattcctgcctccttatcctgccctcctatgtcct

SEQ ID NO: 199922 - DNA, 403 bp, Homo sapiens
tcgaatgagaaatggggatgagaatagctcctaactccaaggtggatggagtaagttcgcacaggttgaatccctgggatcagcgcctggagcctgacaaggtccagtcagagccagaactgctgttactgatactgacccttggccgtaccaggggagaacttggttgccattgccaggtgttctcccaccacgcccagctactgtccctgtttgacatgtggctggaataaagctgtgcacgttgcagcttttggcacatcctggctttgaggtaaaaggtacgtgtgtgtttgagggttgagcctggccatgggaatgataatcacagcccaacccagccgtgaggtcgaaccctacctaggggtgagtcctgagcttgacacccctgagctgtgcggtt

SEQ ID NO: 199923 - DNA, 479 bp, Homo sapiens
tggaggctttaatgcatcatctctatatctactaaaatgttcaatctttcctctagcttcttgaatgtgtttaatgcctttattatcactgtttaagtgtccttgtcttttaattctattatctgtgttatttctggctttctttgagtgactcatttttctcattatggggcttattttatcacttctttgcatgcctggtaatttttgattggataacagagacgttgtgaattttgctttttggggtgctggatatttttgtattcctctaggtattcctgagttttactctgtgacacatttaagttacttggaaaccatttagttctttcaggacttgtttttaagttttctgagatgggagcagagcagcatttagtctaggactaacagcctactgagaagcactctactctatgctctgtgaattgtgaaactttccactcagggtggtggaaaatttccactcaggaagc

SEQ ID NO: 199924 - DNA, 413 bp, Homo sapiens
ctgaggtagattcaattactagtctcattttgtacgtgacaaatcaggcacagacctcaaaaacattatgctgagtgaaagaaaccagttgcaaaagaccatatactgtgtgatcccatctatatgaaatgtccacaacggataaatctctagagacagaaggtagattagtggttgcctatgggatgggagtttaagaggaaacggggagtgactgctggtgagtatgaggtttcttttaggggtgatgcaaacgttcacggtggagactgtagagatggttgcacaactctgaatatctgaaaagacattgaattgtgcactttaaatacataaactgtacagtgtgtgaattatatctcaataaagctgggttttcaaatcttatttagaacaaaaacaaaacaggcaaa

SEQ ID NO: 199925 - DNA, 736 bp, Homo sapiens
gcacttggaaagtgctcctcctgtggggatgcagtcaccctgaagtgtttcagagaggttgtctataggtatacccatgccaagctcccatgggaaaagccccacctgtgtctgcagtggtgaatgagggggaaaagaagtcatcttctccaaggctattcacaagcaccaggactgcctgactgttggggcagagctgcagactttccttgctgagcccagcatggcaactgtatttctcctgaaagaaacttcccaccagtggaaagatctgggactcaaggcctcccgcctgggttcttttgtgccatgggtggtcccttgatgtggtacactctcccttcccctagaaacaggtgtccctaagggcaagaatactgtgaatgctgttgttcctctgggtctagatgcccagtgtggctgccatactctaggctgctgcttggaatgcctgcaaggaatccagagatatggcctgtcctcaagtctcccagcagtgggtaccagtaccagctctgatgggggtggcaggaaagtgacacagactgtgagattccttggttatggatagtcttaatgtgttggctttctgaaatgatggttgtagtagtaatgaaaaggttatgtggacagactcaggacctcctggttggccagggtagtagaggcaatggtgacaggtaaggtcatgcacaagttttctccttcctgggtgcagtattattctacctggaga

SEQ ID NO: 199926 - DNA, 317 bp, Homo sapiens
aaatacaaaaaattagccgggcgtggtagtgagcgcctgtaatcccagctactcgggagactgaagcaggagatccgcccgaacccgggaggcagaggttgcagtgagctgagatcgtgccattgcactccatcttgggcaatgagtgaaactctgtctcaaaaaaatatatatatattagatgctgctgggagcagtggcttgcgcctataatcccagtgctttgagaggccgaggtgagaggatcacgcctgagttggagatcaggccacaagttggagatcagcctggacaacatagtgagaccttatctctac

SEQ ID NO: 199927 - DNA, 405 bp, Homo sapiens
catgactttttctttcccattttaagaatagaagattcattcttagcaacctcagtttatggtttttttctttccttgttgggagatttcaccttaaaggaaggctagatgtagcagcacaggtctgtaatcccagcactttgggaggccgaggcaggcagattgcttgagcccaggaaatagagaccagcctaggcaacaaaaccctgtttctaaaaaaaaaaaaaataaattaaaaaaaaaaaaaacagaaaaattatctgggcatggtggcacacaactgtagtcccagctacttgggaggctgaggtggaaggactgcttgagcctgggaagttgaggctgcagtgagctgtgattgcgccactgcactctagcctaggcaacagagcaaggctcggtctc

SEQ ID NO: 199928 - DNA, 233 bp, Homo sapiens
ctgtgatttactaaagaattatggaaacagcctaggtgtccatcagtggatgaatggataaagggactgtggtttatatgtatatatacaactgaatattagctttagaataggaggagaccctgccatttgccatgtttgtcctatttggacctggagaacattatgctaagtgaaataagccagacacaaaaagaagaatattgtgtaatctcactttcttgtggaatttt

SEQ ID NO: 199929 - DNA, 674 bp, Homo sapiens
ggtaagagggacagggagagataggcccagaacagaagagtcctgatatctacagccaggctctgaggctatttactgtcaatgttagttcctttgtgactgaggggttgggggaccagggactgcatgggcaaaaggaaatgaaacgttgcattattttttaggggaaaactttgagggaaaaaaaaatcaccaattagccttttaaaaaagaaattggagtcagaggattttgaagactccagatgctctgttatatttctcctttagtttactggggaagggaggaaaggaggggcctcaggtgggcttggggaagtgcaatccaatctgccaagccagctttgggggagagtgatttacaaagcaaaacctcagatgctacttcctgagaagtcaccagatcaaaacaccctactctaggcgtttatgaccctgtctttactcccaacaggaaaagcaccctcaataaaacctcagcctgtgcccccatcctccacccaggggatggggagagacacaacataaaatgaaagacctgacccttactactccctaaacacacacacacacacgaaaacaatgggctatgagccttgatttagttgtgggttttcaagtggcccagaggaacaaaacatcaaagtgaaatgaatggcctgatgggataccat

SEQ ID NO: 199930 - DNA, 546 bp, Homo sapiens
ggtgctgagaaaggattagaactatgactctcaaggcacacggaacataggagcaccggtgagcgttataaagtgcccctagccgcccccattctccacccactgaatcatgttatctggccatgggcaccccacgtgattcttacgggtatcaggtttgaaaatatcagagttttaggaggactaaaatcctcccaggttcctgtgacatcgcaacggaaaaagccttaggaatgatctagacgatcatcatctgagattgtgggctcctccgaagttaccacacaagtcccagatcagaaactgagacgggggcttgctcagtgccgcgtggctggcaatccgcggcggcctccggagcatgcgcaagatcttctctgcacggcggccttgcagccccgcttccacccaccgcaggaatgcctctccttgaccgagacacaaaccttttcctcctccagccgacagtttcagcccattacctctaaaactgcacactctcacaggtggtggactccataaatgtgaccatctgcctactcttgt

SEQ ID NO: 199931 - DNA, 832 bp, Homo sapiens
acaccataaaaagatgttcacttcactttgggttgtcctggattttttttttttaatgtcataagtttattgacaaacatatctagtatgccatatgagttcaagtttgatccacttccagaggctgtacctcttaaaatgctcttcatatctgttaatggatgaactgaaacatccttatgttttaagtagttgttgtcttactacaagaaagggtgtagcaaatgcagatccaaagtacaaacacatcttagctagtaacgaccacttgttttccactgaaaatggcaaattcttcccagggccctcctcacagtggctcctacggaccacagaggttgtgaacctctggatgctctggcccaacgtagcgctgctggaagctctgcgaaaggcacagaaaccgaggacggatgaaatggcggcacctcaccaagaccttttttttttcctggattttttttttctttgtttgtagcagttaggattttgcctgttatgatccactttaaattgtgatttccagaaatacagtgaatcaaatgtaagagtgctgaacaactgtatcgttgcatttacatgttctttttgttctcatttatttacattgctcagcctctatacacctagaccaagtcattagatactatgaatcttctgaaggttagtttattcagttagatttatatacagatatatcagagaaggattaacttctaaaatttaactcacatcatactagttttagtagtaagttttatgactagtgaactttattcttgaatcacacatttagcagtgtttatttctatgaaatgacctatttcctgcc

SEQ ID NO: 199932 - DNA, 778 bp, Homo sapiens
acaccataaaaagatgttcacttcactttgggttgtcctggattttttttttttaatgtcataagtttattgacaaacatatctagtatgccatatgagttcaagtttgatccacttccagaggctgtacctcttaaaatgctcttcatatctgttaatggatgaactgaaacatccttatgttttaagtagttgttgtcttactacaagaaagggtgtagcaaatgcagatccaaagtacaaacacatcttagctagtaacgaccacttgttttccactgaggttgtgaacctctggatgctctggcccaacgtagcgctgctggaagctctgcgaaaggcacagaaaccgaggacggatgaaatggcggcacctcaccaagaccttttttttttcctggattttttttttctttgtttgtagcagttaggattttgcctgttatgatccactttaaattgtgatttccagaaatacagtgaatcaaatgtaagagtgctgaacaactgtatcgttgcatttacatgttctttttgttctcatttatttacattgctcagcctctatacacctagaccaagtcattagatactatgaatcttctgaaggttagtttattcagttagatttatatacagatatatcagagaaggattaacttctaaaatttaactcacatcatactagttttagtagtaagttttatgactagtgaactttattcttgaatcacacatttagcagtgtttatttctatgaaatgacctatttcctgcc

SEQ ID NO: 199933 - DNA, 481 bp, Homo sapiens
acatttattttcctatcaacattatcaataacttagataaaggaggtaggtgtagtagaaagagaaatagtgaatcttttgaatggtagaatcaaacacccacagatttggggcaggctggagtgagggactaaatctaacatgatggaacctaggatagatgccctgcttttagatattgaaaactaccacagaggtgacaggaggagcatcaagcacttgcataaaagggatttgggcaaaatgtgaattaatggtatacctagatcactagtaactggatcacagaaggacccagcgatatgtgagatggccatgacttggccatctgtctgctcttctccgttctagaaggccatgagggcttgacccaaattagcaggtagttcacaacccagtttctcaaacaaatgtctgtacatgtacaaacacttttttaaaaacacttcacataataaacgtgaagatatcatctaatttg

SEQ ID NO: 199934 - DNA, 470 bp, Homo sapiens
tcacttttgtttaatatatgtgagagctttcagcttccgtgtttttctaaaggctttaacagcttggcctgtggacaagcaattatttaattaaaattggcacagatgtccaaaattttccattgttcttcagactacttgttttttgttaggtagacacattgttatgaactggacaggaagcaaaattggaagggcaggtaggagcagctgttaaggccacggacatgtaagtttctgcattatatagggttggggtctgcttatttgtcatgtgattttaagccatgttatgtaacctgtctgagcctcagtttccccctgtataaaacagggataattatcggacctgcctcctccagttgtgaggattcagagggatcttgtctgtcaagtgtttacattttagatttttattgagtcctgtgaggctgatactcttttctttctagcatgacattgcagtcgtt

SEQ ID NO: 199935 - DNA, 494 bp, Homo sapiens
caatcacatggtaaaacattcaagcagaaaaaatatgtggtgaaaaataattatcccatcctagaatccagtttccccattgcctagaagtaaatacagttacaaatttcttacatgtttttctagaaatagtctatgagcatacaagtatatgaatatatcttcctcttatttttctttatcacaaatgagatcttgctatttatagtctccaccaccttgctctttatatttaacatattagctagtataggtctacctctttctttttgaacacctgcatagtaatctagtaaagatttttaaaatctaatttaacaattctttattgatggaaatgtgtttttaaaagtcttttgccattatagtggtgtaataaatatcctttatgtatacatttaccaatgtgtttgagtatatttctaggatatatattcctttgaagacttttgagtaggaaagtggtaatactaaaaagacaaacctaatgtgag

SEQ ID NO: 199936 - DNA, 702 bp, Homo sapiens
ctgaattctacatgaaagagcttttacaacgtcaggaaatgaagctcctctcatgcatctgaagcatgcaatggagcagagaaagagcacacacttatgacattagccatggcatcctaaagacgttcaagactacccagaaccacctgagaatcgatttcatgtaggattacgtatctctgcctcgaattacactatattggtatatacagtaatatattttaggaaaattgcgaatactttatttttataatttgaattgttttcccattaacacataccaccatttatgagacgctctgagtgactggctgttgtaaacgtcttactgactgcctccccaccactgccacctacctggctcccttccttacgttttcaaactttaatacattttatgatcaaaactttggcaatgtaatgaatatttttgtaataacaatttcttttcattgcttctcaaagtgtgaatgatacacctttcctatcctttttttttggaaataaaagggaaataagcttgcatgtcccttaaggagaacgctcaggaaagtaagtatttccgctcccaggaagtctgcattatgcttactggcacggcacctctaacctgaccatttgagatcctccaatgactatttccttggagcatcacgttggtgctcaaaaagcttcagatcttggagcattttggatttccag

SEQ ID NO: 199937 - DNA, 364 bp, Homo sapiens
gtcacccaggttggagtgcagtggtacaatcacagctcactgcagcctcaacctcctgggcttcagattcttgccacctcagcctctcaaagtgttgcgattacaggcatgagccactgtgcccagcctaaacaatttattgttttaagtgactgtcaggcagtcaaatctatagcaatggtcacactacctccaccattagctcttctggcatgccaaccactaatatcacctgcacctccagtatctagcaaacagtaggttacagtcaatactatactgctgagttctgtactgctttgaggaaattagattcctgtcttttacatctttaatattaatagactcatacaatcaaaattcc

SEQ ID NO: 199938 - DNA, 373 bp, Homo sapiens
cttccccgtgctcactccatcctagccatactggcccccttctgttccttgaacaaagctctcacctgtctcagggccttgatactggctgctctctctcagtggtatgttcttccccaaacctcccaagactggctctatgctacactcacttttcgcctccaaagtctctcttgaagaggtcttctggtcttttagaaccagtcagtttctagcattcatggaactatcttaaatctctgccatagctcttatcactctcagatgttctgctgggtatttttttttttttttttttccttttaatactttttttggctaattgctgttggaaaacacttggaggaaaacaaaacccgaaaagcctggtgct

SEQ ID NO: 199939 - DNA, 279 bp, Homo sapiens
tgcctgggtcccgtctccagcccaagcctgctcctctccccatgctgactctaagcttttcagactgtgggagcagtgtctgagaagccaccaggttcagtcctgttgtgtagcctccatgcctgtctctggggagggggctgcagcagggcagagccttgtgtctggtggaagggacagagtggccatcctcaaagaaggaagcagcctgccctagaccacaccacctaacgccaggctggaaaggaactgaagtttcacttgagccatgatttgtcc

SEQ ID NO: 199940 - DNA, 147 bp, Homo sapiens
tccctggactggagaactgctgcactctggtaaagacagacaaaaacaaaacaaaacaaccactactactcacaagaaacaacatataaatcgtaattgcaatcactaacagataagagaaaaagaaaagctaaatttcaaaatctg

SEQ ID NO: 199941 - DNA, 264 bp, Homo sapiens
atagctttgattttctcactggtgtttcattaacttggttttaaatgttgacaatatttacaagtggaaataaaatttgtaaatatatgaaagatgcctttccttgtatataccatcaagcaagcactttgttttcaaagcaagtggtattttgatcagttttatttaaatgtgtgatcagaaagaatggcgtacaaatcttattatttctaaaaataagaataaaaaggtaaaactacatttagacttctttctcaagaaatc

SEQ ID NO: 199942 - DNA, 554 bp, Homo sapiens
gcctggtcattgttactgttgagactgctgtacttaacagtcagaggaaggcagctggtcaccacgacccactcggccattcccatgctgaagactcgctctcacttcacacttgtttggactccactatgacttgctggtggcccatctcctggatccttctgttggagctgttctagaagatgcttgtggcaggctccagtttcagtccttggctgaaataagtgtagtgtggctcttcggttttctaatctattccacctaaaaaggttaaggtgacaaacaggtggtgggtacagtagagttgtttttggcccttggtaatattaaaaacttggaatgcattccttatattactacagaattaggagaaacggttgaaagaggagaggtttttttcttggagtatccaaagggattggattcgactacactgacttggtgtgtaatggttgagtaggaaggaagatgaacataaaactgctattaattatgctcttagatgtgaggcaacattgaggatgtattgcatgtaacccttgactgcagaatca

SEQ ID NO: 199943 - DNA, 357 bp, Homo sapiens
cagagttcctccttggagtggtaaaaaagttttggaaacagatagtggtgatggctacagtacattgtgaatataattaatgccaatggattttacacttaaagatggttaaaatggcaaattttgtgttagatattttacaacttttttaaagaattaggagtttggaggatcaagaattcttaaatcatgtttttctattttcatgtgtatattttgcaatgtaagtagatgctggtacatcatctgtcaaaagagtataagtgattttgagctttgggtaaaaaactggataacatgtaaatagaaccagtcataaaaatattgagtgtttgaagtgtatctgagtgaaaacac

SEQ ID NO: 199944 - DNA, 368 bp, Homo sapiens
cctgaggtccccaagctaccacttcatctggcccctgcttagctctgcaaactcagcttgtaccacacagatcttactgttccgtgaccacgcccagggtgtttccacaccaagcaggtgcctttcccagggtttttgcacttgctgttccctcttcctggaggaaccttcctctacctcttcacagggctttgctctctcacttcattcaggtcatggcttaaatgctacctcctcagagagccttccctgaccacttggcctaacacagctccttgtccatcctcaatacttgggcttactcttacctgagggcacttaccaccacctgaaattatctttataatggatttagtctatacttctat

SEQ ID NO: 199945 - DNA, 402 bp, Homo sapiens
gattttattctgataattattttctactcatatttttgtctccctttccttctgcccatcactttaacttaggatcctgcttctcaaatagtagaggctcagaaataatctttttaatgaattgagcctagctagcattaaatttgagagaccaaataagcagtcatttgttttattttattttattttatttttattttactttgagttctgggatacatgggcagaatgtacaggtttgttacataggtatacaggtgccatggtggtttgctgcacctatcaactgtcttctaggttttaagccttgcatgcattaggtatttgtcctaatgctctccctcctcttgctttcctaaccctgccctccggggggttaataaagttttagcaagggtccca

SEQ ID NO: 199946 - DNA, 375 bp, Homo sapiens
cagactcagttatgacagctatgagactgggtatttaaaataactatgatgtatactcctaagggttctaatgggaaaagtgtttaaaatgcaaggaaaagatgggtaacataaccagagatggaaattttaagaaagaataaaaaagaaatactagaaaacaaaacattgatgggaatgaagagtgtctccagtgcgctcatcaatagactggacatggccaaggaaagaatcggtgagcttgaagaaatgtcagtagaaacttctaaaactgaaatgcacagagaagaatgaacgaaaggagcagaatattcaggaaccgtgggttaattataaaagttatgcatataatggaaatatcagaaggagaagaaa

SEQ ID NO: 199947 - DNA, 456 bp, Homo sapiens
tctagaggatccccacgcgcacgacggtcaaagttctgggattacaggcgtgagccactgagcctggcctatttttattttatagagataggatctttctatgtcgcccaggctattctcaaactcctgacctcaagtgatcctcctgcgttggcctcccaaggttctggaattataggcataagccactgcacctggcctggtacttttagaaataagaacacttttcagacctggatttcgggttgttttgtcaataattgtccttatttgcatcatattttttattcttaggctgattatgctttgtacttttagataactaaggtcaacaacagaaaatgaattatgatagttagatgcttagaaagaatccaatattctgcagcttccttgtaagcggatggcctgaccaaggtcccattgctctgtctcttttttttgttaatcaattca

SEQ ID NO: 199948 - DNA, 374 bp, Homo sapiens
gagatcacgccactgcactccagcctgggcatggtggctcatgcctgtaatcccagcactttgggaggccgaggtgggcagatcatgaggtcaggagatcgagaccatcttggcctctcaaagtgctaagattataggcgtgaaccaacatgcctggacaataatatttttaataagatccagtccagaatcacacattgcatttagtttcatgagattttagtttcatgtagtcttgaacaatttctcagtctttgtctttctgggccttggcgtttttggagattgttcaattatttttgtataaggcactccgatttcagtttgtctgatgtttcttcatgatatgattcaaattatgcagtttttgggaa

SEQ ID NO: 199949 - DNA, 215 bp, Homo sapiens
gtagcactagtagatagatttatctcttatgactagagcctcagagcaatttccaaggtagaaacataccaaaaaaataaaagagagaatgccttagccaatggttttatctataacctagatttaaagccaaattagaagtgtcagtcatctaaaatcctgtggttagtgtatttcattttaccaacagaggaacttttgtttttgaaggcaat

SEQ ID NO: 199950 - DNA, 226 bp, Homo sapiens
cagagtaggactcaaaacacagaagagcataaactaagaaatctttcctggtgaccatcgaaacagccatttccatcaagggaagccattggatgttagattgcaaggggtggaggaattagtgagacataagacatcgaggtacttatataaggtgatttaatgaaatgaagaaggaagacagggaaaaggtaataaaatcaaagaagtgtttttcaggttattg

SEQ ID NO: 199951 - DNA, 251 bp, Homo sapiens
gtacgtgtcgcgtagtaacgatgtctagtgatgagtttgctaatacaatgccagtcaggccacctacggtgaaaagaaagatgaatcctagggctcagagcactgcagacacatgaggctcccactgcccaaagtgctgggattacagacatgagccacctcacctggcctgattccatttttattatctaagtttatatgtaatatcagatctttttattttacatcctgtcctatttattcctgtactt

SEQ ID NO: 199952 - DNA, 780 bp, Homo sapiens
cgacagttcagggactctggcgataaagctgccggagtccgcggcggcggaggcggctgcggcgagcaaggaggctgacgacgcacaatgcaaagacggcttttcagagcagccagtggggcaggacaatgtttttcatcaaatgtccttagatttggaggaggtttccccagtgtatccagtggttgtcttcctcttgattaatattaaaggaggagaaaaagtgtgtattggggtcagtgcagaaaacaaatcatccaagcacacgaagtggaatttgctaatagcattactactcacccagtgacttcggagtcacaacccaggacacggttttccgcccatttctacagacacagtgagattcttcattcttctctgttggaacagccaggaaagcggaagagacctccagctgcacaacgacctgtcccccaacccaaccacaagtttatgaagggatgcagaacagcatgaatactgcaaaagatgctctgtgcatcaggtaaatggactgagggacaatgtccatgagtccagaggcgctgagaagctgtgcaaatatggtcagctctatcagacactttgtagtttaggtgtttgaaacaagaaaattgaaaaactgacaggaattaggataagtgtttaggatttagccttgtgccaacagaagaaagaggtgtttagtgaaaaacatgaaacaatcaggtggacataatgtctgaatttaggaatacacagatataggagcctgaatgaatataaccttaccaacttggg

SEQ ID NO: 199953 - DNA, 499 bp, Homo sapiens
ggggactgatgcccaactttgaatcatcttgatccttgagcttgggttaaggcgatcccagattgcaagtttctctggctgcctgacagaagcaaaggctgaatttgtctctccattgtccctaccctggccccatggcctctgctgtgacagtccacacagtcctggctcacaaacatgatctccaagagtggaagggtcctgataccttctacgagatttacattgtcaactcggccctattgttttacaggcggtgtgcagaataggtggtgagccatgtggaagagatggcagaaagagcctcttgatctgtgagacttcatactggctgtggaccaactcttctactgatgtgaaagaataagcctcagcctactcaagccattctatctggggcttcttattacataatccttttatttttattttttttatttttttgcccttaaaattattggtaaagagatgggagtttattttccaagtgagaacaata

SEQ ID NO: 199954 - DNA, 542 bp, Homo sapiens
ggggactgatgcccaactttgaatcatcttgatccttgagcttgggttaaggcgatcccagattgcaagtttctctggctgcctgacagaagcaaaggctgaatttgtctctccattgtccctaccctggccccatggcctctgctgtgacagtccacacagtcctggctcacaaacatgatctccaagagtggaagggtcctgataccttctacgagatttacattgtcaactcggccctattgttttacaggtaaaataaagcatgtgcagattcaacactgcttttttccaaaattaatttctgaatcaaaaattaaagcagaaaatacactttcttaaaaatctatattcctgtaagttttctcattcacatctttggagctttgagcatctgttaaaatggttctattatttctgcctacctaatctaataaaaagtcatctcttttctagcttttacttcttctcctaggccacttactccagacatcatgatgtaataccttgctgtgttcacaaaaatctagtacaaggtctta

SEQ ID NO: 199955 - DNA, 258 bp, Homo sapiens
ggaagcaaccagcaaattaactaatttaagtacatttttaaaaaaagagctaagataaagactgtggaaatgccaaaccaagcaaattaggaaccttgcaacggtatccagggactatgatgagaggccagcacattatcttcatatgtcacctttgctacgcaaggaaatttgttcagttcgtatacttcgtaagaaggaatgcgagtaaggattggcttgaattccatggaatttctagtatgagactatttatat

SEQ ID NO: 199956 - DNA, 1014 bp, Homo sapiens
actctgcagtcttcagggctggtgcccttcaccgatgcagcttcacagcttttccatttcgggtcacccttacatcgtggtcctttccccggccctggactggccaccactggacagcaggatgggggcctggggtgagcacctgtcagtgtgggcatggctgggtgaacacaagggacccttgtgtcctgcttagctattgtctgtgacctaccctggggatcagagcttcaaggttctcagaaaccttcttaatattacattccccaggcatcttatgacaattctatgcacatagggagtgtgccaacattttattgtgaaagatatctggaagacagagggagagagagagacagggagagtcaaacgtggagtttccaacttgaagacacttttatttctgagaatactgggaaagccttttcagggacagagtgacaggaagagcagggaatttatagtaaccaggtaatgctattgcacataataagtagaactttagaagatgctgggggttaagtatcattttacccatctcacttgagagctgaacacgcattctgtataaagataagcctggtcatgttttggatggttgtgttgtccacattcttttctttagaaggccagaatgaagttggcttatgtggactctaagactctaagtttcttcccagtatgttagggagtgtccgtgaagcgtttgccaatttaagaaagatatttgattgtattctataatgcatctgccggcactcatatctgccttccacatacttcattcagtcttttcgctttgattttccttttgctgcatttaggctgtttggataattgcttctctgaggtttttcagggttgtaattctaagagtttaaagagatttaggagttggcgccatttggggtcctgaattcatgctgttggctgaagctgattccagagaagcatcctaacgcctttctacaaatggttgtaaccgaatgtgaaataattaactgggaaacactg

SEQ ID NO: 199957 - DNA, 698 bp, Homo sapiens
tgctgttgtatactctggatattaattgcttgttggatgaatagtttgtaaatattttctccctttcaatagtttgtctcttcactctgttgattgtttcctttgctgtgtaaaaggtttttagtttaatatagtccatttgtctatttttgttgcctgtacttttgaggtcttagctataaaatctttgcctagactaatgtccagcagagtttcccttatgttttcttctagcagttttataattttagtcttttgtttaggtctgtaattcattttgagttgatttttgtaatggtgagagataggggtctagtttcattattctgcatgtggttatccagttttcccagcaccacttactaaagagggtgtccattccccagtgtatgttcttggcatcttgtcaaaaatcagttggctgcaaataagtggatttatttctgggttctcttttctcttccatcgatctgtatggctgtttttataccaacatcatgctgttttggttactgtggccttgtaatatatgattttttttctgtttctatgaaaaatgaaattggtgttttgatagggattgcactaaatctgtaggtttctttaggtagtatagtcattttattacattaattattctgatccatgagcatggatatctttcctcggtcctcatcagtttctttctcagagttttg

SEQ ID NO: 199958 - DNA, 397 bp, Homo sapiens
tttccaataaactcagaggcgtgaaaaggcaaatcaattttatgaacacccatgaaattggttggttgtgaccactatgggtggaaacactgagcttcagtggaatttcccttaatattaaaccaggaaactagagtccctggttatctctctgtcgtatacagcagctgacatctattcctcctggggattgggcagatcttaaagttgatgtcctaagcttctgactgggatcacagctctggataggggttgggtcaggccatcgcctttagaaaaccagttatttagcctctctttccaatgggatttctctgaaaccttgttcatgatgatgccaacttgtgtctccttgaaaaatcaaaacaatggaattaaacttgggtgttctcctata

SEQ ID NO: 199959 - DNA, 1081 bp, Homo sapiens
atgccatctgggttgttgggtaatccaggatcatctcctcagctcaagagccttcacttaatcccagccgcacaggcctgtctctctgtgtaacgtagcctccacacccgagccccaggatgtggacacctctctgtcagggccatcattcaaatctccgtggagctgctaaaagggacagaaaccctccaagctcgtctgagccatgaagtactcctggagtaaaggtagaggggcatctcatggaacccaagagcagaaagcccagtggacctcaggaagcagcgcctgagaaccagagccttccagaagccaggcatctgtccgtgcctgggtccaccccacctcgctgcccacctgtcctccgcaacccctccacagcgcctgggattccatgcctcaggttctagccaccagcagaaacggaggaactttctccaaatttccgggacaaagattcagattgactccgcatagatgagatcgtcgggtcgcctgtggctcgtgtgtgtgtctggggctgggacaggcaggtcctcacagtacacaggaggtgctgagggcccaccccagtgggcatgaacttggcagaaaccccagaacgtacctagagtagctcaaaaaccagactgcccctttcggggtgaaattcacccttcaacgactccaggctgtcacttcacactgtcaggggcagcactgagctcacgtcacatccaggttctcggggcaggcctccccccagcccctgagtaataataacacttcttagcactagcccagtgtccagacttcaaggccaggcctggcctgctgctcaaagcatgggacctgtcccctcagcaggcaccaggtttgctgtggggcatgtggagctaatcactgggcccctccggaaaggctctttcagatccacatgataaagcccccagcgtcaggctagcaggagcagcgggggaacgtgcggttcctgctgctgggaagatgggctggggccggctcaggttccaggcctcagactgcagcattgggaaacgctcccgaccccgctcccgccccacgcggatcagcctctccccac

SEQ ID NO: 199960 - DNA, 2805 bp, Homo sapiens
ttggggctcattcagggcagattatattcttgtcatttttcctcatgcagataacagcaggaaggacttaaggtgtataagaaaaagaaagtattcatacagaaattacctagcagttgtgccctcagagtagaactttgaaacaggactgaagccctttttacctagaaccatttaaaagcctgagcaaggaccaccaccccctccccaccaaattattcggtctctttctggggggcccagcttactgtatgttacaagtctttgaaatgggtctggtgtcttcagctcctgaaatgctaatttaccccttacctaaggagtgtagttataatacagagttggtttccttccttccttccttccttccttccttccttccttccttcattcattccctctgtccgtctctccttccctccttccctccttccttcctttttgtctttgtttctttctctggccccctgtcctctctctctgtctcatccccttttcccactttccttctgtctctccttcctcccttcctttacagtttaaaaaaaaaatctaaaaatagttaagcactgtgtcaaagagtgtttcaaaagaattgtttgttttctcatttcttaaaccagaagtttatgacaaataaatatgccatgtaatatgaaagctgcttcagctttttatgagctttcacattccttgtttgtccttttaatttgtttcttgatatatgaagactataaacttgaaacaaagagttagctgtcagctcttgataatataattggggaaacagaatagatattttatgatatgataattctgatgatctaaagataatgtcttagacaattacctttacatttcaagctctgggatataaattacgtagtcagcattaagatagtattatttttaattgctactaagtggtaacttttgtattttaatatcttgcaagggcaaagaaggcatttttaaaattctaaatgcacacctcctaaggtaaatagtctttcaaaaatatcaggcgtgccaactcttgctgagttttgttaaatcctccttaactgtctgcagtgccccctgacttcttttaaatggatgtgaatatatgtggaaaactaaatccatttattataaatgccttatctttaccctttgggatcttactaaatgcattttacctgctactatttattaaaaatggaagctgtcttgaattagagatacctcacgtaaggtaggttaagcagtcaagtatttctttaggcttatgttcagcacctcagccccctactgagaagttaattaattcagtccaaaatgaaattatagggcagtttggtgcaatttatgttaaatgccatttgaatgtaatcacctgtgttaccacgaatgaggcacaactatactacatggacagagtactgcattgcaccatgagcaagaactgctctgcaagaaaaatatctgtccctgtggtctgaatttatcaaaactcattttcttgttaaagagtgaattattgaatagtaattaaactttaactgatgaccatttatattctagtagccatcttcactgttagtcttaaattataatgtaaagttgacattttccccttacatttcaaaggcatcactatttttaaatgtttacatatgtttacatgtttgtgtgcaactgcttcattgctattaatagttaaatgaaatctgcatattctggatcatagatgttcttagttaactctgggaaagatgttacctttgggtttttaaaagacaagtcatcatttgaaaatatattagggtgtgttgattttctgacatgcttgtgtaattggctttgtttataatttttattttttaatatgggtcagacttttggattaaaaagtattatatcatggacatacattttttaaagtaccaaaggtatttggtaagcgagcccaagtcatgtaattgaaacttctgtacattaaaagaactgattcatgaagacgttttctaactttttctctttaagtgctcctctagactagactgattgaagtagacagtgtggtggaatcagtttaatcagaaaaagacataccaagtagctggtgctaattattataagactaacattctgataagccatggtataattaacattattaaaatgtttacatataatccttcttaaagtatactcttttaaaaatccattgacataaccttacttttagtttagtgatccagaatttccccagagcttaagccactgcagtaaattaggtacgtaggatattcagtcgctactagccacaaggagtctccttattttaatgtacctccctcagtactttattcctgcagagcgcctcagagtgggggagagaaatgagcaatcctggctcagttggattatttcagcattttatttctaaatctgtagtgtgatcagaaatatttaaaattaaaaaaatactttacagagagaggcctactaatcaatgtgcttagagaaacaaactacctttacattcaattaacaacaaaaaaagttacagaaattttaacaaacatttttctttatctgagtatgggagaaaatactaatgctgacacgtttaataattagaaaagatcattccagatcttatggaaaattgtgttttaaattccagcagtttgctcttgagacatggtaatctcttaatgtaactactaaaggagaggtagattgaaaagatcttgtatatacataattatgtcagatggttcaagatatcaaaataaattgttttgttgaaaatga

SEQ ID NO: 199961 - DNA, 2808 bp, Homo sapiens
ttggggctcattcagggcagattatattcttgtcatttttcctcatgcagataacagcaggaaggacttaaggtgtataagaaaaagaaagtattcatacagaaattacctagcagttgtgccctcagagtagaactttgaaacaggactgaagccctttttacctagaaccatttaaaagcctgagcaaggaccaccaccccctccccaccaaattattcggtctctttctggggggcccagcttactgtatgttacaagtctttgaaatgggtctggtgtcttcagctcctgaaatgctaatttaccccttacctaaggagtgtagttataatacagagttggtttccttccttccttccttccttccttccttccttccttccttcattcattccctctgtccgtctctccttccctccttccctccttccttcctttttgtctttgtttctttctctggccccctgtcctctctctctgtctcatccccttttcccactttccttctgtctctccttcctcccttcctttacagtttaaaaaaaaaatctaaaaatagttaagcactgtgtcaaagagtgtttcaaaagaattgtttgttttctcatttcttaaaccagaagtttatgacaaataaatatgccatgtaatatgaaagctgcttcagctttttatgagctttcacattccttgtttgtccttttaatttgtttcttgatatatgaagactataaacttgaaacaaagagttagctgtcagctcttgataatataattggggaaacagaatagatattttatgatatgataattctgatgatctaaagataatgtcttagacaattacctttacatttcaagctctgggatataaattacgtagtcagcattaagatagtattatttttaattgctactaagtggtaacttttgtattttaatatcttgcaagggcaaagaaggcatttttaaaattctaaatgcacacctcctaaggtaaatagtctttcaaaaatatcaggcgtgccaactcttgctgagttttgttaaatcctccttaactgtctgcagtgccccctgacttcttttaaatggatgtgaatatatgtggaaaactaaatccatttattataaatgccttatctttaccctttgggatcttactaaatgcattttacctgctactatttattaaaaatggaagctgtcttgaattagagatacctcacgtaaggtaggttaagcagtcaagtatttctttaggcttatgttcagcacctcagccccctactgagaagttaattaattcagtccaaaatgaaattatagggcagtttggtgcaatttatgttaaatgccatttgaatgtaatcacctgtgttaccacgaatgaggcacaactatactacatggacagagtactgcattgcaccatgagcaagaactgctctgcaagaaaaatatctgtccctgtggtctgaatttatcaaaactcattttcttgttaaagagtgaattattgaatagtaattaaactttaactgatgaccatttatattctagtagccatcttcactgttagtcttaaattataatgtaaagttgacattttccccttacatttcaaaggcatcactatttttaaatgtttacatatgtttacatgtttgtgtgcaactgcttcattgctattaatagttaaatacaacaaaaacacccaaaacccacacaacaaaacaaaaacacaccaaaaagaatgtttgtctttgggtttttaaaagacaagtcatcatttgaaaatatattagggtgtgttgattttctgacatgcttgtgtaattggctttgtttataatttttattttttaatatgggtcagacttttggattaaaaagtattatatcatggacatacattttttaaagtaccaaaggtatttggtaagcgagcccaagtcatgtaattgaaacttctgtacattaaaagaactgattcatgaagacgttttctaactttttctctttaagtgctcctctagactagactgattgaagtagacagtgtggtggaatcagtttaatcagaaaaagacataccaagtagctggtgctaattattataagactaacattctgataagccatggtataattaacattattaaaatgtttacatataatccttcttaaagtatactcttttaaaaatccattgacataaccttacttttagtttagtgatccagaatttccccagagcttaagccactgcagtaaattaggtacgtaggatattcagtcgctactagccacaaggagtctccttattttaatgtacctccctcagtactttattcctgcagagcgcctcagagtgggggagagaaatgagcaatcctggctcagttggattatttcagcattttatttctaaatctgtagtgtgatcagaaatatttaaaattaaaaaaatactttacagagagaggcctactaatcaatgtgcttagagaaacaaactacctttacattcaattaacaacaaaaaaagttacagaaattttaacaaacatttttctttatctgagtatgggagaaaatactaatgctgacacgtttaataattagaaaagatcattccagatcttatggaaaattgtgttttaaattccagcagtttgctcttgagacatggtaatctcttaatgtaactactaaaggagaggtagattgaaaagatcttgtatatacataattatgtcagatggttcaagatatcaaaataaattgttttgttgaaaatga

SEQ ID NO: 199962 - DNA, 2912 bp, Homo sapiens
ttggggctcattcagggcagattatattcttgtcatttttcctcatgcagataacagcaggaaggacttaaggtgtataagaaaaagaaagtattcatacagaaattacctagcagttgtgccctcagagtagaactttgaaacaggactgaagccctttttacctagaaccatttaaaagcctgagcaaggaccaccaccccctccccaccaaattattcggtctctttctggggggcccagcttactgtatgttacaagtctttgaaatgggtctggtgtcttcagctcctgaaatgctaatttaccccttacctaaggagtgtagttataatacagagttggtttccttccttccttccttccttccttccttccttccttccttcattcattccctctgtccgtctctccttccctccttccctccttccttcctttttgtctttgtttctttctctggccccctgtcctctctctctgtctcatccccttttcccactttccttctgtctctccttcctcccttcctttacagtttaaaaaaaaaatctaaaaatagttaagcactgtgtcaaagagtgtttcaaaagaattgtttgttttctcatttcttaaaccagaagtttatgacaaataaatatgccatgtaatatgaaagctgcttcagctttttatgagctttcacattccttgtttgtccttttaatttgtttcttgatatatgaagactataaacttgaaacaaagagttagctgtcagctcttgataatataattggggaaacagaatagatattttatgatatgataattctgatgatctaaagataatgtcttagacaattacctttacatttcaagctctgggatataaattacgtagtcagcattaagatagtattatttttaattgctactaagtggtaacttttgtattttaatatcttgcaagggcaaagaaggcatttttaaaattctaaatgcacacctcctaaggtaaatagtctttcaaaaatatcaggcgtgccaactcttgctgagttttgttaaatcctccttaactgtctgcagtgccccctgacttcttttaaatggatgtgaatatatgtggaaaactaaatccatttattataaatgccttatctttaccctttgggatcttactaaatgcattttacctgctactatttattaaaaatggaagctgtcttgaattagagatacctcacgtaaggtaggttaagcagtcaagtatttctttaggcttatgttcagcacctcagccccctactgagaagttaattaattcagtccaaaatgaaattatagggcagtttggtgcaatttatgttaaatgccatttgaatgtaatcacctgtgttaccacgaatgaggcacaactatactacatggacagagtactgcattgcaccatgagcaagaactgctctgcaagaaaaatatctgtccctgtggtctgaatttatcaaaactcattttcttgttaaagagtgaattattgaatagtaattaaactttaactgatgaccatttatattctagtagccatcttcactgttagtcttaaattataatgtaaagttgacattttccccttacatttcaaaggcatcactatttttaaatgtttacatatgtttacatgtttgtgtgcaactgcttcattgctattaatagttaaatgaaatctgcatattctggatcatagatgttcttagttaactctgggaaagatgttacctttgggtttttaaaagacaagtcatcatttgaaaatatattagggtgtgttgattttctgacatgcttgtgtaattggctttgtttataatttttattttttaatatgggtcagacttttggattaaaaagtattatatcatggacatacattttttaaagtaccaaaggtatttggtaagcgagcccaagtcatgtaattgaaacttctgtacattaaaagaactgattcatgaagacgttttctaactttttctctttaagtgctcctctagactagactgattgaagtagacagtgtggtggaatcagtttaatcagaaaaagacataccaagtagctggtgctaattattataagactaacattctgataagccatggtataattaacattattaaaatgtttacatataatccttcttaaagtatactcttttaaaaatccattgacataaccttacttttagtttagtgatccagaatttccccagagcttaagccactgcagtaaattaggtacgtaggatattcagtcgctactagccacaaggagtctccttattttaatgtacctccctcagtactttattcctgcagagcgcctcagagtgggggagagaaatgagcaatcctggctcagttggattatttcagcattttatttctaaatctgtagtgtgatcagaaatatttaaaattaaaaaaatactttacagagagaggcctactaatcaatgtgcttagagaaacaaactacctttacattcaattaacaacaaaaaaagttacagaaattttaacaaacatttttctttatctgagtatgggagaaaatactaatgctgacacgtttaataattagaaaagatcattccagatcttatggaaaattgtgttttaaattccagcagtttgctcttgagacatggtaatctcttaatgtaactactaaaggagaggtagattgaaaagatcttgtatatacataattatgtcagatggttcaagatatcaaaataaattgttttgttgaaaatgaatactttttggtgtcttgcttaaaaatatttttatattttgtttatctactcaaaattatgaatggatgcatttttgtagaacttaatcttaataaacatttaactg

SEQ ID NO: 199963 - DNA, 1241 bp, Homo sapiens
ttggggctcattcagggcagattatattcttgtcatttttcctcatgcagataacagcaggaaggacttaaggtgtataagaaaaagaaagtattcatacagaaattacctagcagttgtgccctcagagtagaactttgaaacaggactgaagccctttttacctagaaccatttaaaagcctgagcaaggaccaccaccccctccccaccaaattattcggtctctttctggggggcccagcttactgtatgttacaagtctttgaaatgggtctggtgtcttcagctcctgaaatgctaatttaccccttacctaaggagtgtagttataatacagagttggtttccttccttccttccttccttccttccttccttccttccttcattcattccctctgtccgtctctccttccctccttccctccttccttcctttttgtctttgtttctttctctggccccctgtcctctctctctgtctcatccccttttcccactttccttctgtctctccttcctcccttcctttacagtttaaaaaaaaaatctaaaaatagttaagcactgtgtcaaagagtgtttcaaaagaattgtttgttttctcatttcttaaaccagaagtttatgacaaataaatatgccatgtaatatgaaagctgcttcagctttttatgagctttcacattccttgtttgtccttttaatttgtttcttgatatatgaagactataaacttgaaacaaagagttagctgtcagctcttgataatataattggggaaacagaatagatattttatgatatgataattctgatgatctaaagataatgtcttagacaattacctttacatttcaagctctgggatataaattacgtagtcagcattaagatagtattatttttaattgctactaagtggtaacttttgtattttaatatcttgcaagggcaaagaaggcatttttaaaattctaaatgcacacctcctaaggtaaatagtctttcaaaaatatcaggcgtgccaactcttgctgagttttgttaaatcctccttaactgtctgcagtgccccctgacttcttttaaatggatgtgaatatatgtggaaaactaaatccatttattataaatgccttatctttaccctttgggatcttactaaatgcattttacctgctactatttattaagatcgtcgacgcggccgcgaatttagtagtagtaggcggccgc

SEQ ID NO: 199964 - DNA, 144 bp, Homo sapiens
caagaagaaagaagtggttggcagtcttggccaaaaaggaattaaggtatgaaatcagtttctccaactatgctctcacaacacggaaaacttctgtgaccaagtgtgtgtttttcctgcactcaccaagcaattctacggcaa

SEQ ID NO: 199965 - DNA, 363 bp, Homo sapiens
ttatagggatgtctcaaaacgacacaaaagccagcttaaagggactctcactggccaactcagggacaactgagcatcgaaataaataatgacagtaatattcactgactaaaataaaaacccataaaaataaaaattttctataccagattataaataaataaaggagataaagaaggtctgcctcatagtaaaatgacaataaatacagaagaaataataagagttagaaaattgtcatttggcacccatcacaataactgattcaggcaagattaatcaatggataataatactaattggtgaaaagtttgatgaagaatgggacaattatgtaacctcaaagtatcatccacaaattag

SEQ ID NO: 199966 - DNA, 86 bp, Homo sapiens
ttcccacgggagggacggatctgcccagcttggttcaggcacttgttcctgaaccagtcaactgtttcaggggtggggtcatgtta

SEQ ID NO: 199967 - DNA, 236 bp, Homo sapiens
aaatctactattatctttgccactgatacaccacttcatcttcatttcaactcatacatgatgagaaagtacagattcccctaccctgcagcaatgaaggaaagggaatcaaaacttggagggcccttgatttttcatgagtgccaggtagaacatccaaatctagaaaacatccaagaaataatgagcaaggaatataacttaaattctttggttttaaaaactttcaaaaagga

SEQ ID NO: 199968 - DNA, 449 bp, Homo sapiens
gctgtcttccctaccttggtctgatttgagaattagatggcacagactggcaaactcaaaacagaaactcacaaaactttgatatccactggatcaagtactatgccaagtcaaggggatgcagaagaaaaaaatagccatacatacacgaagaactacagtcacattaacttcaagcagatgaagcctgtaacttgctggttctataccctgaaaaaatggacctgtaaatgaatctgtttgggttaacaaggctgccaccatatagctggttttcattctctgccccatcaagctcctcaactttctgtattatctgaaccacaaagcaccatacacctccctttggacttttgtacaaaattcccttactgtaagacatgccctttgtctaatttctgatgctgaatcttgccactgggaacactgaatgtatcttcacctatggg

SEQ ID NO: 199969 - DNA, 631 bp, Homo sapiens
gcaaagtaacagagctggagaatggtggagacaggactcaaacaaaggattgcctgattctggaatccacagttttaatcatattgtctattacactagaaaaactgatgtccagagtgactgtgtgtatttagtcatgtatattgatttgtgtgtatttcgtgtgccaacaaagtttgctagactgtgacccttggaaggcaattaatgtgttttatttctctcagtatttgtagcatccattaccatgcctagtacacagaagatcctcaacagaagctgtttgaattaaatttctacagatacgtagttatccatctctataaacattcacagataaatatatacagaggacatctcattttcaggtagcatctgagaacaagttgtgacaactagaaaccttccctctctatcttgaactatttcaatcaagcttttgctagcattattccattgacatggctcttgtcaaggtcaccagtaacctccatgttgatgattccaatgatcaattctcagcctccagcttgtctgacccctccacagctttggacatagggctttcttccctcctgcaactctctctcacttcctttggcttccaggatattcctatctctttgaatgc

SEQ ID NO: 199970 - DNA, 502 bp, Homo sapiens
accaggaaggaagacagatttataaaaatgaaaaaattcactcaagatgctgatcaaacttcaaatgtgtagctttaaaaaaaaaatcaaaagcaaaaaaacaaaaaaaataaaaatttaaaaaatcacatgatcataatataaatcagaaaatctagattgcaacattgtctttacagatgcactaaatatgtattaaattaccaagaaaattcattctataactttggttgtaaaatggaaaggctaaaaagctgagatgatttaagtatttgttttttccccatgacaagtttaaatgaaggacagaaaaagacttaaaataacctttattagtagtggctcactattattagtagtggcacagtcagatcacacaatctcaggggtattgtattttcaaacgtgtcaatgtcacaaaagacaaagaaagtctgtaaacagtccagattttaaaggaagctataagaaaatgacaactaaatgcaatatttgatcctag

SEQ ID NO: 199971 - DNA, 924 bp, Homo sapiens
agcaaacttccttactgaataaggcaaaatgtcaacatagaagtgactaaataaagcaccaaattgtcaggataattcttgaactgttgttggattgtagtatttatatgacaactccgtggaggcattacttaatcagaagagctaatgtaaagtacctctgggtgacattcaaccacaagaggaaaagtgatataggataatgacgtaacaattgaagaatagaaggatgtaaaaataagggtgtgtgtggaatgctcatttatttgttagtgaaatgaaatgtttgagcatctacatgctctgagagactgaaaaggagagaacgaaaataagtggaagtaagcctctggagaagttcagagggaataaaatttgtagaaaaacgtaggtcagacttgaataggggaatgtcatgtcatcctctaaaaagaaggaaaagagggaggttggagcagaaccagagacagatctttggttatttttcttttctctgtggagtgtgaggcaagatcatataatgttaatttaaaagttgcaagtaaaggaaaaagctcctggaaaggggtaaatatttataacaactccttcagatagaatagaaaacacaccagaaaccagcaaagaagctgaaagcagcagagtatccaatggggatagcgatggatttgtaccatctccatttcatacacatacttacctggtttttctccagcaacgcctgactgctggtggttggagcaggaaaaatcgattattggcaagatccaaattgggagtaacaaataaaaagggtaggaatagaagcagttggcaagggtactcttaaagtaattgacctaggctacacagagaaggaagcaagatccagaggaagctcattgactatgagaaagtgcatatgtttatctgtatcaggggcag

SEQ ID NO: 199972 - DNA, 249 bp, Homo sapiens
ggaccagtgtttgttgacatgctacaggggagatgaggtaggcagcatgagcccatttggcccctcactctgacccccaaggcctggccatcagctctggatcactgtccctgtccttcacatggggaagggggactcttgtccagcagcggggtggtagaccagaggagccccagtgagctgggtacacactcacaccacatcccatcaattctagacacacatttcagtgtctccaaaatcaagatg

SEQ ID NO: 199973 - DNA, 690 bp, Homo sapiens
tattagttcagtgacattgggcaagttacataacctgtctatgctgcagttttctcatgtgcaaaatggggataataattatgcctacctcatagcgttattctgagaagtaaatgagttcataatgtgaaggccttagactaataactggtgcatatgagtactctatgatcactgttattacttcttttgataaaggaaatgaaaacactcaggacaagtgttgccttcaggaaggtcatattccagtgaagaggatgagtgtgcaaacaatgataatgccatgcagcaaatggtatgatagatgtatgtgtggaacttaggggagtagtcatggaagtctttgtagaagaggtggcatttgagcagtcttgaatgttttaggcaaataatcagggaaggaatacaggaataaagaacaaattactgttataacaatgtggatcaatatcaaagatactatattgaataaaagaagcaaagccaggcacaagagaatacatcctgtgtatggaatcacagaatgggcaaaactaagccatggtggttccctctggggagaggggagatattaactgggaatggcacgggaaacatttttgggtgagcaaaatgttctgtatcttgatctgagtggtgctcacatggctgtatatgtatgtaaaattttgttgaactatacacttaaaa

SEQ ID NO: 199974 - DNA, 545 bp, Homo sapiens
aaagttagaatggtttaagaatgtctgaaattctacaaatacttttcttcatcagcagtaagtgtcacttgcatctttctttcccttcgtatctcaaatggtgacagccacaaatgacagagctctggggtcagtcaaggcaaacagcttgctggagtgttggaaaggaccctgttgagaggagcccaaatggccgccttagagggcgtgggaagaactgcaaaagttgattcagctagtaatgctgtcaagacagctctgtgtctgatggagtcaggggcatgctatggtaaacagagtcagctgttgagaggatgccttgaagggtgcccagcccctggtttggtgcttacatccgatggtggtgggagcacctgttctcttgttatacagttgagacctgatggtgcaagggtcagggctggctgcagcaataatttactagatgagcaaggatgcaataatctccttggagaaggacatttgcatatgacatgtggacatgcctctcccatctttcatggtgggtggggctacaaactctg

SEQ ID NO: 199975 - DNA, 421 bp, Homo sapiens
tccgctccttttcttttccttgcagttgatttggttgaatatttttttcatatgccagcactggctggttgatatcttttaacatgttcctgtaacccttttatttcttgtaaactaatatttagatacagatattgccctgcattttgtaaagttctgcacaaagtctgcaaatggaaatagggataatttcagcctccactgtgggtgactcagctttgcgtctgccgcccttgccctctgtctcccctccccatacaaaagacttttttggctgggtacggtggctcaggttagggtcattcctgggcttgtggagaaacagaactgtgttctgatgatccccacccctcccaggggaaagttctaatcttgccttggctttgggggcctctctcatgacctgccttccatctcttgc

SEQ ID NO: 199976 - DNA, 364 bp, Homo sapiens
aattgtttcggtaactggggagctgctgtccagcgcacgcctctatgaaggcttaatgttctgtctcccgcagagtcttctttggtctgagagccacttgtttcttacatccttgtgctaatctcaccatctgctcctacataccccaggcatttgccacatgctggtcctctctttcctgacaggcgggccatctctccagcttctgtgaggacagttcaaattatggaggagggggcaggtgcagggcagcagtgctgaggggagtaccatgcagttgggggagcagggactcatttttctttgtagctcagattcctaagcctgtgactttgagtatcggtgtcttccttgcaatgtttca

SEQ ID NO: 199977 - DNA, 336 bp, Homo sapiens
tggtaaaagatgaggataaaccaaggatgtgcccgaggcaatggctggttagggttttggtgaattttatttttggcggttaggctagctgttgtcttgccatgtagactatgtaagtggataggatgttggagaggtgacgtaggggaagagagcagaatgcgcatgtttgagaggctgaagagttctgagaaaaaaggaaaagaggacaaaagagagggaagaaagatgtggcatttgtgacagggaatggaattcgggggaaagagaaagatgactacagaggagtttaacattctttatcatgtgctgtgcaatataaaccactctcctctc

SEQ ID NO: 199978 - DNA, 398 bp, Homo sapiens
ggctgagcaagactcatctgaaagaaaaaaaaattggcaagacaactatatggttaagaatttaagaacttccagtatgaccacacccaataactgtattagattgttaatggattattgtgttataggtgacatagttaactgtaaagtaacctgactcagtatagttactggtaccacagtgaggtgaataaaacaggatttttcagaagttagcctgaatttcactgtacttttaaatttaacctccattaactaagcatcttttctttgtggtagggtctaccttctgcttccctggaaaggatgaacttacatcatttgacaagacctgttttcaagttatttgttgtttgtttgcttgtttttgtagcctaaaataaaaatttcaaatacaa

SEQ ID NO: 199979 - DNA, 413 bp, Homo sapiens
atgggggcacttccttctaattcacagaagaagctatatgggccccagactgcccatcctgctaaaactggcaaaggccttttcccagcctgagcagtagtgattcagccaactgcagaagtggtatttggagctcacccttaaaacataaagcaagttatgttcagactatatacaggcaatgagaaaatatgatgaaatatgactgcgtatgaatagccccagacttctagggcctttgagtgtgtctgtcttgggcaacatcttctccttttagatttcaggctcagtttactgtcaggaaaattaagttgctgagagcgtctcagaattttggcttaaaagagaatatacacctggaacaaagacttgaggggtgctcctattaaaaaaaacaaacagtgtgtgagctt

SEQ ID NO: 199980 - DNA, 352 bp, Homo sapiens
cgattccatgtgatgattccattcaattctattcaatgatgtttccacttgattccattcgaacatgattgcctttgattccattcaatgattccatacggttccatttgatgatgattccattcgagtgcattagatgattccattcgagtccattcgatgattccattcgattccaattcgatgactccatttgatcccattcgatgatttcctttgattccctttgatgatcattccatttgattcaattcggtgatttcatttgattccattcagtgatgtttccattcaactcctttcgatgatgattccattcgactccattcgattatgatttcattcaattcca

SEQ ID NO: 199981 - DNA, 858 bp, Homo sapiens
agccattttaaattggatattgctactcgagggtcaaggcatcctaaggaatctctatcttcttacttcaggtccaatttcctgagctgactcaacattatcagcgtctctaccttgtgcctagtccttcattgacatgtctttcattaagaagcaagcgcaacataattatactcacatatatgcttcacctaaagtctgtttcttctgcaacacctctagaatggtcaaggagaaggtactttttgcttctctggtgtatttttcagttatgtctgtttttaacagcattatagatgtgccccaatttttaccttacacttcccttcttattatcctctaacaccataccgaaattacaattgatctaaaactttcaaaaccaaaatgctcaagataggataaagattttcttttctagagggtggtccacatcattaaacagagctgaatggcaaggcatcttgaatgatgaacaactgaatgtgccatactttatatataaagaaaacaaaaaacctgacctctattttaaaataaagattaagagaggcataataaataacatacaggtgagatcagaatcctaccttagtggctgggtgtggtggctcacacctataatcccaacactgggaggcggaggcaggcggatcacaaggtcaggagttcaagagcagcctggccaacatggtgaaacctcatctctactgaaagtacaaaaattaggcgggcgtggtggcaggcacctgtaatcccagctactcgggaggctgaagcaggagaatcacttgaacccgggaagtggaggttgcagcgagccgagattgtgccactcctctccagcctgggcgacag

SEQ ID NO: 199982 - DNA, 303 bp, Homo sapiens
catgcgtaaagttgctcatttaatcctcacaacaacccaggaagtagacactgttgtaatctccattttacagaagggaaaactgagaccctgagaggtttcccatctaataaacggcagatctaggatttgaacccagagcagtctagttgaatctgcctcctaactggtctctctgcttccactccagtctctctgcccttccattcgcctcccatctctactaaacatacaaaaattagctgggtgtgagccgggcgcggtggtgcatctctgtaatcccagctactcgggaggctgagg

SEQ ID NO: 199983 - DNA, 522 bp, Homo sapiens
ttttattgttttttatgtattttgtcttttttgtgtgtccaagcctatctgggaaatctgatctctgttcttttaccttgactaaaagtgaaagctctatactttcttgaatgggagagaaataggtggccttatacttgtcttggcagacagacaaataatgcacagcctctctaaataatgcacagtctctactaaaaatacaaaaaaaaattttttttaattacctaggcatggtagtatgtgcctgtagtcctagcttcttgggaggccgacgcgggcgggatcacttgaggtcaggagtttgagaccagcctggacaacatggcaaaacccgtctctactaaaaatacaaaaattagctgggcatggtggtgggtgcctgtagtcctagctacacaggaggctgagataggagaatcgcttgaacccgggaagcggaggtcacagggagccgagatcgcaccattgtactccagcctgggcaacagagcgagagtctcaaaaaacaacaacaaaaat

SEQ ID NO: 199984 - DNA, 429 bp, Homo sapiens
gttactgtacagtctgatagtcagacgttgagcagtggaggggactcgaggcatctgaggaaaaggaaacgtagatgaaaatctttcagattgaatggagaagttactgagatagaaaatactggaaagggccaggcgcggtggctcacatctgtaatcccagcactttgggaggccgaggagggtggactgcttgagcccaggagttcgagactagcttgggcaacatggcaaaaccccatctctaatctccacaaaaaatacaaatattagccaggcacggtggtatgcactggtagtctcagctatttgggaagctgaggtaggaggatcacttgagcccgggaggtcgagattgcagtgagcaaagattgtgccagtgcactctagtctggatgacagagtgagaccctgtctaaaaaaaaaaaa

SEQ ID NO: 199985 - DNA, 711 bp, Homo sapiens
ctactaaaaaatacaaaaattagccgggcgtggtggcgcacgcctgtaatcccagctactcgggaggctgaggcaggagagtcacttgaactccagagacggaggttacagtgagccgagatcacagccattgcgctccagcctggaaacagtgagacttcgtctcaaaaaaaaaaaaacatgcttgtctgctggttcttccttcactgtaacagaaatatctagggcttttttttttttcattgttgttcttcctttatctcttatgaggctttccaaaaaagattttgttctaggaatggaataaactgtagggcgtttaaggcttcagaggtaattttgggcaacctggagttgcaggtaatcacaggctggggctggaattgaaaatgcagtctcacccataatttgagcctcttttgtcgcattatggggctgtgccttggacaggcagcagacgcagatggagatggaaccctgactactgagagagctttgcttttaacatagtccttttctgaattaccaaggccaattgggaagaaaggacttgccgatctttccagctctccatggtagccatagaatttaggaagatttacagcagaacgtgggcatctagggatttctttcttccttttcttttttttaaattttaaattcagaagggaatcttgggctcttgagtgttattctgtggttagggattgc

SEQ ID NO: 199986 - DNA, 521 bp, Homo sapiens
caatttaaaaacagtcatgtagaataatgatgctattatttataatgctcatttgattctcacaatcttgttaagtggacaaagcaaatatcaccatcctgtttgctgaataatgaaactgagtctctgggaagctaactggtaggtctagaacccgtccagttatctttcctgtgattcctttacctttatcatcatcatcgtggtaagcattacattagacttagctatgtgccagacgttgttttagtattttacctgtattaactcatttaatcctcttaatagaggattttttgagtttgttctattactattacccaattttccaaaaaactgagacacacagaggttaagtaatttgtccagttatagagcttagtgaatggtggagccagaattcaaacacaggtagtttggctctcaatatagtctgtgctcttaactaattcactatatttgtctctcaaatatccaaatcacatttctatgaaagttgtgtattaaaagttaatagattt

SEQ ID NO: 199987 - DNA, 1113 bp, Homo sapiens
ctcccaaagtgctgggattacagatgtgagccaccgcacccaggctgccatcctttttaaggttgaagaatcttccattgtctggagagaccacatcttgtcatccgttcttctgttcatggacacttggttccttcccccttttggctattgtgagtaatgctgatatgaacatgggtgcacaaatatctctttgaatctagagaatatattttatctttgccagtaagtgtacccaaagggaagggaaatcatctttgcctggggtgttctgattgtgcctacatgtggcaggcgccctccaagtgagagcagagaaaaggatgaaaagaggaatgaaaagaagaatgaaggttggttgggagggttggggtgggggaggtgaatacacactattgagtgctccctagaagcatccccttatggaatggaatgatttttacatgggcagcccgaaaagcagaggcatctcctagaatttcatccaggtaacacccctccaaatacactcaaacagaagcatgctaggacatgaggaattacaacaaggctatatatacacacacacacacacacacacacacacacacacatatgcatatatatacacatatacatacatatatacatatatggacatgtatatacacacatatacatatatatacgcacacacacatatatatggtctggggtgtggtatatatggtaaggggtggcgtgtcgagagaggattggctcttgtgccaggctggagtgaaatgctgagatcgcggataacacaaacctcagcctcacagggtaccacgagaattctccgagactcagcctccgcgagtaacggagactaccaggtgtccgcaacacgcgtggctcatcggtctcgcggagacagggtccacacaggccaggcgggacaacaccccaacctagatgacccccccgggcaccacaggcggggcataaggagacacactggggcaaacaggaacgcaagccagcctggctgcgtacatctagggccccaaagaaggtcggggtggtgcccacaggaataggagcagcaacaccggtggcaaagactatccaagccaagtgcgccgcgccacacag

SEQ ID NO: 199988 - DNA, 325 bp, Homo sapiens
cccccctcactggataggagctaagtatagggttccaaaagcatgtggcaggtactggtttttagtccgcaggtagctgggacatgcctctccttttccaccctacagaacatccttcagttgctaaatacagggaacttgtggagatatttaggcttcagcgagaagaaaagttaggtagcagtgagttccacattacttcatcaggccaccacaatactgaccgtatttataacctgcctcttctcttaacacttgctgtatttgcagctgggagaaaataccagaaggagagatgattgttgagaggggccctgcctgtgag

SEQ ID NO: 199989 - DNA, 499 bp, Homo sapiens
tatacgtccacacagagttcaagaaaactgagaatagactcacataatcctgaacataggtcaattttgaattccagatggcaagaataaagagaatgaggcagacagtaatggctaagtgatttccagaattgaagaaaggcccaagttctccagctgaagatgttcactgagtcctaaataggatcattaaatagaaatgcacacctgggcccaatgttggacaacaaaaaggcaaacaaagcatttttaaagcaaacacagaggaaatacaaattactacaataaagagagaggggaggaaggaagaataggaagagaaagaagaagaaatttaagaggaggaggaagaagagaagaaggaagaggaggaggaggaagaaaaggaagaggaggaggaaaaagaggaggaggcagaggaggagaaggcggaggaggaagaggaggaggaagagggagcagaggaagaggcagaggaagaggaggaggacccggcgga

SEQ ID NO: 199990 - DNA, 397 bp, Homo sapiens
tataagggtaacactaacctcataaaattaattagaaagtgtttcccctcttctataaaagagattttattgaattggtgttaattctttaataatttggtagaattctctagagaaaccatctggcctgaaggtttccttttttgaatatttttaaattattaatttcattttcttaattataaagcaattcagattatctgttacatattgggaaatgtggcagtttgtgttttttgagaacttggttcatttcacctaagctttaaaagttatgtgtgtagagttttcatggtagtttcttatagccctgcaggggctattaagtctgcaggggctacagtggcatccctcattcattcttgagattgataattgagtcattcctatttttttg

SEQ ID NO: 199991 - DNA, 799 bp, Homo sapiens
gttggagttccacttccctttgtttagacctcagatctaaatgtcctcctgagcaagaggagaggtggggagggaggcagaggggcagggagggaggagcagatggctttgctgaaatcagagaggaggctcaaagtgccagaaaggtctcagattagacgcagggagtcagttacctcgtggctgattccttggggcaggggaggaggcagaaaagagtggcatatttattgtacagcaagagacagaaattagaaagtcagaaaatagatttctccagactttggggtgtaacagaatgggcaggtgtggggaagggaccagaaatgcccagtgacccacttgatgtttctggaggagaaagcctggagcagaacaggggcaggagcaaagccaggggcagagcaggacctagggaccctcttcttccttctgtggctccacagagcatggggtggacacaccaaaggggtggtggagctcagatgaagctatggcgtcaagagccctgggtctgttatgaccctgtgctaactagttgtgcaaccttcagcaggggaaccctttttctgtgacactggtccctccattccttatgcatggagataatgcctcatttgcgcacagggtctcattgcacacaaatgagaccgtgcaagtgaagggctttgaaaagcaatactgctggggctagaagggacttcagagacccttgatgacagagtatttggctcaactaaagaggaaactgaggtctagagaggggaggtgacagggagccaaaggcagtcaggcccag

SEQ ID NO: 199992 - DNA, 517 bp, Homo sapiens
atgattagataaataatgtagcttctaactaggtattttcctttggaagaattggacatttaagcagaggcatgaaggcagtgtgagggcaaggcacgtgaacacctggaaagcagtcacttggtccccaggctctgaggcggcggcatgcttggcatgtggaagaaatagcaagaaaaactgggggactggagccaagtgaatgagggggaggaggtgtgagggtacatgctcctgagaaatgcatctgtgctttctgtgttgtcaaaatctgatttctaagcctgcaaggtcaaaggctagaccttggacactggtaaattcaccaaagcaataaatcctgtcctatgagacctcttggaagatggtcaacctttgccatgtaggacccttcccggatatcaggtggacaggcaggcttctgaatgtatgcccctcattacctcttggtagccttatgtcacagttaattgaatattgtcatattgtattattcataatacattgttattaaagt

SEQ ID NO: 199993 - DNA, 620 bp, Homo sapiens
gatttacaggttgtttactttcctacagttactggtttgggtaattaatgccacataaaacataatggaggccatcattaccagtgagaaaggagggctggatgccaactgtctggtaataacggtagatgcagaaagcacaatcctgaactcatcgtgcccagcacacacggctgaccttgtctcttgcacatgtgcaatactaggcaagtgtctgttgacacagagcgctcacacagaagaagatggtatgcttcagggaaaaggctttgccagcaacacaccctaatcctgagcctgatggactatcacctgcatgaccttgggcagggcatttgaccttctttttgcagctgcttatgaatgccacaggctaggcatcatgtctggcgtaagatgaatccaagtaaacacttggaagatagttactgggggctccttagagaaaggactgtttacagagctggggcaggcagaatacaagatgagacttaagcatctgtagtgccaaaaggtgaggaaatgctcaaaaaagaatgaagccatgtcagagcaacacaagcaccaacccaaaggagctctcgatggccacagctgaacaatgtaaacaacacaataaa

SEQ ID NO: 199994 - DNA, 395 bp, Homo sapiens
ccccattgaacacacaagattatcagatgatagctctgaaaggtaatgccttaggagcagggaccaggggctttaccaacattgaacctgaccttgattcagcttagtcactgatttggtaaaggtgatctgcccctacttgatctgcctaacagagaaaacagtaaattctctctgagggaagatagcatcatctggagccttttaaattatttatacacaattggatggcattcattgaaaactttctaggaaatataagagatgaggccatatgactgaaaacctagaaggaaaaaaacagacaataggaaaaaacccatgggtgatccgaatatataagttagcagacaatgcatttctaacaactatatattcagataatagaggaaaga

SEQ ID NO: 199995 - DNA, 185 bp, Homo sapiens
ttatgttggaagtgttgtaaagggttggaaacagtgctccatctccagcctcgtaaacagaaaatgtcaccacgtggtgagcactggcatccaatgggcctcaccctgtgcttttcagcgcattagtacaaaatgtcatgtctcactgtcctggagcagtgactttcaacatacctgaggacacg

SEQ ID NO: 199996 - DNA, 278 bp, Homo sapiens
tacagaaagagatcaatcacttcttggccttttggctaagatcaaatgtagaaagaaatcagtttggggagtatgtatccctgagaaggtggtaaattctgatgggactatggaagttcagaataccaaactgaactgggaggatagctgtgaagaaaaaagtcatattaagggagacagtgcctcaagattctaaaaggaaagagaacccaagagaagttgagactggaattaatggactaggggtataagggagattttggaaaactgagttaaga

SEQ ID NO: 199997 - DNA, 354 bp, Homo sapiens
gctgggactacaggcacacaccaccatgcctggctaatttttgtattttttgtagatgcagtctcgccatgcatgttgcccaggctggtctcgaactcctggcatcaagtgatcctcactcctcggactcccaaagtgctgggattacgggcatgagccacggcaccgggccaacaacctttgaaacatatataatcatttacttgccttctacggatgtggaaacgggcacagagaggttaagcaacctctccaatgtcccacagccagtgcaaggttgggccaaatttgaacacagggcagtgccgtgagaagcccttggtctgaactacacttagactcctcttctttggt

SEQ ID NO: 199998 - DNA, 363 bp, Homo sapiens
tcagctctgctaagccagggttctaaagctgctactctcccccatgacaccctagatccccatttcaaacccagctcgccaatcagccttccaaactccttagattctcaactaatcaccctctgcagaagcacagcagaccaccagctctgtcttcttcagaagtgtaaagacacactgtccacacgggacttggctctggccaccactcatgaagatccatggcagagcatccgcgcagacccttggggcctggcctcatttctcaactcctcccatccactcacacttctactccttgttagtactactcttataagcaaactcacaagaggtctgggtttcggttctgatcatttggct

SEQ ID NO: 199999 - DNA, 309 bp, Homo sapiens
aagaaggagctttggcaaaaagaaatgaaagaactttatcatcagaagcccaacagttttgcagtattgaagagctgttcaagagaggtagggacttcctctcttgaggactgggtttcacgctaagcaagtgagtgaggacttcaaacgctgagattcagatttttgtattagtaattcatggtatagtcccagttactcgggaggctgaagcccgagaatctcttgatcccgggagaagtatgttacagtgagccgagattgcaccactgaactccagcctgggtgacaaagagagactccatttca

SEQ ID NO: 200000 - DNA, 509 bp, Homo sapiens
ttcaagcaaaggatgaaggagagaaacatgtcaagaagggtctcattggggaatacgagtgttgtcttgtagtccatgaaaaaacaggcagttactaagccgagaattacctgaaacaattactctggcagcagtgaagaggatgaagggaagtgggagagactggaggaagggtagactgagagctgacagtatccagagaggagatgaagggcagtgacagaatgacatttatgactaggtagagggtggggacatttataaaatggccctgtggtttctagcttggtagagtggggaaatggtgagtcattagtcagtatgagaaataaacacagagagatggaacgaacaaaggaaagcaagagaaataagtttgtttgtatacaaggtccttctgagtcatgtgaagtagatggtatggattggatagggtgcttgttagaaaagtggagaatggcatgagagatttgggagcgtgtgagtaaaaccatgaggacataatccag

SEQ ID NO: 200001 - DNA, 370 bp, Homo sapiens
tctcatagttactgagtcagaatcttagaagtgaagtgggactaggaatagcatttgaaaaactccccaggttactttaagcacaatgccaatgagaacaactgtcttgggtttttctgtcacccagtgacagaatctgtcagatgcttggagaaaactcttgctagtagatctggaaaacatagaatgaacataaagcatgcatcagagaaaggacagtcatgccatgccagagataaactatttgacaaaattacagacacaaaataatacatgaagttagtgagaaatatcccttagaacacagtacctaagtaacaattaaaactatttatcacagcttttcttttttccagagtgagttggtgaa

SEQ ID NO: 200002 - DNA, 557 bp, Homo sapiens
tacgagaccactgttgtacatgtggtctgtcatcgactgagacgtcatggggcacgtgaccatatcacatgttttagaatcaagattagactctaaactttccaacaaccctattgtcctgttacttgtttcagggctcaaaacattgttgaggctgtggcatgttttgtgctatataatctgctcctattccctgagatttctcttgtgaaaaactgtccatggctttgttcttgggcatgctgagccacaatgtggaactttcccataatttactatgccagtcactgcagcccttctgagaggctggagagaactctgtttctttttctgttgttttttttttctactgatattttgttaaaaatgtaggtagactttcccatcttaaactgatagcaaaaagaagaggcaaataacagaaggaactatcaaccactgttgttgtttccattcatgcttattctttatgaaatgtttctgtgcatggagggaaaaaggctctgagaatacagctagaacccaccgtgcccacggagacactggctgtttcctgg

SEQ ID NO: 200003 - DNA, 235 bp, Homo sapiens
ttgccaaggtgtgccccacacagtgaggggtggggaaggagtgggtgttggccagatgtgggccctgagttttgaaagtatagccggcagtttggcatggtgtggtgggaggtaaaggcccatacccactatgctggtcacaattaatgaggggcgtgtgtgtaggaccctagagatttctcctgagatccagcccaatagcattccaggttaggactctcctttgggggtaggg

SEQ ID NO: 200004 - DNA, 294 bp, Homo sapiens
agactgatcttctgaactcaagggatccacgtaccttggcctcaccaagtgctgggattacaggtgtgagccactgcccctggtctcagatttgtatttttaaaaatttactatgcccccagagggggatggatcaaaggagagctagcttgcaggcagggaaatggttaaagatgttagtggtgtaaatttgggtaaatgctgtgtgactgggaagtagcagaagtgagggggatttaaaattgtttaagacttgatgattcagcctgggcaacatggcaaaaccccatctct

SEQ ID NO: 200005 - DNA, 458 bp, Homo sapiens
agcatgtttgtttctctctgcctgttcctctagaatttgaaaactaactgtaattgtgtctctgtactacgtgacactcccattggatgcatcctccaatctggaaagagttaatttcctaaaccttaaactggttggcttagtattgggctcaggggaagggaacccaacagtcatgaaactggagcctctgatgattgtcccttctgctgggaacccttagataggcctccgagggagatctgactgccgtttccccaggacagcgccacctatcaacaggaaacagtgacaacagtgaatagcagaaggaagaataatacaatttttaaaaaggagactctagagatgtcacaaaaaaggatataagtacaagagtgagttttctctgcaaaatgtgtgtgaaacttaacagtcacattaattatgtcacatatattatgcaaatacaatttaaa

SEQ ID NO: 200006 - DNA, 294 bp, Homo sapiens
ttttgtatatagtctatagatggtaagattaactaaaaaagtcagtactacgtcccagcactttgggaggccgaggcgggtggatcacgaggtcaggagatcaagaccatcctggccaatgtggtgaaaccccgtctctactaaaaaatacaaaatttagctgggcatggtggtgggtgcctgtaatcccagctacttgggaggctgaggcagaataattgcttgaactcgggaagcagaggttgcagtgagccgagatcgcaccactgcactccagagtaagactctgtcaca

SEQ ID NO: 200007 - DNA, 141 bp, Homo sapiens
acgagtggaaacgcggcatttaatattattcggaaaatgtaatgcaaactcatgtacttggaacagcacttcacgatataattctactactttcgacaaaacacataatttcagcaccttttccactattataaagagaag

SEQ ID NO: 200008 - DNA, 283 bp, Homo sapiens
taaggatgagtgtgatgatggtggcagagatggaaaggactgaacaggaagtgaactgaacacctccaatgaaagccatgtttattattgattaacaaaatcatggaaggattcttgaaattttcgtttaaaatcaaaagagcttgtgttgacctataaaatgtatttatttatttagagatgtagtctcgctctgttgccaggatggactgcagtggcacgatctcggctcactgccgcctccgcctcccgggttcaagcaattctcctgcctcctcctccc

SEQ ID NO: 200009 - DNA, 376 bp, Homo sapiens
tttaatcaacacatacattattctgttctgtatgtaatattgttcttgaatattaagcagccagtgattcagtaccatctggcacttcctggttaagcacagctctgatacagtaagaatgtgtcaagagtccaggaaagcagtttccaatgaggacaatgcaacagagtgaatcagacaggctaggtaggagtgggagaaaagacacactcttccttcacccaggatgaatgtccatgcggactataaagatgcactttctgagtgctatggggggatttttgtttttgttttttatccctcagtaatgatgcaaagtgtgggagagtacatcgggcttagatgacaaaacatccacgactcacacagaccaaac

SEQ ID NO: 200010 - DNA, 405 bp, Homo sapiens
gagatggggtcttgctctgtcacccaggctggagtgcagcagcataatctcggctcactgcaacctctgcctcccaggttcaagcagttctcctgcctcagcctcctgagtagctgggactacaggagcgcaccaccacacccagctaatttttgtatttttagtagaaacggggtttcaccatgtcgcccacctcagcctcccaaagtgctgagattactggtgtgagccaccgcgcctggctggaatgctcattttttacaagcagcaaaacattcgaacaggagaggagcagatgaagtgactgacttctccctctccttccagaacctgcattgtcccagctctttgtcccaactgtgcacgttagtataaccaggggagctctaaagctctcctctcttc

SEQ ID NO: 200011 - DNA, 659 bp, Homo sapiens
ggcaaccaaagcaaaaatggacaaatgggactgcatcaagctaaaaagctcctgaacagcaaaggaaacaatcaacgaagtgaagagatagcttacagaatgggagaaagtatttgtaaactacccatatgacaagggattaataaccagaatatataaggagcccaaacaactcaacaggaaaaaggtctgcatagacatttctcaaaagaagaaatacaaatggtcaacaggtatatggaaaaatgctcagcattactaatcataagggaaatacaaatgagatatcatctcaccccagtaaaaatggcttttatccaaaagacaggcaatcataaatgctgacaaggatatagagaaaggggtagaatgtcttcaaagctcttctcagcctttcattcatctttctgtgtgcttacttttaagtaagcacatacatttttgacttctcctgtcacttccattgtgatcattctaaaataatgtatctctagtcctgacttgtggtccagtactattgctagaaaaagtttctatttttagtgcatcaaaattgttataacacaagctgatctttctctactcccaaatgagcaacatttcccaatgactttagctttagtacctcctcttgcccaatctcccaatgaaattataaa

SEQ ID NO: 200012 - DNA, 433 bp, Homo sapiens
ccaagttgggcctttgctccttgtgatttcagtgacacattttgtccccacttatctccctcagctttgtagtgagtagttaattgtctaaatgtttgtttcatctacttcataagtttctttacaagaggaacctggggccgggcgtggtggctcacacctgtaatcccagcactttgggaggccgaggcagatggatcacttgaagtcaggagtgtgagaccagcctggccaacatggtgaaaccctgtctctactaaaaatacaaaaattagacggatgtggtggcgggcgcctgtaatcccagctacttgggaggctgaggcacacgaactgcttgaacccgggaggcagaagttgcagtgagccgagatcataccacagagattgtgccactgcactgagattgggtgacagagcaagactgcatctc

SEQ ID NO: 200013 - DNA, 438 bp, Homo sapiens
ttcatcagccaatgctgaatgcattagagcttttaacttagaaaatggaggaaaaatattccagaataagataatataagaaaccttttacttgggccgtcttgtcatgagaatgccatggtggtgggtgtgggcatagcttgaagggggatatagaagaaattagagtcttacagaactgtggcttataattgtggaagttttcctctttgagttcagctctgactgagacattgcctaactcccaaggcatgctgacttccacatagtcaatgacattgtgtgggtgtgtgattttgaaagctagtgttttcctcagtatctacaaagatgatggctactaaaacagaaaaagtgacctagaataaagaacatcgcagatagcatgtagggccatcataggggccctctaaatttggagataaaaatcagtgactg

SEQ ID NO: 200014 - DNA, 441 bp, Homo sapiens
attttagtaaacagatgagagaataatccagtcagaattcccagaatccacagttctgtttcttccaatggtagaaaaggcaatgcagcatcataaagctagaaagaacttctgtcccgtggcatcaaacagctctgcttcacttaaattgtccccataaatatactattcttctatttaacgtctctgagcagaaaaccctgcattccatcaattaccatacatacaggctcttactaccctaatcaccaagaactctcaatgtctaagaacattttaactctaacatgggttttgttctttcccttgcctcaatttgagcttgaaatagagaatatatctgtcaccgcagaaacatactatcattatgcctccaaagcagctaacaaatattagcttgaatgaacaaccaaataaatgttcacagtcatatacttggat

SEQ ID NO: 200015 - DNA, 282 bp, Homo sapiens
ctgctcccatcagtgtagttcaagtccagagcactcattgtctagtttgacaggttcagcatgcttgaataagctgcatcaaggatttacagtcatgctttaacccaggattgtgttcagtggctgagagcagtgtggcagggtttagagccatggtggtttgtagggtgatatttggatcatataagaggatggcctggtatctgcccactcaccccacagtgagccagtagcctcccgtttgttctagcagagtcagcacctgatggggtacaaacaagg

SEQ ID NO: 200016 - DNA, 1149 bp, Homo sapiens
gtttggacagctgaacgaataagcagcgatgtgatagagctccaggctgttcacaaagagataaggataaccgagatgttgccagttgaggttatcgaggacaccaaagagaaaagaaccatcatccatcaggctatcaaatctctgtttccaggattagagacaaaaacagaggatagggaggggaagaaatacattgtagcctaccacgcagctgggaaaaaggctttggcaaatccaagaaaacattcttggccaaaatctaggggaagttactgccacttcgtactatataaggaaaacaaagacaccatggatgctattaatgtactctccaaatacttaagagtcaagccaaatatattctcctacatgggaaccaaagataaaagggctataacagttcaagaaattgctgttctcaaaataactgcacaaagacttgcccacctgaataagtgcttgatgaactttaagctagggaatttcagctatcaaaaaaacccactgaaattgggagagcttcaaggaaaccacttcactgtgtgttctcagaaatataacaggaactgatgaccaagtacagcaagctatgaactctctcaaggagattggctttattaactactatggaatgccaacgatttggaaccacaggtgtctctacgtatcaaggttcggcagaggtatactacacaattcctgtgcagaagtcatgggttcatatatgaaccgcgggtctggagattaccagagaataacaggtaaagggtattacataggtaacaaaagtatgtgtggcataacagggtaacgacgacaaggagaaaagaaataggagggaaaacacagattccagaggaaccggatcaatggagagcaaggacacataattagaggaagaaaagagcaaaaaaaacaatactaaagaagggaagaaagcacaaagacagataagaaagagacaccaaccgaaaaagaaaagatgagagtacgaaacgaacgccaaattagacaagagaggacgagaaagacgaacaaatatcgagacaagaaaaaagatgtaggcatagacagcaagaaagtagatacgaagaataagaaaatgtcatgtttccttctctatcctctctcctctcttctatgagg

SEQ ID NO: 200017 - DNA, 621 bp, Homo sapiens
aaggggtttgcagtgggccaaaatcataccactacattccagcctgggcaacagaacgagactgtctcaaaaacaaaacgaacaaaaatcaaaagctctactccataaatcagttgcatggaaaaacatttggaggctccttgatcaaagatttgatgtgtgtgaaagtgttctgaagacagtggagtgctgtgcaattgcacaccactgtgttctggtgacagtaacacccaatgttgagaaataactctctcacctcttaaaattcgagttaaaaagtgtataattgaacagttcttagaatattcagagctgtggaactatcaccactatctaattttagaacattttgtcaacccctgaaaaaaatcccaaattcattaaccaatcagtcaccatttcctcctctccctaacccaaagcaactgctgatctgctttttttcctctatggattagcctgtttcagacatttcatgcaagtggaatgatacaagatcggtcttttggcttttttcacttagcatcatgttttcaaggctcatccatcttgtagcatgaattggtacctttcccattgtttgaatgataccgccattgtatggatgtgccatgttttgtt

SEQ ID NO: 200018 - DNA, 333 bp, Homo sapiens
tcatctgtattcagcagtagtatacacctgtaatctctctgttttcatctcattctccttcccctgtggctagaatcatgctcagaaataaaaggaaattaatgctttccctggattctgttattttttaaattgctctccaatggttctttttccagagttctctaaaggaaggctattcccttgctattcagagctgtgtccaaggaccagcaccaaaaatcacctgagtactcatgagaaatgcagactcccatacctgctgaatcagaatgtgcaccttccagaagctcttcaactcattcatgacaatttgaatgccctgttctacac

SEQ ID NO: 200019 - DNA, 446 bp, Homo sapiens
caaaaaaaaaaaaaagaaaaatgtaattgtgttttaaaatctctcgtgaattagttatgtcttaatgtcattagtcacattttcatataaacagactgtacaatatggtttactgagaaaaggataatgactcaaaatgctgagaattatgttgtagcatcagttcagacactgatgaaccatgtactcctgggcaagacatttcccttctctgtgcctcacttttcccttgtctgaaataaagagttgtgttagttgagtgattttcagttttcagattggtctctgtaagatggtctgaggaggactaagcagaggcaggagaggggaagctcgggcagcagaacagtgattttctctccctaattcttcccacgcttcacaacagagaagcttgacatttatgtgctttatgtttcttggggtttcactcaagatttgcttgg

SEQ ID NO: 200020 - DNA, 422 bp, Homo sapiens
tagtccagggcacaagctcaccaagaggctgagaccttggacttcggagactcagaggggtgaagatgggcgggagacgggataaaaaactatatattgtgtacaatatgaactatttgggtgatgggtacactaaaatctcagacttcatgagtatataattcatccatgtaaccaaaaaccacttgtacccaaaaggctattgaaattttaaaaaataaacttttaaaaaaaactacgacctaatcagaggactatacaatgcttcccttctccccaccccttaccacggcaccactaaaggcctatttgctgcagttctttttacttagtacattatgtccttctttcagcaagaaattacaaggcaaaaaaaaaaccctagtttgaagaaattgaccaagtatgagaatcagagtcag

SEQ ID NO: 200021 - DNA, 423 bp, Homo sapiens
gcctatattggaactgtggagcacgggtgtgtcggcacaggcatatcagctaaatagacagaggcgtgtgtgttaggaacaatcaagccatccttctttctaattcctctaaagcaaggggaactcttaggatatccagtttataatgaaaatttaaaaaaaaactaaaaaaagcataatcgcaaaaatgacacaaatgtcaaaaaaatgtagacataaaagactggaaagataataacggccgagctgtcatagaaatcacagctaaaatgcgcaagttagcccatgttccagttcagacttgctccagataatccccggattccttgtttagaggatggttctcaacctttaaaagattcaaaaccctcattggtgggtttttgtttattcttggaatctgcctcatcctcccttgacttt

SEQ ID NO: 200022 - DNA, 123 bp, Homo sapiens
gcatcgttcctcagctctttttctttcagtgcctgcttcttattctctggaagatcttcttccactggctctggcttggtctcctttttgggaaggggtggtggtgaaggtgttgcaacctgt

SEQ ID NO: 200023 - DNA, 476 bp, Homo sapiens
agcattcaggatcagaatccatgccctatagaagactgactcttagtcaatgtgggaccttcagggaagtcctctactattcctttaactagttccagatattctatggttgaaaaatggtaaaatatggctaaaagaattattgccttctaaaagcaaaactggcatgatttgaggagaaaaagcatttgatttggaatgcagatatttgagttttagtatatgtcttaccattagctctgtgaacagaggcaagttactgtgcattttggtgtcctgaactgtaagacagggttaatatttttcttataggtttgctgtgagattaaaatgaaacattatgcatgaaaacacttttaaaatgagaaaatgctatataaaattaaggtttgatcgctattaagacaggagtttttcttacctgagacttcttcaaagaatatggcccttaactaagaataaactgcttgaaatta

SEQ ID NO: 200024 - DNA, 540 bp, Homo sapiens
tagcaaaaccccgtctttacaaaaaatacgaaaattaaccgggcatggtggcacacacctgtagtcccagctactgagaaggctgaaatgggagaattgcttgaactgaagaggcggaggttacagtgagccgagactgcaccaccacactccagcctgggtgacagtgagaaccctgtctcaaaaacaaaacaaaacaaagaatccctgttgcctcaccatacttcatgcatcctacccctatagcacttctgatgaaattgcgtgccgtagatttagcaatttagagaattctagcttgtttgtatgggtttaaagtttgcatgacatttatgtttctattgttggtctaaagttagcccagagattagcagggagcagcaggctcagagagttgtcttccttctttacttggtactgcatctctaggcttggtagctcttcagtaaatactctcaaaaaatacttatttttaagaagacatttatgtgatatttataaacaaattaatcctcagtggttagaatatgcagtgaaata

SEQ ID NO: 200025 - DNA, 324 bp, Homo sapiens
aaccaccatcaccaacttttatatagcatgtactgtgtgtcaggggctgttctaagtgttttccatttctaacttacaatccttcccaaaacccaggagggaggcattatgagccccattttgcagatgagaaaattgggactcagagatgctacgaagtggaggggccaaaccatagcttaggatttctcactccccttccagcgcttcctttggtggcccatcctccccctttcattcaacagatattaatggtgactggtgctgtgttgctaatgcttgggagtggggatggcaggaagcagggttgggcggtcctggcca

SEQ ID NO: 200026 - DNA, 336 bp, Homo sapiens
aaagtggtggggttgcagtggggagggaaagaaagggctagaacaaggcctagagtacaggaaaagctcaattatgacagctatcagttttaaaaaaataaggtgcgaaaaggctctgtgtagcgaaatgatctccagatattacatgaaaaaggtgaggtgtaacaggaggcagtgataagaatttacatttttattataattgcataaataaacattaaatgcataaagaagaaactaataattatttctaagaggtaggacaggggacagaatagtctcattcatgcttgcatataccactgtaacacaataaacacacctttacacaaagga

SEQ ID NO: 200027 - DNA, 493 bp, Homo sapiens
tcttacatttttctgcaatttggatcatattatagactaaagtacagtatctcctcttggttgttttgttgttattgttttatttagtgagtccccaaaatatcttaagtgccaaagggagagagaccaccctagcatttttttttataattatgcaagattggtgtgtttgtgcctctggtacatttaaaactaaatggaggctgggtgcggtggctcacacctgtaatcccagcactttgggaggccaaggcaggcggatcacctgaggtcaggagttcaagaccagcctgcccgacatggcgaagccctgtctctactaaaaaaatacaaaaattagctgggcatggtggcatacacctgtaatcccagctacttgggaggctgaggcagaaaaatcacttgaacctgggaggtggaggttgcagtgagccaagatcacgccattgtactccagcctgggcaacagagtgagactctgaatcaaaaaaag

SEQ ID NO: 200028 - DNA, 364 bp, Homo sapiens
ttctatttcaatgactcctatgaacattaacttgagaagattgtaattggaagcaattctttcagtgctacagaatttgtgtgtgtgtgtgaattactatttttttcttctgaatacaataagagcctgagattttaggctggaaaatggcttcaaaatcacagatctctagcagccattcctctcctagccctgagaattttctccagtgttcctaggcttgtccttacactgaacaaaggcatttctcagttcattctttaaagatactatttagcaaatggtccagagcattcaattgctactttgagatgctcgaaatgcaaaattgatgtggggaatgcacagctggttctcagaaggc

SEQ ID NO: 200029 - DNA, 374 bp, Homo sapiens
acatgggaggcagaggttgcagtgagccgagattgtaccactgcactccagtctgggcaacaaagtgagactccatctcgggaaaaaaaaaaaggatccaatctgaagaaaataaagaaaaaagagaacagaaactcaatgtcttatggaacaatatcaaaaggtttaaatatatgaataactgatagaagaggaggaaagagagaaaaggataggagcaatgtttttaaaaataatgacagaagagtttagcaatttaattaaactgaaaaaaaacaaaatttggggccgggcgcagtggctcacgcctgtaatacagcactttgggaggccaaagtgggcaggtcacctgaggtcaggagttcgagaccagc

SEQ ID NO: 200030 - DNA, 162 bp, Homo sapiens
cagaccctctgtgacaataacccttcctgcagacaaaagcagaggagtcatgaggcacaacacgcctcattccaggtgaactggagacaatgtgttccccagcagcggcagcggcttctgatagttggcgctgactgtatgcacgtggggtatggggctggg

SEQ ID NO: 200031 - DNA, 337 bp, Homo sapiens
gtgagcctaccggacttcctggtgtgttgacaggaggagatgagggacgtcagaaaatcagtgcattgtggagtcacttttctgataaagggcacatcagactgcaaatggtccagacagccagattcaggacactgatgagtttctggggtcaccatagcatccctggagtcagctgctctgcagcctgaaggagggctgacagtgtggagtcactgctattacttaatgaaattatatagaaattctataatgattatgtaattgcataatgaaaactctccatatcagagttcagaatatctcccaatttccagtacagaatattatccataac

SEQ ID NO: 200032 - DNA, 582 bp, Homo sapiens
ctcaggtctgcccaggcctcattcccacgcacccatcagacttccttcagtcactgcccaagtgactgtccacacaccatccaggaacggcgttctgagtgtggaagcagaagtcggtgtggatgaattttgctggaggcctccagaatctgaactgatgctccaactattattgctcccaagtgtgtgactgcgagagcccatgtcagtgtgtgtgtgtgtgtgtgtgtgtgcgcgctgaggtggagggagggtgatctggattccaaattgcagtttccaacattaaagttatgctgtaatgcttctgattcataaaatgagctcatagtctcacagtatcctgaatgttgcttcgaatgcaaatgcaggtcccttagtaagaattggggatttcagcctactccaccctagccccggcccagcatgcaatttttcagtcccagagtcaagagttctcatgtgcagaaagaagcaattcctccaacagaatgcggccactggctctgcttcctgccacctgcagtgagtcagggaagaatggagccccaggctgcttctgtactgatgcatgcacgcctg

SEQ ID NO: 200033 - DNA, 697 bp, Homo sapiens
tgaaaccggtccctggtgccaaaaaggttggggacactgctgtagaggaatacctgaggctgggtaattctaaagaaaaaaggtttatttggctcacaattctataggctgtagtagaagcatggcacaggcatctgtttctggtgagggcttcagggagcttccaattatggcagaaggcaaaggtggagcaggtgtgtcacatggtgagagacgagaaggagaaagagagaaagagaaaaggaggcgctgggctctttaataatcagatctgaggagagctaatagaatgagaactcactcattaccttcaggacagcaacaagccgttcatgagggatccacccccgtgacccagacacctcccactaggcctcacctacaacactgggaatcaaattttaacatgagatttgcaggggacaaatatccgaactacatcaacatcttatatttcttttgttaaattatttcctaaatattttattttttgatactgttataaatggaattgttttcttaattttttttggaattttcattgcaagtgtgtagaaatacaattgatttttacacattgatcttgcatcctatagccttgttggtttcatttatagttttttggtggattccgtaggactttctatatgaaagattatgtcatctgcaaatagagatagttttacttcctttccaa

SEQ ID NO: 200034 - DNA, 590 bp, Homo sapiens
ctattatatttcccaagttgacctttattaactcctggtttcaagcaacgctcccaccttggcctcccaaagtgctaggattacaggtgtgagccacggtgcccagctgcatggctctgcattaggcctcaccatgtcatgagataagatactgcccagcattggggaaatgaggagacactgacctcagtgttggactcagaggctacaaactcacccaagaatgggtcacagcagagagagccaagtcactggaaagatggaaaagctgtggtgcttcagtcccagactaatggctttaatgtggctaaagagcatctcaaccagcctcaaggcttcaatccagaaaggaagaggccaagctggggacaggccacccaaaccctgcctggggcaggggccgctctactcctccacctccaccctagcccccttgggtatctgatcacatctgcaggtggccgtcggagctggggaagggtgtggcagctatcacagctcagggacgtcaacctgttaaggccatctgtccacttcctgtccctagtgctgagtcaccaaaaaagcaaaacccccagcaccgaaaactt

SEQ ID NO: 200035 - DNA, 320 bp, Homo sapiens
gcaatgtctggagacatttttggttgtcacaactgaagggggtgttattggcctctagtgggcagagggcagagatgctgctgaacaccctagaaggcacaggacaccccgcagtgaagacctggatagctctaaatgtttgcgatgctgaggttgagaagcccagctctaaagagacgttccctgcagggccttctgtggttatcccatgtaaattttacttctccttccccactcccgtatttcatgtcctcattttctgctttactgcttttctgctgtacacttaatgctatctaataaatgacatatttcattca

SEQ ID NO: 200036 - DNA, 521 bp, Homo sapiens
atcccactagagattttgctttaatactgacttgttttaaaataagagcaagagaactgacatttattgaccacctgctgtgtgccagctgccgccttagtcaccaccaagacctctctcatggcggtgtcaagagaattatctgcactcttggtgcctagttatggtctctggagcatgtggggctgttttttatcactcccattttttagaataggaaatcaagattcagggaagttggccgggtgcggtggctcatgcctgtaatcccagcactttggaaggctgaggcgggtgtgtcacctggggtcaggagttcaagaactgcctggccaacatggcgaaaccctgtctctactaaaaatataaaaattaaccgggcatggtggcacgtgcctgtagtcccagctatttgggaggctgaggcaggagaatctcttgaacccaggaggcggaggttgcagtgagccaagaaggcgccactgcactccagcctgggcaacagagtgggacttcatctc

SEQ ID NO: 200037 - DNA, 362 bp, Homo sapiens
aaaagaatgtgtactctgcagctttgggatgaaatgttatgtatgtatctattaggtccatttggtctgattaggtccatttggtacagattaagtctgatgttcattgattttctctctggaagatctgtccaacgctgaaaatgggatgttgaagttaccagctattattatattggggtctgtctctctttttagctgtaacaatatttgctttatgtatctgggtgctccaacactggtatatggatccagtgttgggtccatatacaattacaattgttacatcttcttgctgaattgccccctttatcattatatagtgaccttctttgtctcttcttatagtttttgtcttgaaa

SEQ ID NO: 200038 - DNA, 401 bp, Homo sapiens
ccaggaaaaattgagctacacagtcaataccactatatcctaataaagttactagatatgagagataaagggagaatccctttgggcagacaggcaaaaagaccaagtcaataataggaaaaaattcaatctggcttcatataacatttaatatcagaagacatttgtataatacctgtaagatactcaaaaaaaagaaagtgtgaggcaacatggcaaaactccatctctactaaaaatacaaaaattagctgggtgtggtggtgcatgcctgtaatcccagctaattgggaggctgaggcaggacaattgcttgaacccaggaggcggaggttgcagtgagctgagaacgcaccactgcactccagcctgggaaacagagtgagactccatctcaaaaa

SEQ ID NO: 200039 - DNA, 412 bp, Homo sapiens
taagaagattcagaattcaatactgcctttaattactattttattaattacagcagcaacatatccttaaagataatatttacaaaaatgtgaaaagttattaagtatacaatatttgaagcacaaacgagatttctttacatggtaagttcctgaggagtctataacccatgaattgggaatcactggtctatgttctttaaacaaaaataaactcttcctgatgtttaaggggtttccagaagtggtccttcaatgatgtgaccatatagatgctattcaatcttagggatttcagaaggccagaatgttagacattcttttttttctttttctttttctttttttttttgagatggagtttcgctcttcttgcccaggatggcatgcaatggcacgatcttggttaccg

SEQ ID NO: 200040 - DNA, 131 bp, Homo sapiens
cagcttgtaagtctgaatctctcttctgagctccagatccacatatcagctgcttattcgagttctctgtagactcctcaaatgcaacccgtccaatactgaactccttctgtgtacccccatctctccac

SEQ ID NO: 200041 - DNA, 355 bp, Homo sapiens
agccttggggtttgtcctgtgcccgtcattgaccgggatcgcttccttttctgtaaatcaaggtcatgggcgcagctgacttgccaaggctgttgccagctctgcgctgccttctgaggaacttgatggtttgcttcctgtgaaaacttgatggtttgctttaaggtatcactagataccttggggtgatatctaatcacaccaatgaagagattgggtatttgtttttcccaaatccctaagtgctgatttctccagggcagtacacaacctcttatctttagcactcactttgacttgcataagtttcctggcttggatgataagctatatggtcaccctgcttattcagaga

SEQ ID NO: 200042 - DNA, 500 bp, Homo sapiens
tacattgtactatttgtatataacccctgcacatcctcccatactctttaaatcatctttagattacttatcatacccaacaccatgtaaatgctatgtgaatagttgtcatactgcatcatttagggaataatgataaggaaaaaaagtttgtagatgttcattcagtacagatgcattttttaaaaaatattctcaatccactgtcagttgaatccatggatgcaaaaccatggatacagggggttgactgtacattaactttgtaactttttactctctgattaaatgctttcattactgagacttcctaaaataaattcctgaaaatgtaaaatggttattttaagtttgagagaagcaatgtaattaagaataatttaaagtctatttctgggactggaagttattggatgtgatccttaatccctaataagcaactatgtatcttcaaatattgaaaattgaaaataataataaagatcttgaaaatgtctaaa

SEQ ID NO: 200043 - DNA, 371 bp, Homo sapiens
tgccagaacatgctgtcattgaccaatttcccatctcccctgggaagagaaacattctttaaggaggacattttgaaatggctccatagtgtgactcactggaggacaatgccaaaggctttggggcaaaaataaacaaaagttaaaaaaaaaaaaaaaaagtagattctatcaaaaaaggtttggagtgatgttgccctggaaaatggaagctgatcttggactggatgaagggtggattttgtttgctccaatgaggtagtttcttcagggtaaaattccactagaatgtgtcttccttgttagggcagaggaaaaggaatctctaatcagtcacggttcccttaaattagctcctctgtccccgaaaa

SEQ ID NO: 200044 - DNA, 438 bp, Homo sapiens
ccattctttttttgaagttcttaatattattaacatacagctggctttgtttttcattatcccattttgcggaggattggttgtgaatttaagggtgtcacctcaaacaggagggtaagttgcactttaagtgatgtaaaatagtaagaagctaaaaaccttaaaaaatgtttagttctcggccgggcgtcgtggctcatgcctgtaattccagcactttgggaggctggggtgggcggatcacttgaggtcatgagttcgagctcagcctggccaagaaattaaaaaattagctgggccttgtggtgggcgcctgtgatctcagctactggggaggctgaggtaggagaatcgcttgaacccgggaggcagaggttgcagtgagccgagatcgtgccactgcactccagcctgggcgaccgatcaagactccatctt

SEQ ID NO: 200045 - DNA, 457 bp, Homo sapiens
ttatgagaaataataagtatttttctatttacatgagaatttaatctcaaaacaggaatcagaaacatattaagtccagggcataaaacctaaaccactgctcatatttattctttctaaatagagcaaagtgtaaaatcttctccataaaatgcacattgtgcttatgaaaaggccaaagtcttagtgagaatcattggtattccatagaagagtgaattaaacacagccaagggaagacccaagtctcatacttctcttgtatattccagagttccaggggaattccaggtgatagaggtgatctcccatactgttaaagcaaggttgcagacacttgggaattttggtcccagtactctaggaggtcacacctctgtcctgcaaaatactacaggaatgtatactcttcctatgactcattctggtcattcttccagcatcacaaaaaccaaaa

SEQ ID NO: 200046 - DNA, 468 bp, Homo sapiens
agcaaagaacaaaataagcaggagaaaagaaataataaaaattagagcataaattaatgaaacaaacaaggaaatcaacagagaaaccagaagctggttatctgaaataaatcaataaaattgatgaacttctagccaggttaactaagaaaaagagacaaggtacaaatcaccaataccagtataccaacaatgaatcattgccccttgatatataaaaacatagtactactaacattagcaccaaaaaatggaacactttggtattccaaagtattcatttaagatctgtatgaggaaaactacaaaactctgatgaaataaatcaaataggctgggcgtggtgactcatgcctgtaatcccagcactttcggagtctgaggcgggcaggtcacctgaagtcaagagttggaaaccagcctggccaacatgatgaaacgccgtctctactaaatatacaaaaatta

SEQ ID NO: 200047 - DNA, 427 bp, Homo sapiens
tgacattgctttagctgtgagaacagctgtcaatcttcagtagcccctaagacttttctctagctcctacttaataacagtttcttagaataataacttttaaaaagctacacctgcctgcggatttagtaagaagacatagcctcaaatctccaaatgctcaaagcttattctgagcgtgtggtggctagatgttgataagaggaaaagaaaggaactgtttacttggttgggaatacttatttgggggtaacaacaatgtggacaatggcacaaagttattagaaggaaaattaaaccctctgtctgggcgtggtggctcacgtctgtaagcccaacactttgggaggccgaggtgggcggatcacttgaggccacgagttcgaggccagcctagccaacatggcaaaatcccatgcctactaaa

SEQ ID NO: 200048 - DNA, 456 bp, Homo sapiens
acagaccccatttctaaaaaggaaaagaataacaacacttcacttctgtggtcttcctccctaaaacacgtatcctcagtctaatcatgggaattacatcaaacaaaacccagttgagggatactctacaaaaggcctgaccagtactcctcaaaactcagaaacaagcaaagtctgaaaacccccctagcccagaggagggtagggggacctgataactaaatgtaaagtgggatcctggaacgcaaaaagactagataaaaactaagggaatccatttaaaatatgaagcttagttagagtaatgtaccaagactgattccttcgttgtggcaaatgtaccatactaatataaattaactataggggaaaaggatgtgtgacacacgggagcattctgtactatctttacacttctctgtaaatgttaaactattctaaaattcacagttgact

SEQ ID NO: 200049 - DNA, 202 bp, Homo sapiens
aaaatctggtgtatgtttaattaagaattcccatatccctgttataattatagaatgcacagcctctgttaacacacagtatgcagaacacgtttcctaaagcaagttctaaatgggggtagactcagaggtccctgaaggcagttaccaatcagctgactgctaaatggaataacctcagaattgcattagaggctttgat

SEQ ID NO: 200050 - DNA, 669 bp, Homo sapiens
ggcaagaaaatggaagttactgctagaagagaattgttattaacaaggatatattgaatgtctgcttatatacagtattatattaggaaagtgtaggaatcattaatactgctttataaatagttctgttgttggctggtccatgtgcagtagtgtttacaactctttgatcacaatcaattacagttcttctccactcccactgcttcacttgactatccttaaaaaaatagctctgatgaatttatgaaaggtatgttagtaattttttaaattatgcttacttttataataaatatatcagtgtacttattttcagtgggatgagattgttgaagtaaacatgttaacccagttgcataaactacaatctgaaagtactatgtaaatattcaaaagaaagatactgaataaagagatagcttttaacctgcagaaagaaaataaaggtagtacctttcattatcctgaaagccatggatagaattgacatctttaaaaatgtttgtcaatcttatatgacaaatattgctcacagcactctcctgagagtctaccaatctatgtgattctgtgctgcaggctgtgtgaggttagtgcggggtgctttgaaaaggcttcattaaaacattcttggaaactatcattctcagcaaactatcacaagaa

SEQ ID NO: 200051 - DNA, 600 bp, Homo sapiens
  misc_feature (464)..(464): n is a, c, g, or t
  misc_feature (496)..(496): n is a, c, g, or t
ttaatttatctttgtaatttattcttctgtctttcaaagaggctatgcagcacatgccttgctgagagaaagcaagtgcttctaccctagctggtttagtatcatcacactgtacaggaataggcaagggctgtttccagttgcaggcaggaagaataaacactgattagcaagccctctcgacaattagtggcaaaagaaagatgatggctgaggagccccaatgcccagcctgggacctcacctatttcacaaactgcctctcatgctaacactaccaagctttaagtaggaaaagaaatgaccatcaactgggttagattagtccccttttgaacagattttgttccccgaaggaaaaatatccaaaaaggaagggaaggagtcaagattatcccaaatggaaatttctagagcaaagcttctaaaatcgcccttctctagaaaacatttttattctacanaggggttaagaagctttttaacttttactggntttacttttcggtattaaggaattaaacagaacagatacgtaactgttggcattttcttgtgtctgttaaggggctccaaggctctaattcacagggacatgtg

SEQ ID NO: 200052 - DNA, 584 bp, Homo sapiens
tatattaatgcactttcattagtgctgaattactaacaaagtacataataacaatttggtagaaaaaaagtacatttatcctgaagtgaaggaggaaagtaagaaaaaaaaactaataaaatggttagcctttcaattgcaactgtatttggtaaaaagagaaaatacatataacattatgtattaatcttactagaggttccaatccttttactgtccccagcacaatcagatagcattatcaggtacaatgtcatcactatctttaatccaaagaggaagtcatatttgccaaggcagaactgcattttgaaagaaaccctttaaatgccagctaacctaagcttgtaggcaggacaagctccacagagattgcttcaaactcttaatttatatggtcatatttgtaaataaagaaatatgtgcagggtttaaaaacacaccacttaatattggtgaaaaggccacattgattatatattattcttagtcataaatctatgttcactacgcaaatttttaaaaatctgacatcttaagagagagaatatgctgtagtgagtgacttgacaatcagccaactt

SEQ ID NO: 200053 - DNA, 439 bp, Homo sapiens
aaatgaaggaggaggatgtccttaagttccttgcagcaggaacccacttaggtggcaccaatcttgacttccagatggaacagtacatctataaaaggaaaagtaatgtcatcactatctttaatccaaagaggaagtcatatttgccaaggcagaactgcattttgaaagaaaccctttaaatgccagctaacctaagcttgtaggcaggacaagctccacagagattgcttcaaactcttaatttatatggtcatatttgtaaataaagaaatatgtgcagggtttaaaaacacaccacttaatattggtgaaaaggccacattgattatatattattcttagtcataaatctatgttcactacgcaaatttttaaaaatctgacatcttaagagagagaatatgctgtagtgagtgacttgacaatcagccaactt

SEQ ID NO: 200054 - DNA, 854 bp, Homo sapiens
aggcacccaccaccacgtccagctaattttttgtatctttagtagaaacagggtttcaccgtgttagccaggatggtcttgatctcctgaccttgtgatcttcccacctcagcttcccaaagtgctgggattacaggtgtgagccaccgtgcgcggcccccttgtgctgcagtttttaacacattgcagctaacacttactgagcactgaccctgtgtcaggcgttgtgcagaactgataatcctcacagccactctatgagatgtgcactattagacttatttctgatggagaaactgaggcttagagaggttaattcacttgtagaagctcacacgattagtgagcgaaggagcagagagtcaatctccacgctggctttaaaaaaaacacagatagagtcatctcattctcctactttgtaaacattattttttttaacctcacaatattgggattctccaccctggcttcatggtagaatcatttggggtctttttacaaaataccattgcctagaatccacccacgactacttaaaaagaacaataataacaacgctaatgacagccaacattacattgggcttactctgtgctcaatataagtgttactatgtgccaaggctttctttaaccatatatggacacacacatgcacacatatattctctctaatatatataacactaacatatacatatattcagatgagggtgtctctcaatatattctcatttaatcctcaaaataaaccttggatgaagataccattgagtatcaccaatttacaaatggggaaggtgagactcagaagatttaaaagcctagctcatatgattcaagagacatgca

SEQ ID NO: 200055 - DNA, 280 bp, Homo sapiens
gggattacagccatgagccaccacacccagcctggtggagtaggttttctaaaggtttaaaagcatgagggtgtttgtgtaaccctctttctttagcttctaatttgatcaaaggtggaaccagctgctgtcacagcttaccacaagcttaggggcttgaaacaacacgcatttatcttaccatgctggagtcagttgtccaaaatgggtgtcactgggccaaaatcaaggtgtcgctgctacagtacgaggaacccccacagcgtggaggcttccctct

SEQ ID NO: 200056 - DNA, 133 bp, Homo sapiens
taaggaaagtacacctccctcgtctcccctctgctggctgccaaggccacaatttgaacccccaacaaaccctcatgaccagagttgttgcattggtggcattggtggtttactctcagactcccgtgctgcg

SEQ ID NO: 200057 - DNA, 243 bp, Homo sapiens
taatggggttcatttcatttgaatagtaaataaagaggttaaagttcacctctatagattcacttaagaattctgaagcagaaacgttaaagggaaaatattcaattgtactctgtccatctaatagcctacaaagtagaacgggaatctcatagatttataattataatggtgattgaaaaataacagcatgcatttttattgtgtgtgtctctgagtatccagacgactgggcaccgcaga

SEQ ID NO: 200058 - DNA, 352 bp, Homo sapiens
ccatcacagccggccctgtactagattctttattgcaaaattgtttataatagactggaaacaacctaagtgtccaacagtaggggattgcctaaggaggtgcattgttaggatgatacagcatgaggctgcaagaaagatggaaaaagctctttaagctttaaggtatagagaagaatttccaggcccagtatgatggctcatacctgtaaccccagaactgggaggctaaggtgggagaattgcttgaagccaggagttcgagaccagcctgggcaacaaagtgagatcctgtctttgcacaagatttaaaaattaactgggcaaggtggtgtgtgcctgtagtcctagc

SEQ ID NO: 200059 - DNA, 369 bp, Homo sapiens
aagttgcaagatattaagaagcaggaagtagctttttaacaacctcagttttgtatttccacaacaaacacctaattttttgaacagtattttctttgctacattttcactattgggtatctagtttggtcttgctgtatctgaaaactggccaatttatatccgtatcacaatgaacaaatatattccttcatgtatgacagtttcagcatacagaatgcaacctcagctaccaattatagctgcaaatgagcaatagtgtggaatgagacagcctgctggctttgttagtattctgtctcctttgggatcccatggggaaaggggaggctctgatgaagagaagcccttggctcatggtttattgtg

SEQ ID NO: 200060 - DNA, 267 bp, Homo sapiens
atgctgacagcaggtgagaaactcacatatcttgcatcagtcatagaatcagggtttctttctttttaccactggagacagttgagcacattctcattgtcacatctcgttgaaatatttcataaatctgcagggtaatcatttaaaatttaagttatttccttctaaaaagtgttcagagaggatgtgaaactgagcaaaatgcaaaggctttttttccccacatcataaatgtgcttcctcagcaactaatacctttcaaatgat

SEQ ID NO: 200061 - DNA, 181 bp, Homo sapiens
tggaattgatacaggttggatatgggtccctatccaaatctcatgttgattatagaatatttgcatattaataattcataacacccaatcttgtctgtggctcctcagattatagtctttcaagcaacttcttttgattagactaaagactgattaaatcatggagactgggagaaaggca

SEQ ID NO: 200062 - DNA, 180 bp, Homo sapiens
aatctgggccaaaactcgccaataaggaaactaaattttattgtcctctatacccttccttaagttaaacaaaaaaatacaacaaaacaaagaaaaaaaatccaaggtgctccagcgtgagtgtgatcgctgccccactgacctgtggagtagcattgctgggcaggctaccatgtgacg

SEQ ID NO: 200063 - DNA, 315 bp, Homo sapiens
gcttggtcttgaactcattaacatctgacttctagtaggcactggattcaggcactggagggatggccttgggcacactgtgtacacatgaaagaggatttgtggggaagaaaaaagcagaaaagagaaagatgctatcaagaactatgggtggggatgcagggcagaattggttaaggaactggtttgtgctacagatacaggctcaggcagcgctatgttctgacttattcctgtgttcatacaatcagaagagattatgatcaggtagtccaagaaacctgggttggtgaaaaaaacaggttcccgatagag

SEQ ID NO: 200064 - DNA, 443 bp, Homo sapiens
tcctctgttcagtccacttacatttctaaaaattaagaaaaagtctagagaagattaaaatgacacatcttctaaccttttactcctacttctgaaatctatgtggttcactagtacttccatttgctactaaatcaacttaagtcttaccactaagacgatgctacacactattccttttccttactcttaactactcaaggtgagcctttttctacacatgcttatagcagtttattgtcagtacttgtcagctacaaaatggtaaaaaattttaaaaaacaaaaaataaaatcgaaaaatgagccaggtgtggtggcacgcacctgtatttccagctactcaggaggctgaggccagaggatcgcttgtgattgaggctgcaggtgagctgtaattgggccactgcactacagcctgggtgacagagaccccatctccag

SEQ ID NO: 200065 - DNA, 407 bp, Homo sapiens
ctggctcctggttcttcctcctgctctggaggagccagtggggaagacagtcaggtagccactgctgccctccctgccccagtgggtgctttgagccccagggggatgggccttaagtgttcaggcatcgctgtgaggctttcctgggacctttccccatgtcctcattggcaggtggaggagtgttggtatgcagatcctggctgcccctttgccatgcacagcccaatggggagggagtggtgctggtatatatcccggtacacaccccagtgaagatactgggcccggcccctgtagtgcccaggggctaaagcaatagaggggattgctgccccagccacagcgccccagccttcccagggcctgcacatttgtatgtccacaagattgtgcaaccatcactg

SEQ ID NO: 200066 - DNA, 382 bp, Homo sapiens
agtacattgcttttatgttgactacaaataagtgaacaaatgctaaaataaagaaaaaacaaatgaaaacccccaaaatgcccccacaaattatagtctctactacatgcgaggtatggttctaagtactttaaatgacagtatttataatcctcaccataacctcatgagaaagaaagtaatgttattaccattttgcacaaagggaaactgaggcagggtgtattcgcctgcccaagtggcatcggatttgaactcagatctgaactcaggcagcctggctctacgggctattcctttaacctttgatatatactgactcaccaataggaacaattcacctggtaaaatgaaacataatgaacgtattctatttaaaact

SEQ ID NO: 200067 - DNA, 149 bp, Homo sapiens
agtctccctgactgtcccctaaatgcccctaacacaccacagggcgacctcaaaggcaaatcttaccacagcgctgttctatttccagtttttcaacagctccttagcaaaactgggctctttcatgtttggggaaggtggcttgtcca

SEQ ID NO: 200068 - DNA, 169 bp, Homo sapiens
tttcttagtatctattttttattggtgtgttaaagtacaaaataagtaaatcaaatcctaccacaaaccagaaaaattaatggaatcattggaaatcaagtattcaattggagcttaataatccatcagcttctgaaaacactaagcagtgaagaagcagctcatggat

SEQ ID NO: 200069 - DNA, 227 bp, Homo sapiens
ggatgactgcaggaggcccctcagggctctccctgtttctttcctcatctcctggtgggtgctctgtgccccaccaagcactcagaatcgtgtcagaaggtctgagtagagccactccacttacaccctccaccagggtcccattgtgcttagagtaaaaggcaaactcagacttcctcacctacagtccaacccttcctcaggtccctccagtctccctggccacc

SEQ ID NO: 200070 - DNA, 565 bp, Homo sapiens
gtaagcttataggttaaagtaatctattattatgtaatcatggagactgtcaaacattcgtctttaaaaaaagaccattattccagcagcattcctgaattgttttcatcttagccttaccagaataatctaagaaattaagaaggataattatttcaaatcagacatatcagtttaatgttggttatttatgaaagtgacttcatgttttcagtgtatcattatcattgctgcctccaaaaggaaatggcagcagttctcctaataataaactgtaagtatttattacttcaggtatacaagcccttttaggttgcagaaaataagtggaagtaatgttttttattttaactactgttttgattgatcgtacctaaagagttgcgtttgtccttgtaagccagtgagaaattggtaagacttgcttaaaagtttcatggagccccttttagttggaaacaatattttcatcaatattccaaagaacaaagcattcttcttaattttgcttataaaaataattacttctgatgcatattaaaattcaagctattccactttcctg

SEQ ID NO: 200071 - DNA, 555 bp, Homo sapiens
cacttgataggtactcaataaatatctgttgaatgaatgaaatagaccctaaaataatctaaataactttttatactatataacaatggccaatcctcacataatcataattttgatttaagaaatcttattttaggccaggtactgtggctcatgtctgtaattccagcactttgggaggccaaggcgggcagatcacttgaggccaggagtttgagacctgggcaacatggcaaaaccccatctctactaaaaatacaaaaaaaaaaaaaaattagccaggtgtggtggcacacacatgtagtctcagctactcaggaggctgaggcatgagaatcacttgagcctggaaggcagaggttggaggttcacgggaaggaagagatcaaaatcagactgaaaaaggagagtcagaaaaggcttcacagaagtttgatgaatggataagattttgagggccagtggtagggataataacatttaaggtgggaagaacattatgaataaaggcaaaggcagaaaagtcctgggcttatttgaggtaatccgtgaggg

SEQ ID NO: 200072 - DNA, 469 bp, Homo sapiens
tggttttggcttaaaagggcaggatatcttgaaggggcttacagatcgtaggtacatttaaagattttctattttaattggttaaggaagagaagctttgtttaaaagtctggggtcagtaactggctcaggggtatgactccctccaagtccactaggaagaaatttagaacaaagaacgcaggtcagggttttgtacttaattttttcttatctgaggtttatgtgccagtgaatctgttgggtgagggtcttcagagtaggggtccaagtttctgaaagacaactcagggacatacgttaagatgttatctttagtttttatagggaaaccaaacacctctggattctaacttttttggctattgttttaggttactgcctttttaataagttacttactttttaggactaggtagcaaaagaaaaaagacaagatggtaactttcccatggtggatttaagcaaa

SEQ ID NO: 200073 - DNA, 124 bp, Homo sapiens
tgttaggattataggtgtgagccacggcacccagctgactatagatttttgaccgaaatcttacctttgcagaattgatcactccctatatgtggctcccactgcctccaatccaggctacaat

SEQ ID NO: 200074 - DNA, 112 bp, Homo sapiens
ggaaaacatggtgcagaccacacacaactgttggaatgtcctccactgatgtaaagattatatgattatattccccagacccttgcatttaaatacaccctactcttcttgc

SEQ ID NO: 200075 - DNA, 629 bp, Homo sapiens
tgaggatttaaatgattttaaatgagttgttgttgcctaggaatgtgctggggattgactgagatctttctgtcctccatcagcagccccatggagtgagtgatgtctccccctacaaatctcctaataacaaagctttctccacagacagtagaaaggatgaaccacataagcctttatcaattacacaaagcacagcagcttcatcaatgggacaaaacccttctgtacagtttctatgtacaagatgaatagggccagctctaagaccaaggtcacatggggatgtcttgcaggtttgttttctatgttcacagcatttgaatctttttctctactcagcaccacccttcctcagccacaaccactcccaccccaaacacacacacccagaggcaccctgtgggagtccctcttaagctctccccactggctcattcgctactgatgacttgtggacccagacactttcatcactctcaaccagtcttttatgtgtgagtcagataggctcttacctttcctaaagaaatttcaggcaacagctagagaagagtgagtcctctcacttcccctttcgttgacgaaccacgagaggttgtcccttctgaccctaaagggactcctta

SEQ ID NO: 200076 - DNA, 196 bp, Homo sapiens
tttatttataactactaatgtggcctagatttttaaacagaaaatttaagttattcatacctttctttcaattaacttaaaatatgaatttaaaaatataaacaaattaaatagttcaatgaagtgcaatatttactatgttaccaaatgaagaaaaagggaatatttaaaaagataaaaaacttaagccttaata

SEQ ID NO: 200077 - DNA, 119 bp, Homo sapiens
ggattaccagcatgagccaccatgcctggcctcaaaagttacttaagtatattgtgtaaagtgagccactatagtcttataccaggaaataatcactgttaacaattgggagtaccttt

SEQ ID NO: 200078 - DNA, 133 bp, Homo sapiens
ctatttttaattttagtcattttgataagtgtgtagtgttatctcattgtgctttcaatttgcatttctctaatggttattttatttttattttgagaggcagtctcattccgttgcccaggctggagtgcag

SEQ ID NO: 200079 - DNA, 303 bp, Homo sapiens
gaaagaagggttttggaagataaatggaagacttcaagtgaatctatagttttgtttaaaaattctgaagcaaaaataagaaatactgagtttgatctcttcgaggtattaggtacctaatgttttctcagttctccattgttttttgtttgtttttgtttttttgagatggagtctcactctgttgcccaggctggagtgcagtggtgcaatatccgctcactgcaacttccgcctcccaggttcaagcgattctcctgcctcagcctcctgagtagctgggattataggcacgcaccatca

SEQ ID NO: 200080 - DNA, 244 bp, Homo sapiens
gccggagtcgcacgcctacgagactgcgcggacccgcccaaaaggaaaatggaagtagtggcgtgaggctgcgacagtgaaggttatttttctctttttaaagggccgctagacctcccgtctaaaggaagcgcccgacgggcctccgaagtacacgcccaggcccccacagcgcagccgcccgaccgcctctcttcacaccggccagagtccaccctctcccactttcccctcccctcccctc

SEQ ID NO: 200081 - DNA, 453 bp, Homo sapiens
aatacaatggaaatgccatgtaaatagttatcatgctgtattgtttttctgtttgtattatttttattgttgaatggttattttttactgctttttttttcaaatattttccatccacggtcggttgaatataaggatataaaatctgcagaggggagggcccactgtgtcaacaatgcaagtaaaaaaattcaagacagatagccaggactatagaatacagagtcagaattcaaaatgctgtcaacattctcatacaccagctgaaactgatggaatgaatctcaacggagaagagatgtaaagtcttatatttgctctccaaaaataaatcacagaaaaacagaatggaggatactcaggttggcatagactcctatgaagaagatgggaggattcagaataactagaatgaatgcacaggaagaagactgaacaggatatgttctgaaa

SEQ ID NO: 200082 - DNA, 256 bp, Homo sapiens
agaagaagtaaatgtcagaaatgaaggaaaataatagcaggtaaaggaaagaaagggaggaatcgcagaaatgagaaaaactgaaaagggaagaaagcagagaccactaattagaagtcgagcatcttggaggatgaaattatgccataattttcttcccttgtaagtgatatatatatatatatgttggattgaattttgtctattttatcttccttaaggtttgtatgacaagtgagggatcaaaagaagggag

SEQ ID NO: 200083 - DNA, 635 bp, Homo sapiens
cctgcctcagcctccccagtagctgggattgcaggcgtgtgccaccacacccagctttgtgtgtgtgtgtgtgtgtattttagtagagacggggtttcaccatgttggccaggctggtctcaaactcctgacctcggcctctactaaatgcttaataattgttatctattattatcctcatcaaagttccaactcctagtacagtgcctggcacataatagacataattcaatgtttgctgtacttttagtatgaatcaagaacatcatttctaaataatcacttgaagaaaccactttctcattgaatattgagtaattcattcacacaacctattatggagaactcactgtatgccaagcactgtagtgggtttggggaatataaaggtaaacagtatgtgttctgcccttaccaaaataatgattttgtgggggagatatatacaagtaaagcagcaattactatagcttgataagtatagggattaagcaaagggtactatcaatgtgccagcacatagctggatgtggtggtgcatgactgtaatcctagtactttgggaggctgaggcaggaggattgcttgagaccagcctgagcaacataacgagaccccccttctcccaaaaaaaa

SEQ ID NO: 200084 - DNA, 650 bp, Homo sapiens
taaccctgagttgacacagcacatgtctcagagagcacggggttgggggtaaggttataaattaacagcatctcaaggcagaagaacttttcgtagtacacaacaaaatggagtctcctatgtctacttctttctacacagacacagcaacaatctgatctctctttcttttccccacagtgtggggggtggaacacaagcttagaagtcacaaaatcagtattctgggccctacatgatgagctgtcactgagtgatgctggcattgcaactgcttctgtaaacagtggtgtgagcactgtcatgacatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgataacttcctgctatgagtcagctaaacattcctgaatccaaccattctacccctggcaaactccagtatctgatgctctatcacatgtggaaacaaagtcactcacatcggtttcaacaagtacactgcttagtgaaatatgggtctttaaaaacatactggaatttgaaaaaataaaccacacactgatggtaatg

SEQ ID NO: 200085 - DNA, 421 bp, Homo sapiens
accttcaatcaacaaaagcctaaaatttttattttagaatcatgatgttggaagatctttagattgctcataccataaagctgtttctaagattggtctcgggaaggtccaagatcaggattgaagtatgaaaaatcttggccaggtgcagtggctcatgcctgtaatcccagcactttgggaggccgaggcaggtgggtcacaaggtcaggagatccagaccatcctggctaacatggtgaaagcccgtctctactaaaaatacaaaaaattagctgggtgtggtggcggacacctgtagtcccagctactcgggaggctgaggcaggagaatggcgtgaacccgggaggcagagcttgccgtgagccgagattgcaccactacattccagcttagtgacagagtgagactccatctcaa

SEQ ID NO: 200086 - DNA, 525 bp, Homo sapiens
ccagtcctactctgccagccagtaggatggggatgcaggtcccgccagcaaggactggctgaaccgtgcgacccatgcagtagggcccttgggtcagctgtccccacccactacactgatggtgaatgaggccagaagacagggggctctgcgtgaagcccaccagcccctgccacgtgatggttggaacgcgtaccttagagcttccagttccgtcttaggacattttcaaagatgagcgtcctcaggaggggcggtggagggggcatgtctggagggacctgaggcacggggagcgctcggtgcccaggccgagcagtgccacacgtgcgcacgagttatgcctgcaaacacgggttacgcctgtgagaccagtgggctccttccagccgggctgcctgaggccactgtctgtgtgttggtgcccattgtgggctccggggcgctcttcccttgtgctgacgtgagtggagttgaattgccctgaatcagattagactgaaataaactgaattgaaaggccta

SEQ ID NO: 200087 - DNA, 384 bp, Homo sapiens
atatcacatgttcttacttgtaagtgggagctaaacattgggtacacattgacataaagatgggaacgacagactctggggatgactagagtggggagagtaagggggtaaacggctgaaaaactacttcttgggtactatgctcactacttgggtggcagattgatttgtacaccaaaccttagcatttgtactccaaactttgtaacaaacctgcatgtgtaccttaattctgaaataaaagttgaagaaaaataaaattatttaaattttttttctgatacctctctccaatatttttctcagtttgtggcttatcttatgatactattatctcacagaagtctttccatttgtgtggcaaattctgcatatatttttctc

SEQ ID NO: 200088 - DNA, 350 bp, Homo sapiens
gtaatgatagcttatcaaatctgtactttaaagatggttcatcaataaatggtacttgggaatgacataaaaatgaatgctaagttatatcccaactggattaaagagttgagatttaaacaactgggctaggaaagaaccagaaaatatacataagaatttttatatcctaagggtctaagcatgacactaaaaggagaattcacaaagacaaaaattactaggtcttaaagaaaaaagctgtgagccttatactatcagattttacaacttaaaattaacccctacgagccttctagtttccaatgcagcaagaaagttgcttggaagtcatcactgtgtcttaacaa

SEQ ID NO: 200089 - DNA, 763 bp, Homo sapiens
atagttagagacatgacaaaactggcacatgtgcctgcgcaagtgtggcatggatttaatcctggggccatgtttgaaaaatggttcccagcactaggaggatttaaaactcttatagtaggagttataatagtaataaaaacatgcttactgctcccttgtttgctatgtacttcttcaaatgataaaaagcttcatcgctaccttagttcaccaaaatgcttcagcacaagtgtactatatgaatcactatcgatctgtcttacaggaagacatgagtagtgaggataaaggtgagaacttccactaatgagagaggttctcaaacggggggaaaaagggaggagaccacccctcatattgtcttatgcctagtttctgcctccaaagaaagaagaagtgaaaactgaaaggcagaaatggaatccacaggcagatagcccagcatcatgccctgggcctgctagttaaaaatccacccctgacctaactgcttgtgttatctatagatttcagacattgtatggaaaagcatcatgaaaatccctatcctgttctgttctgttctgactagtggtacatgcagcccccagtcacataccctctgcttgctcaatcaatcatgaccttttcaggcggaccccgttatagttgtaagcccttgaaagggacaggaattgctcactcagggagctcagtttttggagatgtgagtcttccaatgctgccagctgaataaagccctttccttctgcaactcggt

SEQ ID NO: 200090 - DNA, 557 bp, Homo sapiens
  misc_feature (544)..(544): n is a, c, g, or t
cctacttagcatagaggcaggcagcgtaactactcgaataggcctgtgtgttcttgcttagtgaaataatgtatgcacaatcataatgctatcagggattgagaataatttgtttaccagcgtgggtgagaaatattagcactaccatttccatagaaaccattttgcatttaaaaagttctggcatgtcaaactgtaaatttcagtatttaaaaacattctcttatgtgaatccctgtattgcaaaagatactggtcaaaggaagtgctatttgtacactttcgtcaagtcatttttgaattttcttatttaaagaaagtttgccatggcctgtcatactttgggagaagtggttgatatagacacaaaaggacctggtttgtagcaattatccattcccttggcctcaaaggaatactagtatataaaggcagaaactttctctttttcttttgagactgagtctcaccctgttgtctaggctggagtgcagtggcgtgatcttggctcactgcaaccttccgcctcccgcgttcaagtgantctcctgccttat

SEQ ID NO: 200091 - DNA, 466 bp, Homo sapiens
  misc_feature (453)..(453): n is a, c, g, or t
atacaaggatcacataagacgaatgtttttaaatacgaaatttacagttgacatgccagaactttttaaatgcaaaatggtttctatggaaatggtagtgctaatatttctcacccacgctggtaaacaaattattctcaatccctgtattgcaaaagatactggtcaaaggaagtgctatttgtacactttcgtcaagtcatttttgaattttcttatttaaagaaagtttgccatggcctgtcatactttgggagaagtggttgatatagacacaaaaggacctggtttgtagcaattatccattcccttggcctcaaaggaatactagtatataaaggcagaaactttctctttttcttttgagactgagtctcaccctgttgtctaggctggagtgcagtggcgtgatcttggctcactgcaaccttccgcctcccgcgttcaagtgantctcctgccttat

SEQ ID NO: 200092 - DNA, 494 bp, Homo sapiens
gctgaaagctcaaggctcccgaggacacctgggaaaagattcggggggccacgatggcataggcatgggagactcagccctggagtctggcagggcttgaccaagtcacttggtgaccttgaacacatgactttccctacatgacttccccttcctgggactccgtatgctctgtaaagatgggaacattcatggctgggcacggtggctcatgcctgtaatcccagcactttggtagacgaagacgggcggatcgtggtgcccacgaggtcaggagttcgagaccagcctggccaacatggtgaaaccccgtctctactaaaattgcaaaaattagctgggcgtggtagcacgcacctgtaatcccagctccttgggaagctgaggtaggagaatcgcttgaacccaggagggagaggttgcagtgagctgagatcacaccactgcactccagcctgagcgacagagccagactccatctccaaaaaacaaac

SEQ ID NO: 200093 - DNA, 634 bp, Homo sapiens
attgatagtaaatcaagcatacaggacttcaggaaagctgatagggataattctttcaattaaaggaagctatacttccatatagacttggactataaatgcaatacataaattgcaatgattatctcaatgttcttcattctttaaagttaatttatgcattttctaataaaagaaactaacatatgcaagtgacatatctcagagatagttattttgtaatttttttgcaaaaagttacacaaaagtgcacataattgcataaaatattaaccaatgccatccaagtattatatgcatttgtgcagttattatagtcaaaatgatataagggtttatgtatgaattcagtaaggtagttttctcagttagggttatgtttgtcatatttgcacctttttaaaaacatggtttcttgaaaatctccaatgtctctgaaatcagaatatcgctggggtaagcagggaaggtatatataatttttagtgttacaggtgattcttctgtacacttcctaagatcatagatttaagacttaggaaacaaagcaaactgttgctaactcttggaacatagcctagaacaacattactatttagcacatatagtaatagacacaaagataaaaccaata

SEQ ID NO: 200094 - DNA, 789 bp, Homo sapiens
aaagcgctgggattacaggcgtgagccaccacacctggctgaaatgaggaaatttttaaaagtggcaaatggattatgaacatcttattcagaaataaaggtaaaaaacagctaaaatggcaaaagcagttgggttctggggaaggtggggccaggggactttttgaagccttaatatttgctttgttaaaccatgttcttgcattattaagttgtgtcatgctaagaactctattttgtcaagccagattatgatggcttaacatgagtgaaccttccagcttctcatgagatgcaaatctgacaggaatagggactcgtgttactttatggcaggtaaatagcacccttcagatacaaaattgggttggtttcgggcgtggtggcgcatgtcgtagtctcagctactacagaggctgaggtgcaaagattgagcacaggagttccaaggccagcctggccaacctagtgagacctgacctgtctgaaacatacaaccccacccgcacccccaccaaaacagggatggtgcttcctgtcccttaaggagacaagacaccaaaggagaaagtacgtagctagtgatgagtgaattgagcattgtattactgctctcatttttgtcttaagttgtcacaactaacagggaggctgagtactctgtccactgggagctggtggttccattgagggttgtgtgtgcctgctggtttgagttcctctgtccaacatcagaattgtttgtattcagatatgcaacaagatgggacttctcagtttcacaacgta

SEQ ID NO: 200095 - DNA, 748 bp, Homo sapiens
ctggagtgcagtggtgcgatatccgctcactgcaagctccacctcctgggttcgcgccattttcctgcctcagcctcccgagtagctgggattacaggcatgcaccaccacgcccagccaattttgtatttttagtggggacggggtttcaccgtgttggccaggctgatctcaaactcttgacctcaaataatccacccacctcggcctcccaaagtgctgggattacaggtgtgagccaccatgcccagccttcattcctttttgtggttaaataatatttcattgtatggatggaccacatttggtttatccattcacccattggtagacatttgggtcgtttctaccttttggcgactgaataagctgttttgaacatttgggtacaagtatctgtttaaagacctgttttcagttctgttgggcatacacctaggagtggaattgctgggtcatacggtaactatgttgaacttcctgaggaactgccaaactattttccttaacaactgcaccattttacattctcactagcaataacgagggttccagtttctccatgtcctgattcttatatttgaagtgttaaattcttgcaaacatttttctcatgtcttggtgctcctgctttgctggtgcctgaatctgtgcgtggccaccaggttagcctggtgtaggtctcgtggttcaagattggcaacagaggaccggagaggagacaagcagctgggagcccccagaggtg

SEQ ID NO: 200096 - DNA, 478 bp, Homo sapiens
gggtttgctttttcaggccctggcctccaagaaggtccatgcatttcttccttgctggtagagaaacttggttgaattaggattttcttaaaaacagaagcaaagtgtatctaaaccctggtcacttaagaactccagagacagaacttcagtagtaaaagctgttttttataagaagggaatggacagtcggaaacaatatcctttttaggcacactgaatttgctgcatttagtataaccctaggtcagactgtgaaagcagagttgctaaaggccacattctgacctcagatcgtgggcgcgtatcactgtgcattttataaaattagctacagtgcagcctctctgtgtgtgtgcgtgtgtgtgtgtgtgcgcgcgcatgtgtgtacatgcagtgaagctaacttttaaaaaataaacagcaacatgtacccatgccatttaagattagtatcaagccaaagtctgattttaat

SEQ ID NO: 200097 - DNA, 800 bp, Homo sapiens
ccacttcccagtatccaccaccagactggtacacactgtcatgtcaaattaaattaatgcaagagctacccaatttcaccccactgacatgcacaccccaatccaactcacgcccccacagatgatcttaccaaaacacaaatcacatcaagtccccagctccgacctaaaacactctcctatgttcttatgaggaaaaccaaattcttcatgtggccagcaagaccctttgtggactggccggccaccagccaaggggtccagcctcacagtagctcttctctccccttgatcttcctcagttacttgatttcattctgttcccttctgtaaagggcctctgcacaaatggcagttctctctgctttctggaacacttttcttcctaccctatctcacattctcctactcatacttcagatatcaatcaagtgtcacttcctcaggttcctattatataagcccacaaaattctactgttctattcagagcatttacctctgcctgtaattatacataattatttgttgatgttgttgttgttgctgtcgtgtgtaaattttattagggattgtcttcctcctatactcttcactccatgataatgcagaccaggaattttttgctcattattggatctctggggtcaagaacagtgctaggtacatggctgacactgaatgaatatttgttgaataagtgaaacccaagagctagaggtcactgtcaaatacatagataaaaaatttttccactaatactgaggtaaagctggaggcaaagatattagtgaaaatcta

SEQ ID NO: 200098 - DNA, 448 bp, Homo sapiens
tgctgtgttattccatggtggaaggcaggaaggtgagggagggagagagcaagagagactggggaaggaggctgaactcatcagaggctgaactcatcattttatcaggacccactcccacaatcagtgacccactctggagacaatggcattaatccatgcatgagggcagagccctcacaacctaatcacctcttaaagatccaacctctcaacactgttgcgttgcggattaggtttacaatgcatgaactttgggggacaaattcaaatcacagtgataatacttgaaagagtaaaagaggcttgtttgttcctaaggtttctccttattaagccaagggtcaagaatgtggagcaaatgatgatttattgttttaagactgaattgtggcttaatcttggttcaaagagaatggaaaaggctgttacaatgtcagaatggtag

SEQ ID NO: 200099 - DNA, 196 bp, Homo sapiens
tcagctacactgaagatatcttaattttatttaaaaaacagtcacgttcatctgaagggagggagtaccactaggtaggatggatagataaccccatggggaagctaaacagtgaggtcgggcaccgcgactggcccagctcccacaggaaccccatctgtgcagtgggtgctccctcaggccacccaggacccgg

SEQ ID NO: 200100 - DNA, 615 bp, Homo sapiens
ctcaaggtgattaagctactaggtagtggaattctagtgggtctagatctggacttgatggctgagttcttactaatataccttgctactttggaagaggaatagagtttcaacatgtgttgggcagaatattcaaagctaaagaaatagcttgcacaaggtagggagatgggaaagtgaagtgtctgtggtgatgaactgaagagtattgaaagtggacaataagactagaaaggtaaattaaagccagattttggaggcctttcaaagctgttcacaatgtttaaactttaatctgtagatgaggggagccatcaaaggatttttcaactagggagtgacactaggtttcaggtttgcttcattagcagtatggagtatgtgtttggaatctccacaggggtcagtacagaacaggatgacactgctaggagttggttctcaatatgtttcttcatttggtatattgaaatcagtaaaagtaaaatattttggaaatctcaggtttcctgtatttcaatttttttatgatgttatttggttagaactccccaaggcattttatttcatatcatgtttctcagcccatttgatatcttccaggatttttctaca

SEQ ID NO: 200101 - DNA, 543 bp, Homo sapiens
aagtgtctgacatccagccaggctctgaccccacaaagccagatgccacattggtggtgaagaaccatcagctgattgtcaccaggggctcccagaaagactacagaaaggatgtcagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccagacagctgccagcctctacatgccttcatgagcctctgctccagggaacaggcaactgggacccacagcagctcaaaagaggggatggctagcaggaaggcaacttcttgggcctctccactgacacagctgagagacagagttggttggactagaactttagggattcaaatgtatgacagcttgggggaaaaaataaagaactgactctg

SEQ ID NO: 200102 - DNA, 539 bp, Homo sapiens
tgttgttaatttccatattgctttttgaaaggagaaataagatattgttaaggggcccaaaaatatacactaaccactgtttttttcaagaaaaaaaagccatttttttctcttagataaatattttttagctggttttaattttaatgtgcatcattgctaggtaggcaagaatgatcttgaaaaagaaagcttttgtaatattaagccaacaaagacattgcctgcaggataaatgaatagttgaacatattcactggttacatggtcaagttttatctttaacttattttaatataagatggttactatgtttcatattaagagtgtacccttttaacagtaccttataaataattcttaagcccaggtagggtgagttagaagtatctagttttacaattagaaatatgaaatgagaaatcagtgctcctttgtatgactaagctcaagcaggatttaaggcagggaggggtcaccactgattgatcttcaaatcttaccatgtctaagactgttgctgctgccatttgtctttc

SEQ ID NO: 200103 - DNA, 400 bp, Homo sapiens
tatatgattccatttatatagcattcttgaaagtgacaaaattagcggtttccgggagtcaaggacaggttgatgtgggagggaactgggtgtggctgtaataaggcaacatgagggacccttttgatgatggaaatgttctatatcttaactgtatcaatgtcaatatcctgggtataatattgtcctgtagtttggcaagatattatcattgtatagtatcttgtattatttcttacaatggatgtgaatctataattatcaaaaaatgacaatttaattaaagcatatagtaaataagtaaaaaaataaaaacagactacaaaaatggtcaaaaaagcatgtatgtggacatttaatcttttctgtatgattaaataattaaaatattctcatattt

SEQ ID NO: 200104 - DNA, 264 bp, Homo sapiens
atagcaaaagctaatttggtcgttcactagcactggtagtcaatcctattttacccatttcaaccaagctgagtgaatttctgagcatacaaatctaatgacctttccatagttaaagtgcatagaatatactatgtgaaagagtatacgtatgtgtgagatggagagaaagaaaaacagagcgagaacaaaatcaggtttatatgaaatggaattaataaaaccttgtgcataaatggcataaccaaagcacctaagtgcata

SEQ ID NO: 200105 - DNA, 523 bp, Homo sapiens
attaaacctgatttctttataaatcacccagcctcaggtgtttcttcacagcagtgtgagaacggacgagaacgccatgtttaagcggaaattatcaaggaattactgcttccgggagagaagcagtaggactgggcactggcagccactttgggggactggtgacgaggcagcgtggggctgcagggaggacacattccccagctggagcctcatgatggtcagggtgagttcgcagggccactgtcaccaaggcaaggtgagcccacaacatgcctggcagcccgggcactctcctgcatctggcaccgtccgccaacacagcagtgggacgtctgggaaggaacagaggctggagcgagagagcatggcagacctatcagtaaaccctctcagggccactctttggtccttctagaaggatccagagaaggaatgtgtgtgtgtgtgtgtgttgcagaaaaatgaagggcctccaggcacaggtgaggattaaatctacacctttatagcattaaaatct

SEQ ID NO: 200106 - DNA, 817 bp, Homo sapiens
ggtcttttctggcagattacttctattttccacaggtgtgggccccattagctctggccacctgagaaagccctcaggcaaagagtcgcaggtgaaagccagcagttagaggttcacagaaatgagtgcagaagcatcttcagttggagagccattgcctcttgctgtgaaatatttgggaatcttcagaaaccatgaagaataacctgctaaagggttttattttgtcagtcaagctggaatgcagtggcgtgaacattgcttactgcagcttcaatctcctgaggtcaaacaatcttctcacctcagcctcgcaagcagctaggactacaggcatgtgccaccacgccccactaattttttaatttttcttttgtggagacgcagtcttgttatcttgaacaggctggtcttgaactcttggagtcaagcaatccttctgcctcagactctcaaagtgctgggattacaggcatgagccaccacattcagccaggaaaagtttttgtacatttacacaaacttataggatattgtgtatatagctttgctggtttgacttcctagaatagctcccaggaacacaaagtacttaattgattagtataaaatgattatgtcatactcacatgttggttttctaaatgcacttaattttcctgattaagaactgaaaatatgctgccagggacactgtgacctggggctcattttgcataaaggtatgtgtatgctgatgggcaagccaaaggcaatgttatcgaagtgtcaactcaaacgcagactatttgactggtccgcaatggagagagtcccc

SEQ ID NO: 200107 - DNA, 953 bp, Homo sapiens
ggtcttttctggcagattacttctgtgagcaactgggtctctcagttctttgggagcaccctgggaaacagtgtggctatgacttggagctgctcaccagttccagtcattctgtggttgagagctgctccctatggatgttaattcttctctattttagattttccacaggtgtgggccccattagctctggccacctgagaaagccctcaggcaaagagtcgcaggtgaaagccagcagttagaggttcacagaaatgagtgcagaagcatcttcagttggagagccattgcctcttgctgtgaaatatttgggaatcttcagaaaccatgaagaataacctgctaaagggttttattttgtcagtcaagctggaatgcagtggcgtgaacattgcttactgcagcttcaatctcctgaggtcaaacaatcttctcacctcagcctcgcaagcagctaggactacaggcatgtgccaccacgccccactaattttttaatttttcttttgtggagacgcagtcttgttatcttgaacaggctggtcttgaactcttggagtcaagcaatccttctgcctcagactctcaaagtgctgggattacaggcatgagccaccacattcagccaggaaaagtttttgtacatttacacaaacttataggatattgtgtatatagctttgctggtttgacttcctagaatagctcccaggaacacaaagtacttaattgattagtataaaatgattatgtcatactcacatgttggttttctaaatgcacttaattttcctgattaagaactgaaaatatgctgccagggacactgtgacctggggctcattttgcataaaggtatgtgtatgctgatgggcaagccaaaggcaatgttatcgaagtgtcaactcaaacgcagactatttgactggtccgcaatggagagagtcccc

SEQ ID NO: 200108 - DNA, 1079 bp, Homo sapiens
ggtcttttctggcagattacttctgtgagcaactgggtctctcagttctttgggagcaccctgggaaacagtgtggctatgacttggagctgctcaccagttccagtcattctgtggttgagagctgctccctatggatgttaattcttctctattttagattttccacaggtgtgggccccattagctctggccacctgagaaagccctcaggcaaagagtcgcaggtgaaagccagcagttagaggttcacagaaatgagtgcagaagcatcttcagttggagagccattgcctcttgctgtgaaatatttgggaatcttcagaaaccatgaagaataacctgctaaagctgagctgggactctgcctggatataacttatggcctattctatatggaaagttggttttctcacagttccactccctttccagatatcagcaaatggccctcctagcccagaagtctccagagagggttttattttgtcagtcaagctggaatgcagtggcgtgaacattgcttactgcagcttcaatctcctgaggtcaaacaatcttctcacctcagcctcgcaagcagctaggactacaggcatgtgccaccacgccccactaattttttaatttttcttttgtggagacgcagtcttgttatcttgaacaggctggtcttgaactcttggagtcaagcaatccttctgcctcagactctcaaagtgctgggattacaggcatgagccaccacattcagccaggaaaagtttttgtacatttacacaaacttataggatattgtgtatatagctttgctggtttgacttcctagaatagctcccaggaacacaaagtacttaattgattagtataaaatgattatgtcatactcacatgttggttttctaaatgcacttaattttcctgattaagaactgaaaatatgctgccagggacactgtgacctggggctcattttgcataaaggtatgtgtatgctgatgggcaagccaaaggcaatgttatcgaagtgtcaactcaaacgcagactatttgactggtccgcaatggagagagtcccc

SEQ ID NO: 200109 - DNA, 643 bp, Homo sapiens
ggtcttttctggcagattacttctgtgagcaactgggtctctcagttctttgggagcaccctgggaaacagtgtggctatgacttggagctgctcaccagttccagtcattctgtggttgagagctgctccctatggatgttaattcttctctattttagattttccacaggtgtgggccccattagctctggccacctgagaaagccctcaggcaaagagtcgcaggtgaaagccagcagttagaggttcacagaaatgagtgcagaagcatcttcagttggagagccattgcctcttgctgtgaaatatttgggaatcttcagaaaccatgaagaataacctgctaaaggccaccaagttctattgaacatcatgaatcctatgctcaagtgagatcagctcaagtgagaccagatatctgaagaccttttcattttcgccaccctcaaatgaaggcatgcaaggtaggagataaaaactatcatgtggaagatgccctccctgtgccaagagaaaagaaacattcttccatgaagactcatagccgagataattccgtataaacagaccttgttaaaagaattatctccctttggcctccccacaaaatttagatacttttccacaattgcctctttaca

SEQ ID NO: 200110 - DNA, 360 bp, Homo sapiens
  misc_feature (316)..(316): n is a, c, g, or t
tccgctttctctttcttgattgcctattaaacctctgctcttaaactcacttcttgtttgcccaggttttctatttctctaccctgagttgatgacctcgggtatttatcccagacaatgatgccacttcacctgggaggctgaggcgggtggatcacctgaggtcgggagttcgagaccagcctgtccaacatggtgaaaccccatttctactaaaaatataaaaaattagccgggcatggtggggggtgcctgtaatgccagctattcaggaggctgaggcaggcgaatcgcttgaacctgggatgcagatgtngcagggaccaagatcgccactcactgcacctggcaatcagctca

SEQ ID NO: 200111 - DNA, 888 bp, Homo sapiens
gcaaaacaccaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagccggggctgactgcaccctgggcaacttcgcaaggcacctttgatgccatttctaagactacagtactgaccccgactctggaaggagactgtttcaccaaggtctcctatcaggagtcactggacacctcgtcaagaccacaccagagtctccgtgcagcggacccaggctctagctgtggctacaacatagggttttt

SEQ ID NO: 200112 - DNA, 568 bp, Homo sapiens
gcacgcaaaatcagcaagtgccatacagtaagtactgatctacaacagaaagaaatcaaggcatacctgcagacttaaacgacatactgaagagccacgtccttgttcaaataattccattccaattccccagagaacagaggtggcatgcggtaggattagagtttcactcagctaagacagaggtttgagtccctgctcggcttagctgtgtgatcttgagctcgtgaccaaacttcttacagtcttaggagagttagaaataacaaatgtagattccagagtgattgaaacagagtaggccttcaggaagtcacagttattatttgtataagcctttcagtttagagtaattttagaattatagaaaagttgtgaatatagtacacagagtttccatgctgttattttattttcaacaatattgttattctgattgtgaagagaggtaaacaatttctaaattacaccttaaaaatccatgacaacaaagaatactgtcactctaggaaacttctgatttatgcacttaaacacaccactccgcatcaggtgaactgatttccca

SEQ ID NO: 200113 - DNA, 791 bp, Homo sapiens
agaaccaggaggcaacaaaggcttgctgcacaagaagggctaagggaccgcttttgtcacatggaaacacaaacagtaccccttcctctataggaagaggccaattcagagggttctgtgcatggaaggacctcattgactgccggccagtttcttcacttcctaacgtagtcaactgccaagcataatgctgtctgcaggagtgacatccagaaggtcaatatttgcccttcctggtgccaaggtggggacaataaattcctttgccagtggctcaaagatttgggtacgccttgcagtgtatatccaaatgggtggaagggctgggtggaggaagggagaattactagggagagcagcagaaacccatctgggtaactatccaggaacaccaggactcccggttgggtcacttgtgataagatgtgggaatccatccaaggacaagctatagatgggctggggatccacagcccctctggacatccccaccccctgcccataacttctctgtaacagtagcaaatctggcaaacttggaggcaatgggtatccagtacataaaccaggagggagataaactagggaaagatgggaataggacttgaaaagattttcttttttttcgcaaaacttagcattcatgtctcaacattttatatatgtatcctgaatagagataatagaaatatagcagaatatacttctgatcctaaaaatgtaagggggggaatggtatagatagcaggtggtggctattatatttaaaagctttactgagtagcatgtgt

SEQ ID NO: 200114 - DNA, 432 bp, Homo sapiens
tgtactgcagtttcactaaaaatgcaaggtttttgtgcctgctgctgtaactgcagtgatggcttcatgaatttccttttcattctttacagtggtccttatgctggattcatttatcttaaaatggcaggcaactgcagctgcagacctcaatctatggttacattatatcaagcagttcaggtgtttcgtgtaatgtcacgacttttttctgcttcgtggaagcactttcagcatcactagtggcactttgtatgtgtcccatggtgttattcaaggtttacaatattgcactaaaaacaattaaaaatatgcaagaatcagaagagattactctttcctgtgatatgtaatttactggagagacagagataatgatctcaagcagagataattcacatcacatgttattttaagtggagcaacacttga

SEQ ID NO: 200115 - DNA, 199 bp, Homo sapiens
cagatcttgtgagaactcattcactgtcacgagaacagcaaggggaaagtctgcccccatgattcaatcacctttcaccagacccctcctccaacacgtggggattacaattcaaatcacatttgtgtggggacatagagccaaaccatatcagactccaaacccacaccccagaaccagattacccaaagtgctgcca

SEQ ID NO: 200116 - DNA, 374 bp, Homo sapiens
ttcacgttatacatttcaaatttcaacatacaaagccatgaaaaaaatttcaaagctccgtaacttgactcctccctcccagccttctatgccccaggtaggtatacttttccattgaaagaccttttattattaagaaggtaaacaccttccctcccctgaaggattcctccttccatttaaggaggtacactttaaacggctgtaaaaagttttattctcagctctagcacaaaagagttgcattttttacccaataatttgattttttcccttttctatagagacagtatatcattccattgcccaggctgaagtgtagcagcacaatgaataagctcactttaactcaactcctgggctcaagtgatcct

SEQ ID NO: 200117 - DNA, 550 bp, Homo sapiens
atcaacaaattatcaccatgggatgtgaggcaagtactggtggggaaaatacctcagagttgtctcacaataggtgtaaaaacaggtagggtatttatccaccaaatcctggcctatcattgaatgaaagctgcttcagtctctctggcatttcaacttgccctgcaagtgagctgagtgtgctctgagcatgccagaacagacacctttcagcagagtgctgcaggtgtccacaggaagcagccttcaatctggagaagtgagtgccaagggtataagagcaaaaaacagtatctgctaaattgcaaacagttacaaccatgaatctgaaaatagatgaactgtcatttgctcaaaggaatattatataacagttcagatggacagtgtagctctacaatagtgaacatcaataaatttccaaataagatattgagaaaaaatggaatttgtatcataataattaatatatgtaacatttccatgcagtttaaaagaatgaaaaactatagcaaattcaggaagagcaggtgcatttagagaatagcaa

SEQ ID NO: 200118 - DNA, 466 bp, Homo sapiens
ccatttgcttttttaaattaaaaataattattaaaaaaaggaaaactttaaggaattcacaatcaattgcctgactcattttgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttggttcctttttatttctcatgtgggctttgttttgtttttgtttgggtagatcttcaatttggatatttggaggagtgaacatcgttgttttgctggagggaagatcttgatggtgtttctttccccaaaaattgacttagatattaaaattggtgcttataagagagagttaaaaaaaaataggattgcttcaattaaaattacaa

SEQ ID NO: 200119 - DNA, 958 bp, Homo sapiens
aaccaggtttactttgtatctcaaattaattatacccttgtgtagttttttagcttttgtctgcagttggggaataagggtaactttctgtccttaaatatgtagggctgggagaaaacttaaaacttggtggaagaagtattctgcctttgagggagatctccctacgcattcatttcctgttctagttaacttcttaggaactatccagaacagcccagactttgtccttgtcctttgtagaacaggatgtcctgcaatggtttaacccagtgaatctagtatcccctggagtataaaacctagagtggaatagtttcagctgcagtttgatgtggggcatgcacagaaaagacttcatttctcccaggcagctttcctgacacttggggactggcttgccatggattttaggcttctcttgcttcttgttgcctgtctgtgagtaataaagttgctttgcttaacttgatgtgacagtgttctgtctcacaagactcatccttggcgtatgtgcaaaactgagcttgtgtaaaaacctcctgtcagtgatagactttagtagacattcatgagggctttagagtcctcctctgagagtgatactggtgcatagtattggcgaggtatttagaatcctcctctgagattgatattggtgtgtggtaatcccctctcagggattgatactggtgcactgtattctacttcacattaggggccttataaaagagtgaggaagcaatgatttatattcttaggaagcttacaacgaaacataatacagatatgtgaaaagaactaacgtggatggtttcagatggttgagaagtcattggaggaactgcagtcagcgtgtcttcgagggagatatctactgatgggattggtgtaggaagacagtctggcagtacagggcagcagggacagcactgaagcagaaatgaataatcttcat

SEQ ID NO: 200120 - DNA, 371 bp, Homo sapiens
caatactgcagccactagtcatatgtggatcttgagcgcttgagatgtggttggtccaaaatgagatgttttgttagtgtaaaatacatactacatttcaaagacttagtatgagttaaaaataaaattcctcaataattttgtattaattatgtatgtgttggaatgatgtttttgacatactggattaaatttaaaatgtattatcaaaattaattttacccgtttcttttactttttaaaatgtggcaactaaggtcagatgtggtggctcaagcccataattcagcactttaggaggttgaggcaggaggattgcttgaggccagaagtttgagaccagcctggcagcatagtgaggcctcatctct

SEQ ID NO: 200121 - DNA, 390 bp, Homo sapiens
gcacctctgagtttttgctacggtaggttggccacttagaaatgactgcaaacaaagattgcaagggaaatgtaaaatccagacaccctaattgatttcctaggatgtaaatgttagttctaaaaggaaaccattttaaagctgttagtttaatggggtgcccaaccgatgcctattcaaagttatcagtacagattaaagataaatttttcaccgtgaagcaaaaacttctttaaaataagaatagagatgacttaatcactaattttttcttcgttatcatggcttaaaacctcaagactgctaatattctcaagaaaacacagattaaaaaccactttttaaagggttagtatttatcaattaggtatctcgactcagcatctctca

SEQ ID NO: 200122 - DNA, 352 bp, Homo sapiens
tgtcagtatttgagttttcattgacttcaggaatagtcactaaagcggagtgaatttctggatcttaacctcatgagagaggtcaatagacctcatttgtaatataccttatgtttgtagaatacctgtcaggtctttcagcaaacttttaatgtggcactttcatttcatagatttaagcatagaacatactgttcaagaatgtgtgcaaataaatgtctgagtggggtatctaacccaggctttttaatggattactctgggatttatttcagtcagtaagattaggtttttttccattactgtcgacaaacttaaggaaattttcatggaaatcccactctgcgagtag

SEQ ID NO: 200123 - DNA, 561 bp, Homo sapiens
tctgctgctttagaatttggcccttgtaccatggacctcattgtcctgtgtgtgcattgctcaggaaaacaccttggagcaaggcagtgccctgagggctgcctggagccagtgctcttgttttaatgtaggtaaaaatctacactcttaccccacaggcatgatttcatctcacaatagagagcccctgtatgctttgtaagtggtttctgaattcaagcaagcattttctctcttgagagaagcttacaggtcatgttcttgccagactacagacatgactctctgatcctcttaggtagcagggccagttcaggctgtatatcctaaaactaaaagtggggtactaaggtgggagctacaaggaatgaagggcaatgactaacagacataagcagaaaaacaaacgaatgggctctgcttgactctgtttatccacagtcatgatttacacgtgaagaaagatgcttaagtttattttataaaagattattttcagtcagagatagggatggaatgttagacgttaatttaatatggaacagtttatgcagactccac

SEQ ID NO: 200124 - DNA, 151 bp, Homo sapiens
cctgtaaatgaacctatactacctcatgcaccactatacttctagcactgagcacttctagactgacacactgtgagttgttgattggatgcaaaaatcacgaaacaaaagaacatgaaactacattagtgtgagtaactcacatgaaata

SEQ ID NO: 200125 - DNA, 157 bp, Homo sapiens
gctcattcagtgtttggcacttgggcccactgctgagggagagaggaatagagtgaaaagggggcaggtctgggggaaggggctacactttgcccaggaagagtcaaaagtgaccaaaggtagattcagatgctgagacacatgacacggaagtcaa

SEQ ID NO: 200126 - DNA, 743 bp, Homo sapiens
gagataaattctgaaatttttacagctgacattaagttaagcctggcattttcaaagtaatcccacagagtaaggaggagggtagaatatgagggtgcatagatgaaacataagttgatgttagatatacatgggctttcccttgcttttgactttcatatatatttgaaatttatcataatcaaattgtaaactaaaatttgcttcaaattttaaaataattggaagacaagtcacagaaaccatagactgagatcaaaatatttataaaagtcatacccagtgaaggactattaaccaaaatatacaaagaactcttaaagcttaacagtaagaaaagaaacaatccaacttaaaaataggtgaaagatctaaacagacacctcagcaaagatctacagatgacaagctgtaaaatgatgcctaccatcatatattattagggacttgccaataaaaacaataagataccattacataccaattaaaatggccaaaacccagagcactcaataccaaatgctcattaagatgtagacagagcaatagaaattctcatttattgctggtgggaatgcaaaatggtacaaccactttggaaaaccgtttggcagtttcttataacactaagcatgctcttaccatacaatccagaaatcatgttctttggttcccaaatgaattgaaaacttaaatacacacaaaatgctgcacacagatgtttatagcatctttattcataa

SEQ ID NO: 200127 - DNA, 413 bp, Homo sapiens
aggactgggtgaagggaggacaaatggcagggggaccagaccagccctgggaggtggggagatcacagccaaatgcctctttacaagcactgtccctgcagagagctaggccaggtgagtttgggaatttgggtaggagccagggatagctcaaaggttaagtgtggaccctgaagccagactgcctggttccacgctgtgtgaccttgggcaagtcacttaacctcactgggcctcaattttcttgagtgtaaaagggaaataatgggccgggcacggtggctcatgcctgtagtcccagctacttgggaggctgaggcaggagaatcacttggacccgggaggtggaggttgcagtgagccgagattgcgccactgcagtccatcctgggtgacggggagactctgcctca

SEQ ID NO: 200128 - DNA, 304 bp, Homo sapiens
atatagtgcatgagttaagaatgtgggctgtgtgtcacacagactgtttcccatgttgccatgcccagccaaggtctctcaacttctctgagcttcagtttttcatgtacaactcagtttcgttgttggcttttagtgaaataatgcataccatgtcttgtgtggcacattaaataaagactcagtaaacgttcaagatatgttatcattgtttttgttattattaggaattccatcatactgacataactgatcttatagatagaaagcaagagaagagggaagtggccattgactttgtagt

SEQ ID NO: 200129 - DNA, 301 bp, Homo sapiens
agaatttatttttccccaacagctttctgagttgatttaagagattatttccttaatttgttgtctattgggtttaatgttggctttttgaaataattaggtaaaacccatttttatattcagagtcatgaatattctcatgggccacagttctctttctaaaagcctaaaaatctattctaaaatgaattgattgaaatattttagtgctcttttgttcatgcttcgtttttttaaacttgaactttacctcgttagatttcataatactttcttggcattctagtaagacggcaagcgg

SEQ ID NO: 200130 - DNA, 371 bp, Homo sapiens
ggggccttgagtcgtggtggctggaagctaaacctgccacctctggaatattctctgtgctggatctaatcttgaaattacatttcctctgctcaaagcctgtctttgaaagtgggggtgtttccggtggtttgctgcagtttggagtactgggaactaaataaagcctttgctactttcatctagtctccgggcacacccctgagtaatccaaaggccatcagacggattctcgtgctggactttcccctaccttaggccacatctcactatggagtgaggatcaagaagtaaaggtctgggaaggagagagctgcaggggccagggagactcttcgtgagtcggagagccatcagcggcccaaggaaaa

SEQ ID NO: 200131 - DNA, 739 bp, Homo sapiens
cactctgttgcccaggctggagtgcagtggcgcaatctcggctcactgcaagctctgccttccgggttcacgccgttctcctgcctcagcctcctgagtagctgggactacaggcgcccaccaccatgcccggctaatttttttgtatttttagtagagacgaggttttaccatgttagccaggatggtctcgatctcctgacctcgtgatccaacccccttggcctcccaaagtgctgggattaccggtgtgaaccatcgcgcctggccaatttttgcatttttttgtagagacggggtctcacttcgttgcccaggctgaacttgaactcctggccttcagtgatcctccctcctcagcctcccaaagtgctgggggtatggatgtgaaccgccacacttggccagaactgggttcaaattctgacactgttgctttcttgctgtgttacctcagacaggtgactttacttctctgagccccagttttcctatctgtaaaatggcagttaacattattgattcctcagaatcattgaagatccagtgaggtgacgtgtgcagagaactctatacactataggtgcttgagatatcacgtctctctctctctggcatcccaggagcagttctgtccctcccttggtagtgctagaggagggtagtcggccctgatttatgtgccctctcctgcctcctcagatgctggggacttcccctcccctggaacttgctcgcc

SEQ ID NO: 200132 - DNA, 234 bp, Homo sapiens
ataaaaggaatccagattggaaaggaagaaataaatatttatttgcaggcaatatgattgtttatatagaatatcctaaaaacaatgtcaatgagaaaagaaaagaacttttatctgaggaatgtgagaccttttaaattatcaggcccatagaaatgttaaaatgatacagcaatcatatcctacttcctcctttaactatatattcatccttaaaactgtttgctgttgcca

SEQ ID NO: 200133 - DNA, 524 bp, Homo sapiens
gagctagaacagagtaagattgacagtgtaaaaaatttgaaaaattattatgtaaagtcagtgtattgtcaggtctcacaggattcagaagaccagacaataccttgataaagatgagagagatgaaaacaagagagagcagagaacagaagctttaaaatattagttgcctcctccaagacacaatagagatcaaaattacaattaaataacattaggccgggcatggtggctcacacctgtaatctgagcactttgggaagccaaggcaggaagatcacttgaggccaggagttcaacatcagcctgatcaacatagtagaaccctatctctatgaaaataaaaaagttaaaccttatctctacaaaaaataaaaaagtaaggtggtacgtgtctgtcatcctagctacttgggaggcagaggcaggaggatcgcttgacctcaggagattgaggctgcagtgagccttgatcgtgtcactgtactccagcctgggtgacagagtgagatgctctctttcta

SEQ ID NO: 200134 - DNA, 428 bp, Homo sapiens
tttttgaaagagcacaaaaaaatcataactgtacggcttgttaattttcacaaataaatactcatgaatccaggatttagatcaagaaccagaacattaccagcacccagaaaccttcctgcaccctcttccactgagtggccctttcaacccttacaaagccggagagctcaagttctgggccctgtggccttggtgagcaacaccctggaccgatcagaacgacccagtgagttgggaaaacgctccttttaccgataaacttgaagcaactcatgactgtggctctggcaccacctcagcggaggcggaagtgccatagaacttttaaaaaatatatttaccaagaattaaaaccaggtgaaatagtcttgtatttggtagtttaagggaaagcaattggctggattaaaatgtattcaaatgtc

SEQ ID NO: 200135 - DNA, 350 bp, Homo sapiens
agggaaatctgaggactaagtcaagggtactccaaagtttagcatcactgaaaggaggaggaaccagcaagaggaacaagcagtgaggaagaaggagaaccaacagagggtgtgtcctagaagcggagtgaggaaagtgtttctagaagacgggagtgacagattgagtatgatatgcactgaggactggctgttggatttggcaatagggaggtcactagtgacctggacaaaagccatttcacaggaaggatagggaaaaatctgactagtgagggttcacctgagaatgaaaggagagggggtgacctaaaggggaacagagaaatggagaggtagctacaggggga

SEQ ID NO: 200136 - DNA, 334 bp, Homo sapiens
acgggcacaatgtgcttattaataccagcttagctgtgccgagctgttctcatgaaacttcaacctcctggaaaccaatttaagtcatccaggctgactgcagatgagtggcatgttgctattacactgtttccattaggactgctagacttgaatgcttcaccttcagaatctttcccctggattttgtccagagttcccaaattgcagaggatctgctaattctgatgagaggttacagataaaatgaactcatgagattatgtcattagaagttggttgggtaaaaactgaacttgtaggtatgtgaattgagccctacatctgaaaaggt

SEQ ID NO: 200137 - DNA, 371 bp, Homo sapiens
ataaacttcctaagtgatgttgaaatgtttacactaccctgctccaaaatgagtcagctaaattccagttaatatttaaagagacagtgtcaactaaattaatactgttgttaaaagtaagttgtggatcttggtcactccacacaagctagattgtcttaatatttgtatggtgcacttttacttacaaaagggaagataaaatgttttggggaataattaccaggggtctggccaggtcaaaattggttagtccccttctcccatcttctaattttggtagttaatacttgttaaaacatcgttttttaataactcactaaaaagtgtattctagtatgtagttggaaaaaatgactgaccacaagtta

SEQ ID NO: 200138 - DNA, 617 bp, Homo sapiens
gtgagcatttcaccagcagatgtatttaaagtatgcctggcagagagtatttaggaatgcttagctattatttatctcatcctcatcaataaaaaacaatgataaacctttttacttaattaaatatgtacaccattaagcacatatccttaatttaccaagttttatgtaattaatatatttacaaatcattgcttttccactttaattagctaacagttaatttctaaggtaccaaaaattgagactcttactgagaaagattctcatcctattttatttattaaattagaaaaacagtacctcttaagagtttaccaggtgaatttcttttagatgaaaattctccctcagttattcctgggttggtatcttgactgagtgtcttttcttctttatttatctcaaaggtgagttccatctgcagactctaataaataatgattagtttcaaatcatagattccattttaactcttaggaagggaagtgtgacaattcaggaatgtggtgttcatggaagtctgtgaaaactttgtgtttgggtccattcgtttgttcacacactgtttaagacttttgtctcctgatgccacatgtgacagagaaacttcttca

SEQ ID NO: 200139 - DNA, 514 bp, Homo sapiens
caatagaactctttttacttaaaaatctcaggatttttgggatctgagctcttgtcaaaattcactcaaatttcaccttttccaggacatgatgctgcttatatgtagtcttttctctcccttctaaaatgtataccccataagggcagagatttttgttctcactgctctccagcatctggaacactgcttggcagatacttgatgccaaaaaatatatatattttttaattaattagtgaacaacacaattaccaagcacttaactacgaaccaacagttctacttcacaattcacaaatgattcagttcttaattattatttctgtaatttatgatgtatgaattttttaagtgttattaaatactagttgataagctggatatcacattaatcttgtagtttttcttctcacagtatggcagagggtcctattctcaaaggtgctattggcctgtactcccagcatagatcctccctgcatctttctagtgggctctgtggggcttagta

SEQ ID NO: 200140 - DNA, 359 bp, Homo sapiens
ggactctctagcctcacctttaaaatcttccaggaaccctttctctcactaatccccttcaggcgcaaatactccagcaaaacttaatcactggtttttcacacttgacatgaactttttccattttctgacttttctcaaagtttaccttgtgtagaataatattttatctaactgacacatctaaatataactattcttcaatgccagctaaaagcttatctcttccagaatgccttctttctgattacactaatctctgatcacacctacatttacttgacttatattactcagcatgtttttactataaagtaaatcttgtgtcatcttcctcatttacactgcacattcatcaa

SEQ ID NO: 200141 - DNA, 815 bp, Homo sapiens
aaagtctgtttccatggcctatagacttggagtaccttaaaatgttacctatggggctgggcgcggtggctcacgcctgtaattccagcactttgggaggccgaggcaggcagattacttgagctcaggagttcaagaccagcctggccaacatggtaaaaccccgtctctactaaaaatgcaaaattagccaggtgtggtggcacacacctgtaatcccagctacttggggagactgaggcaggagaatcgcttgaacccgggaggtggaggttgcagtgagccaagattacgccactccactccagcctgggcgacagagtgagattccgtctccaaatagacaaatgcataaataactaaaaattacctatggaatgaaatatttctgatcaccaccgatacttttttttgttaaagagctgaaaggtacttggaaagacagatgatgccactgactcatttaaccaacaaaagctggtggcaatggaaaaggcgcggtctgtccacggtcacgtggccagtgggacccagccccgcccactgcaagctcagaggtctttcctacaggccctcacggggatcagggccaggggttacacctaagccaggcagttggtgcctttgggaagaacacatcctttagcaccagagagaaaaaaaacaacaaaaaatcagcatttctctaccatttacatggcacggagccatttcatttccaaaaaggatggcctcttttaccaccaggaagagcacccaaattcagtgaacctgataccccacacctcccccctcgccctctctgcactcctcca

SEQ ID NO: 200142 - DNA, 541 bp, Homo sapiens
gctgagcacattgggcccgagagcgggtgaggggaggaggcagagaggactcagagtcagaagtgggttggttggagagagttgggggcaggtgaaggtccctggagttgagcagataaaagtgcaggaagggtagggtgctttaaaggtaatccacaaagacaatgacctctaaagtagattcgagactgcagtttcagaagcacgcacaccaagctgtgcatggtggtcatcactggagtagggtgcagatagataagattatagagggattttattatagtagttttttttttcaaggatacagtttcactctgttgtccaggctgaagtgcagtggctatttacaggtgcgatcataactcactacagcctccaactgggttcaagcaatcctcccccctcagcctctttcatagctgggactgcaggcatatgccatcatgcacggctaatttttttagtatttattttttgtagatatgaggtcttgctatgttgtctaggctggtctcaaactcctagcctcaagaatctcctg

SEQ ID NO: 200143 - DNA, 432 bp, Homo sapiens
acatctattttctgaaacgtatatttaaagagaagaaaaaccacagcccataaaggttaagtgatctccattcttcaaagacctaagcagtaatctcaggtttcctggatccatccctaagccctccactaacagcgatgtcctatatagagaatctgctaagatttctagttgggctcccaattatttccctggcctagataaaatacttccttgtttttagcaactaaaatgaaattttccatagtaacaatctggcaatagtataaacttttggtaacgcttaaataggttaaaacctatatgttcaaacagtaaatattaaaagacaactcaatggaaagaaaatactacataaatttaaataatttgaacttactaaattagtcaaaatagcaaaattgataagggataaaattaaaaaccaccgtt

SEQ ID NO: 200144 - DNA, 195 bp, Homo sapiens
aacatggtaagtgaaaggagccacaatcaaaagaccacatagtgtacgactccatttatatgaaacgtccagagcaggcagattcatagacagcaagtagattagtggttgctagaggaaggagggaggagggagagactgctaaagctgggtttctatttggaaagatgaaaatattccagaattagatagtgg

SEQ ID NO: 200145 - DNA, 680 bp, Homo sapiens
gtaaagccggaaagtatgtgggtggctggctgggccatggcctttgtgttagaggtgacctgagtttcttcaaagcacctgtgttagtttttcattgctgctgtaacaacttatcaggaactttgtggcttaaagcaactgtttttatctgacagttctgcaggtcagaaatccaatacaggtctcaccaggctgaaatcaaagtgtcagccaggctcattctctgtagggactctagagaataattcatatccttgccttttccgttttctttcttttcttttcttttttttttttttttggcgggggggaacggagtctcattctgtcgcccaggctggagtgcagtggcacatattggctcagtgccacctccgtctccaaggttcaagcaattctcctgcctcagcctcccaagtagctgggagtagcccagcaccatacccaactaaattttatatttttactagagtggggtttctccatgttggccaggctggtctcgaactctcgacctcaggcgatccacccgcctcggcctcccagagtgctgggatcacaggcatgaaccatcgtgcctggcccacctttttccattgtctagatgccattgtatttcttggctcctggccccttcccctatcttcaaagccatcaatgttgcatctctctgtgctgtg

SEQ ID NO: 200146 - DNA, 524 bp, Homo sapiens
tttgaaaacaattggccagatagaaaaactggtaaaaattactgagaatgtcttgaagtgggtttttgaagattaaccaataagatcagctgcatatctcattacctaacaagtcctcctatgtccattaatctacttatgtatggatagataagcgtttatccacttattcatgcagaaagaacttatcactgtccactatgcaaggactggttttcagtaatagtaatataggatagtattagtaataagtcatatctcaagacgtgtcttgaacaatttgctgaatttctagaagataatcggcaatgtagtacagaaatgattgtaattgtatctaccgtttacttctatgaatgttggccttgtgtggaaatagacaaaaatagatacctgtctctgacaatgaagttacaaaattgaccacaaaagtagatgcaaatgggtaggacattgtcagtgttggtgagtgcaaacttgtatctccttcagtgctaaatatcacactgttaggtattttcagt

SEQ ID NO: 200147 - DNA, 355 bp, Homo sapiens
cagactgagaccctgtctctaaaataaatcaacaaacaaaaccaaaagaaatgtctttcctctcttacacacatgggtatatgagtgtgtgagtatgcgtatgtctgagtgagtgataaaaatccactcccttaatatcatgagtatgtgtgtctatgagtgattaaaactcaataatttaacaaatttgttttatgaaatgaagagtgattgagaactgtgtgggaccctggtgcttccgagagatgatggagggtgcaaactggtagaaaggatgtgaagactaagagaggaaatctgggccacttggaaatatgtagccattgtgagagtagaaagtcttctgctactcatt

SEQ ID NO: 200148 - DNA, 389 bp, Homo sapiens
tagagtggcccatgctctaccttgcagtccacggggctgcaagacgtgaaaatcctaaaagaacgccaccaaaaggcctagggcctccccgagctggaggggcctggggaccccacctcctaagtgtagtggccccatcccaccccctccttcctagcccctgtttacgggagaggttcgcccaccacttatcagacatccaaggacccagagctggctcagagtggggccggcaacttctcagaagattcttagagtgaattccctttttaaaatgaataaggacatgaagagatacgtgttgaggacaaaggctcccagagaaggggagtcaggatggagagttggacctcagcttcctatggccatgacacaagccacagcaggca

SEQ ID NO: 200149 - DNA, 232 bp, Homo sapiens
gtcatcaggacagcctgtgctggccgctgaggccgggatggtgacctccacacaggcggcctgcagtaaggcgagtcgctgttggaaattatttatcacccgagcaggtcattccgtttcagactccgaggcctacgcatctaattgacacagcaataatggcctatgaacttttgatccaattaattgttaatgagaggtttgattagcaaataaaaggcctattaggtga

SEQ ID NO: 200150 - DNA, 216 bp, Homo sapiens
aagtcagcctccatgtaagtgaagaacagcgtaaagcccttaacaaagggcttatgttcaagttaaacttaaggaaaaagcactgagacctgcacaaaggatgccctgaaatcacagagaaaggcgggccggtcgggaggaaaactcaaagactgaagcatatgaagaaaagaccatcaggctgtctgaacagccctgcataacacagcaatgtta

SEQ ID NO: 200151 - DNA, 588 bp, Homo sapiens
caagtggcctcacaaaggcatgtgggatggcaggacagtagtgctcagaggaaaggcagttagcttcttgtctcagctgcccagggaggagatgaagatcataggagaggccaggggaaatctctgtccgaatcaagctaaggagaggtcacatgttctttctagggtgggctgtggcagggccacaggtccctgggccagactgccagagttgttttgctcttttctgtgccttggtttctctcctgccaagtggctgtaacaatacctatctcacagacctgttgtgaggataaatgttgtggttttggccagggaccttgcaaagtgcttttgttaacctgacctgtatggtctgtgtttctcatggtgaatgttgtatttctcaaatggctcaagtccttcaactcaggtccccgagttcagaggagatgctgctggaggggtggcaaggtggggtctcccctcatgcccttggctctgtccatactgacgttgtcaagtgtgacctgtttgttattgcctaaaaacacttaacgagttcaaagcaaagggaacatactttttaattatttctctgcttgtctc

SEQ ID NO: 200152 - DNA, 319 bp, Homo sapiens
tggaacaaaacaaggaggcccactctcaccattcctcttcaacatggtattggaagtcctagccagaacagtcagacaagtgaaagaaataaagggcatccaaatcagtaaagaggaagtcaaactgtcactgtttgctgatggtatgattgtttacctagaaaaccctaaacactccagtttccagatacaaaattaatatacacaaatcagtggctcttctatacatcaacagcgaccacactgagaatcaagtcaagaactcaaccccttgtaaaatagctgcaaaaataaataaataaataaatgaaaaccaaaa

SEQ ID NO: 200153 - DNA, 210 bp, Homo sapiens
atatttttagaaaagtgtttgaaatcttttataaacttcatattttgtttgctcctttatattctgtgttacttaaatatgctctaaaaagcagtggtaaaacagctatttaggaattgaggctgttattcataacttccatgtgagactgccacatattgaactcatattgaactcatattgaaaatatgtcattttatccactgggtt

SEQ ID NO: 200154 - DNA, 254 bp, Homo sapiens
tgcccacctcagcctccaaaagtgctggaattataggcctgagccactgtgccctgcccagagctgccttcttaagtttacataccttacaaggagtgtcatggctgctaaggtctggtttgcaacagtagatggaagaaggatgcagcacggtgcagtggaaagtgagggcattggagtgaggcagatctgagtttcccttgcaatcttggttaggatattcaaacactcaacctgtttccccgcatgtaaaa

SEQ ID NO: 200155 - DNA, 248 bp, Homo sapiens
gaggaaggctttgaaatcttgtaagcagagcagctcggtgatatagagcttccaatgtagccataagctagaagtcaatatgttgtagagatgcaagtcagtgaaatcaaggaagtcaaagaaccatgaagagaacgtgtcagaactgtcatcagtatctattcttgaagtcaccatgaaggataaggatggagcacagggaagaaagggagaagggggtgagcttcatgctaaagctgtctagggca

SEQ ID NO: 200156 - DNA, 662 bp, Homo sapiens
aaggaaaaattgaattaaaataaatataaataaaatattcagaatctaagttgaagccttaggcactgaatatccccattaaaatgcctttccttaaaccttcaaaagaaaggaaaccaagctttgctttttgaaagaaccccccgaccccacatttcaatagctatgtataattcctttaaggagcccagtcagcgtgtgtgggagttgaaaatgcttttaatcatttcccctcaagtttgacagaagtgtggcaaggagggccatctgttttgcttgaatgagaagcgacccagcattctgatttcaattagcctctttgtagctttctgtttgggctggttccatgggtaacggttcagctaagtgtggagaggagcgggccaagttctgccggtgctgatttgttttaacaactgtcaatgaacgtagaacaagcgtacgaggcgatgttgtggacgcacagtgaaaaacataattttacggaatcaagatggcacgtcctagagcctgagagctaaacaaaatattgaaatggtgtctttaaatcatcctattaaacgatgattgagagatttaaaatcagtatcacttctcatctaaattcctagtttcagtcaataaatacgcgcctcctatgtgtaaatacgcgcctcctatgt

SEQ ID NO: 200157 - DNA, 701 bp, Homo sapiens
cccgcgcctttggggacctcgagagcctgcgttccctccaccttgacggcaacaggctggtggagctgggcaccgggagcctccggggccccgtcaatctgcagcacctcatcctcagcggcaaccagctgggccgcatcgcgccgggagccttcgacgacttcctagagagcctggaggacctggacctgtcctacaacaacctccggcaggtgccctgggccggcatcggcgccatgcctgccctgcacaccctcaacctggaccataaccttattgacgcactgcccccaggcgccttcgcccagctcggtcagctctcccgcctggacctcacctccaaccgcctggccacgctggctccggacccgcttttctctcgtgggcgtgatgcagaggcctctcccgcccccctggtgctgagctttagcgggaaccctgcactgcaactgtgagctgctgtggctgcggcggctggcgcggccggacgacctggaaacgtgcgcctccccgcccggcctggccggccgctacttctgggcagtgcccgagggcgagttctcctgtgagccgcccctcattgcccgccacacgcagcgcctctgggtgctggaaggccagcgggccacgctgcggtgccgggccctgggtgaccccgcgcctaccatgcactgggtcggtcctgacgaccggttggttgg

SEQ ID NO: 200158 - DNA, 150 bp, Homo sapiens
caacacaaggtcgagcttctgtgccacagcattagaggcagaaagacaaacaacacattagggtccctattctaatctctgctactgaggggcaggagggagcctgtaacagcttccagaaggaattaatacagcttcagagaaacaact

SEQ ID NO: 200159 - DNA, 1795 bp, Homo sapiens
gaggcgcgtggtagtgatggcggcgctcagtgagactttcctgtcactggctactactactcccaaccctcctcaaagccgccggagcaacccccaggtctttactttacaatcggcaatttgacttgctctgctgcatgtctggagggaccaaggaaagtgtggagacgctccaaggattaggtgatcggagcttgaaaagaaaaaaagccaaacaaataaacaaaacccacccaccctaacaaatatgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagaggagctgaccagtgctttggtgcatctaaaactgcatctttttattcagatctttactcttgcattcttcccagcaacaatatggctttttcttcagcttttatcaatcacacccatcaacgaatggcttttaaaaggtttgcagacagtaggttgcatgcctccgcctgtgtcttctgcagtgattttaaccaaggcagttggtggaaatgaggcagctgcaatatttaattcagcctttggaagttttttggtaagtaaacatagtttaacttgtctattacaacttttgctgtgatattgtgtatatgaaagatttagtgaaagctggatttgttttactctttggttaagtataaaaattgttgaatcttttcatgtgccagtatccataccctgaagaaaagtagttaatgaataaagcaaatgttctcttacaatatattttggaggtttggattttaaaattccatttaatgaattcaaggaatcaattaaaacactatgtgtctccttatagaggttatgtcaatatattgatcatttaatgaggtcttttagattattattattttgtatcatgggactgaggattttgaaaaggaaacatgacccagctggtcagaaagggaatgctaatttacttgttgacatgccatttattttgtacatttcactgtcaaagaagctactggcttggatgcttctgagaaatctatgtgagaaaaaatttgaaaggaagatatgactaatgagtaatttgcaagtaaatgttgtatctatatatatatatatataaagattcaaaagtagttcagctttcataagtagaaccaatataaggacgttgttttagcatttttaatcattatttttaaataaatgatgtaacagaggcttgatttgtgttatgaaagattgagaaactaaattttctgttgatttaatttttttgtgccttaaaactttgttaaattcctgaagttaattatcatattgtactttttggggcataactcattagcagatatgtagtgcagtgatttacaaataattgagagtaaaatcagtgatgtataaactagttcatgagtctaggtaaaatatcaattacctctgtttaaaatgctctgttaattattattgtatgtatttaaatgtagttaaagcttttaaacatgttgttacatagtgttaattctacacagtgctacacagcttttagtgtcacatagccttacagagtttataatgatgtagcatctgcaaaatatatgcatagcttatatcctatttttatagagccagtaatggtttttgtgatgctgtattacttctgggttttagacaataaagtctgtttaac

SEQ ID NO: 200160 - DNA, 904 bp, Homo sapiens
gaggcgcgtggtagtgatggcggcgctcagtgagactttcctgtcactggctactactactcccaaccctcctcaaagccgccggagcaacccccaggtctttactttacaatcggcaatttgacttgctctgctgcatgtctggagggaccaaggaaagtgtggagacgctccaaggattaggtgatcggagcttgaaaagaaaaaaagccaaacaaataaacaaaacccacccaccctaacaaatatgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagaggagctgaccagtgctttggtgcatctaaaactgcatctttttattcagatctttactcttgcattcttcccagcaacaatatggctttttcttcagcttttatcaatcacacccatcaacgaatggcttttaaaaggtttgcagacagtaggttgcatgcctccgcctgtgtcttctgcagtgattttaaccaaggcagttggtggaaatgaggctgataaatgatcatcctctcttttatttctttcagggcatcgttataacacccctgctcctgctgctttttcttggttcatcttcttctgtgcctttcacatctattttttctcagctttttatgactgttgtggttcctctcatcattggacagattgtccgaagatacatcaaggattggcttgagagaaagaagcctccttttggtgctatcagcagcagtgtactcctcatgatcatctacacaacattctgtga

SEQ ID NO: 200161 - DNA, 779 bp, Homo sapiens
gaggcgcgtggtagtgatggcggcgctcagtgagactttcctgtcactggctactactactcccaaccctcctcaaagccgccggagcaacccccaggtctttactttacaatcggcaatttgacttgctctgctgcatgtctggagggaccaaggaaagtgtggagacgctccaaggattaggtgatcggagcttgaaaagaaaaaaagccaaacaaataaacaaaacccacccaccctaacaaatatgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagaggagctgaccagtgctttggtgcatctaaaactgcatctttttattcagatctttactcttgcattcttcccagcaacaatatggctttttcttcagcttttatcaatcacacccatcaacgaatggcttttaaaaggtttgcagacagtaggttgcatgcctccgcctgtgtcttctgcagtgattttaaccaaggcagttggtggaaatgagcagctgcaatattttaattcagcctttggaagtttttgggcatcgttataacaccccctgctcctgctgctttttgaattccgatgctgaagatcgtgtttgcaggccatgagcatctctctttaatatctgtacc

SEQ ID NO: 200162 - DNA, 805 bp, Homo sapiens
gaggcgcgtggtagtgatggcggcgctcagtgagactttcctgtcactggctactactactcccaaccctcctcaaagccgccggagcaacccccaggtctttactttacaatcggcaatttgacttgctctgctgcatgtctggagggaccaaggaaagtgtggagacgctccaaggattaggtgatcggagcttgaaaagaaaaaaagccaaacaaataaacaaaacccacccaccctaacaaatatgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagagcttcttacttaatgcgattctgcgaagcagccaactttgtgggatgcaggagttgaagaaggaagaatgccacagctgtcagcatttctctaaggactgacttcttttgtaagcacctaagaaaccttcagagtcatccagctaatttggatctaatgaaatgccgtgatctcgtgctttatcgtggtatctaagcagcaatcaaagccatttcttccatcaaaagccctttttacaaaagaatacaacattaagtcattttcaaaagccatataacttaagatgtcctagattgtatcattgtgtaatattaaaccacttctaaagcctgctaatttcatggttaacttgtaacttaggaggtagcagtcatat

SEQ ID NO: 200163 - DNA, 1067 bp, Homo sapiens
gaggcgcgtggtagtgatggcggcgctcagtgagactttcctgtcactggctactactactcccaaccctcctcaaagccgccggagcaacccccaggtctttactttacaatcggcaatttgacttgctctgctgcatgtctggagggaccaaggaaagtgtggagacgctccaaggattaggtgatcggagcttgaaaagaaaaaaagccaaacaaataaacaaaacccacccaccctaacaaatatgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagaggagctgaccagtgctttggtgcatctaaaactgcatctttttattcagatctttactcttgcattcttcccagcaacaatatggctttttcttcagcttttatcaatcacacccatcaacgaatggcttttaaaaggtttgcagacagtaggttgcatgcctccgcctgtgtcttctgcagtgattttaaccaaggcagttggtggaaatgaggaccctccttgcctggtgtcatttcttgagctctcctgggaggagattagtctaaaacaacaaagtagccagatgtctggttctgagagagtcccagaggccaggctatggtaggcaacagaaaccgcgtggggctgaagatcaaagatacctgagaattacttatgggcacatagtatgtgtcattcccattattaacagtctgagaaaatttgtttctctaattaacccttttgttggaataaccttaaattttagtgagtatatttctgttttgatatgttttcttttgtgcagtattaagtgcacacaccaaaaaagagaaatgaaaaggtactctcgtgcttgattgaaatctctaagccattattcttctcccaaatagatacgctatcaagtgtgttatcatttatcatgaaatgaa

SEQ ID NO: 200164 - DNA, 1658 bp, Homo sapiens
gaggcgcgtggtagtgatggcggcgctcagtgagactttcctgtcactggctactactactcccaaccctcctcaaagccgccggagcaacccccaggtctttactttacaatcggcaatttgacttgctctgctgcatgtctggagggaccaaggaaagtgtggagacgctccaaggattaggtgatcggagcttgaaaagaaaaaaagccaaacaaataaacaaaacccacccaccctaacaaatatgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagagtttgcagacagtaggttgcatgcctccgcctgtgtcttctgcagtgattttaaccaaggcagttggtggaaatgaggcagctgcaatatttaattcagcctttggaagttttttggtaagtaaacatagtttaacttgtctattacaacttttgctgtgatattgtgtatatgaaagatttagtgaaagctggatttgttttactctttggttaagtataaaaattgttgaatcttttcatgtgccagtatccataccctgaagaaaagtagttaatgaataaagcaaatgttctcttacaatatattttggaggtttggattttaaaattccatttaatgaattcaaggaatcaattaaaacactatgtgtctccttatagaggttatgtcaatatattgatcatttaatgaggtcttttagattattattattttgtatcatgggactgaggattttgaaaaggaaacatgacccagctggtcagaaagggaatgctaatttacttgttgacatgccatttattttgtacatttcactgtcaaagaagctactggcttggatgcttctgagaaatctatgtgagaaaaaatttgaaaggaagatatgactaatgagtaatttgcaagtaaatgttgtatctatatatatatatatataaagattcaaaagtagttcagctttcataagtagaaccaatataaggacgttgttttagcatttttaatcattatttttaaataaatgatgtaacagaggcttgatttgtgttatgaaagattgagaaactaaattttctgttgatttaatttttttgtgccttaaaactttgttaaattcctgaagttaattatcatattgtactttttggggcataactcattagcagatatgtagtgcagtgatttacaaataattgagagtaaaatcagtgatgtataaactagttcatgagtctaggtaaaatatcaattacctctgtttaaaatgctctgttaattattattgtatgtatttaaatgtagttaaagcttttaaacatgttgttacatagtgttaattctacacagtgctacacagcttttagtgtcacatagccttacagagtttataatgatgtagcatctgcaaaatatatgcatagcttatatcctatttttatagagccagtaatggtttttgtgatgctgtattacttctgggttttagacaataaagtctgtttaac

SEQ ID NO: 200165 - DNA, 786 bp, Homo sapiens
ttcaagggggttgggggaagaagcaccaccttacaatttacatcctgctaattacctataatgcctagatgcagtgatgacatggtggaaagggcagatctgttatctgttctctcaaagggaaatgatgtatagatagaaacagagagattcttataaaatagaattctccttggtgagttgctgactaaaattaaattgacataagtaaataaatcttgaatagttcagggattgttcgtccctgctgacagtaacaagaaacttgggtacgggccagattttccactgcagtctgaagaactttgatttcttgaaatgcatgtcaccaaaatttgacaaatgctccaatatttaaacactactagaacctagaactttcccatacaaacaataaaatgtaagactaaaacttaaatgactttattgtttcaataaatataagactaaagttcttaataaagtcactaacagatatcttagttggcagatttactagaagagttctgtacagggtttatatgtagatttgttcagttacaagtttgaaacgttgcagaatttcacattccactctttatacaagcttctattttctgactaagaactgccaccactttcttagatgtctttatgttttcctcattcctgtcaatggcttgaagaattggcattcttctggggaaacatttttcatgagagaaaaagatttttgttattttatgagcatgagaaaattagctatgtgagatgtggatgctgcataccaccatacaccttacagga

SEQ ID NO: 200166 - DNA, 362 bp, Homo sapiens
gtaatgatgtatcatatggctgaccaatgaaatcgaataccatatgattggactgaccctgtgtatgaacatttgttacaagattcatactactatcgatgactattcgaattgatttcgctactattcaaatcggcaatctgatttccggtcatcatactagcaccacttccaccactacaactgccaccactttcttagatgtctttatgttttcctcattcctgtcaatggcttgaagaattggcattcttctggggaaacatttttcatgagagaaaaagatttttgttattttatgagcatgagaaaattagctatgtgagatgtggatgctgcataccaccatacaccttacagga

SEQ ID NO: 200167 - DNA, 897 bp, Homo sapiens
  misc_feature (2)..(2): n is a, c, g, or t
  misc_feature (81)..(81): n is a, c, g, or t
  misc_feature (111)..(111): n is a, c, g, or t
  misc_feature (120)..(121): n is a, c, g, or t
  misc_feature (144)..(145): n is a, c, g, or t
  misc_feature (154)..(154): n is a, c, g, or t
  misc_feature (337)..(337): n is a, c, g, or t
gntgacctgggcattgtacacccggatctcaagccagagatctgctgtactacagcctggatgaagactccaaaatcatgnctccgactgtggcctctcccaagatggagnacccgggcnngtgctctccaccgcctgtggaannccgggatantggcccctgaagtcctggcccagaagccctacacaaagctgtggatgctggtccataggtgtcatcgcctacatcttgctctgcgttaccctcccttctatgacgagaatgatgccaaactctttgaacagattttgaagaccgagtacgagtttgactctccttactgggacgacatctctnactctgccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagata

SEQ ID NO: 200168 - DNA, 768 bp, Homo sapiens
gaattttccatctgactttatttccaaatacacttttttttttaaaaaaccaatacactttttttggggatgacagttttaggaaatccaatttttcaaaaaatactacatttagtctgggggtttagccaaagatttcatccggcacttgatggagaaggacccagagaaaagattcacctgtgagcaggccttgcagcacccatgacacaacctgtgagctggggcgggatttggggccctcaggtctgcttctgccctcataggcaacccaccacataaccccatcctaggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagata

SEQ ID NO: 200169 - DNA, 196 bp, Homo sapiens
aaaggggttcctctgctccgctgcctccttcagcacatccagagggatgctggagacccaggaggggctcagtcaacacttgaaaatgctgagccaatcccacttgagaaaagataaagaaaagaaaaagactaggaaatggagaacatgtgtggattaaaagcagcttatctctgagggagcctttccctgaaga

SEQ ID NO: 200170 - DNA, 609 bp, Homo sapiens
tcagggtagcactaattccaggagacaggataattaagaacacaattctggagttagctacctcagttcagacccctgcttcccaaggtttttaactatgtaatcttggtcaagacattctatatctgttcctggatttaagttttgtctcatctgtcaatggaagttagtacctacttcattagggatgttagcagggtcaaataagattatccatatagactaaatggcagtttctggtacatattaaatcctcagtgaatgtcctgctatcatcatgatagacatcaatgtaattattagccctactattgctcttcatgttgtcaggaagggcctagtgctaatgtctcacagggggttttgtctaaggctcttgtgccatcttctctgatgtgcctctctgaagccatcagtgtattcacaatgtattccccaaaaaggcagttctctaactgcagtggggagattgaactggatagtagtcagaatcttccttggcctttcttgaccaatgcgaaacaggtctcaaatgaccatatttcctgtgcttatacatgaaagactgtcagtgatcactgtgggcttatccctccttcaggctatttt

SEQ ID NO: 200171 - DNA, 189 bp, Homo sapiens
tcaagcagccacctcagcctctcaaagtgctgggattatggatgtgagccactgcatctagccaagaaaatgagtttttaactaaaaactcaacacagaaaacttctgacccagaaagtttcgctggcaactgtaccaaacctttaaggaggaaataataccacttctgcacaacctgtcacagaaaat

SEQ ID NO: 200172 - DNA, 631 bp, Homo sapiens
cccaaattatttttctcttatgggttatgcatttggtattgtatttaagaaatcttttcctgaccaaaggtcctcaagaattttccttatatttttttctagaagctttatagctttaggtatcacatttagacttatgatacattttgagttaacatttgcatatactgtgagatataaatgaaagttcattttctacatatgcatacccaattgttaaacaccatttgttaaataagaaaaaactatcctttccctgctgagttgactttgcatccttgctgaaaatcaattgtctgtatacatatgttggttcatatctagactctcctgttccacatggctatgttgcagtcaatgtcacactgtcttaacctgtggttttataataaggcttaaagtcatgtagtgttagtttatcaaatttgttattctttttcaaacgagtttcagctattttaggaccttttcatttccttaagaagtttagaactggcttggtaatatacacacacaaaaaaaagccttctgggaatttgattggaactgcattgaatttatagatttgtggagaattgctaccctaacaatgttaagtcttctggcccataaacactgtttacctctccac

SEQ ID NO: 200173 - DNA, 135 bp, Homo sapiens
ggggccccaaggttctcctttcatgctgggaggagggtttttccacacgtctcagacccaactctcgggcttcttaacccaaaagaacttccacgcagaaggcagcgaaaatagtgcacttcattttctaagaca

SEQ ID NO: 200174 - DNA, 261 bp, Homo sapiens
taccataacccataagctgagggcagagtggaccatcctaggatgcaatggagatggagatgggagtgggacggggataaggggagtagcagctgtttcctgttaaaacacagtggtgtcaacacaggtaaaaggagctttgtaaaaggcagtggaaaggtacaatgaaaaaaatggtttgatttactttgggagggtttttcctcccaaagtaaatcaaaccatttttttcattgtacctttccactgccttttacaaag

SEQ ID NO: 200175 - DNA, 650 bp, Homo sapiens
ccagcttctcctcaccacccgtgaaaaagaccagaaagattggttgactgttcttggagatgagatgacaggcctgcaggtgcacctgtagcctctgacctgccagtagaatcttcacttgcatgactaaagcagcagcttagatttccagaaatattagcagttttcatttaaactttctctagagaccctgggcagatgacatgaatgaactgctcaaaaatttcctcagcaaacctttaactctcatttttgctgataccattatttttgtaggaataagggagagaaattacagagacagaaggaaagaaaaattttaaagaaagaaaagcattatttgctgtgtaaaggcagttacccaaggctaatatgcagtgtgtcaaaggtataactgaaatatcttaacctgtaatccaaatccaaagaataaacatgaacattaaaataatactgaagcataaaggtctgaaggataacagatatccacagttattctgcaggaagacccatagactaagttggctttccagccctactgaccatccctagaggcttcaactgtgagcctggtagaaaactgtattagaagttgcaatgatttcattttctccatctcttgagatgctaggaaaggtccaaattacact

SEQ ID NO: 200176 - DNA, 456 bp, Homo sapiens
tacagaagactttcagttttatttaagaaaatatttgtgaaatgatttccaagagaagtggctgaaacatcttgttctgtgttctcaaagccagaattctgatccagttctcagcatttgaatgagattgctgtaacttctagtccctaacttggtgctttggattttacagggatcccataaatgtctgttgaaagctttctaatcacaatgttttctgatctataaagaagggttttaatcctgaagatctgggtgttcatcagtaactcagtggacaaacttcattgaaattttctttgaatgtacatggtaagaaatataacttgaactctaaatagctgttgttttatctaatgctgatgataaaaaattttctcaacataaaagaagatatactataaaaatgacttaattttctgaagtatgtatatagtttagcaggtgaactgaatg

SEQ ID NO: 200177 - DNA, 290 bp, Homo sapiens
tcccactggcttcccataatcctttaaatgaaatccagccttctgccagacctcacaaagcccttcctacctatctccttgacctcactaccaaaaccatctccttccctctctaggccccaaccacactggccttccttcagttcctaaaacacagcaagctcattctcatggaaggatctttgcatttgttccatctgccttaaatgctgctcagcctgagcatgttctcagactggctccttattgccttcttttcattgggcagtacttactcagataaaccccct

SEQ ID NO: 200178 - DNA, 199 bp, Homo sapiens
tccggggaaaaggaagtgaagagggccagagcccctgggaagaggcctggctcagatcaaggattctgccaaaaccggaaagtggaggagccaacgactcggggggttttgcttatcaggaaaaggcattctagagggcgtagtggtaaagttaggatgggagacagtggaagcttgcgtcaggggagcgaaagtacag

SEQ ID NO: 200179 - DNA, 509 bp, Homo sapiens
atatctattcttatttaactatcggtaaatcccaagatgtgcattgctgggtcatatcgtaactctgtataacattttgaggaaccaccaaactgtataactaaaggggctgtaccagcaatgtatgagggttccaacttctccaggttcaatacttactactgtatttaatattaattttgtagagacaggatcttgctgtgttgcccaggctggtctcaaactcctagcttcaagtgatcctgccacctcagtttcctaagtagctgggactataagtgcacgccattgtccctggctgatatttaaaaaattttctgtagagtcgtgttcctactttatagtagagatggtgtttcactgtgttactcaggcttgtcttgaactcctgggctcaagcaatccccccaccttggcctcctgaagtgctgaaattacagcgaaacccaccatgccacctttatttactctctctttctacccccaaccccagttgctatgtttcagtc

SEQ ID NO: 200180 - DNA, 341 bp, Homo sapiens
agagacaaggaataaactcttacgtttatgccagtggaggtgccgggaaaatttaagagaagaaaggagagtcttttcaacaaatcgtgctgggaaaagtggatattctcttgcaaaagaatgaagttgtacatctctttcacaccatacacaaaaattaactaaaatgaactatagacctaaatgtaagagctaaaactataaaattgttagaaaaagaagagaaaattaagagtagtccagcgtatagaagggtgctattattgaaagagtttgaaatagtgacttagttattttgaaacatttttgaagacgttatttagctggaaatgacagaaaga

SEQ ID NO: 200181 - DNA, 291 bp, Homo sapiens
  misc_feature (62)..(62): n is a, c, g, or t
attatgtgaacccatctctactaaaaatataatattagccgggcgtggtagcacacgctgtnatctcagcctcccaaagtgctaggatcacaggcatgagagctgttcttctgcccagctttagaacataaatgtttttccacatcttaaaattttcttcctaaatataattttaacagctacataatggagccactcataaacaatttctgtgactgctgtcctgttgtttgctgtttttcataattataaatctgcagtggacaccctcttacatcactgttatctata

SEQ ID NO: 200182 - DNA, 180 bp, Homo sapiens
cattctttctcccatacgtcaaaaaaatttatgaaaccatgtatttcctcacctgttttaagtaaatgcttaattttttcttcattttacaaagtaacacacttacaacatagtatcttgcatattttaaacatgacaagaagttcagctgagccccaggaagtacagggttgcccttag

SEQ ID NO: 200183 - DNA, 476 bp, Homo sapiens
ggtttaattttgaggaaatagtactgttactagcgaggtgaacttggagaagtaagaaagcatcacaaacttgggcctggaaaagaagtaggttttgttatgtggtttttttcaaaacccaaaggacaacacataatctgaagaggattataaactggagacttggggacaggtctaatgagttatttgttgttcccaaaggcacttgacatgtatgtgggattggactactaccagctttataaaaccatgatagcttatagttgactctgtaaatattgaaaagcacacagcagactcatatgtccacagattcttggaaaattttgggttgctatggtgtctttaatttcctcttcaatatgacaactaacaaaagccatataagttgttttggcagacatttaagatactaggaatcttttattgtaaactcttctgtaattttctttgaattttcttctattcacaattag

SEQ ID NO: 200184 - DNA, 456 bp, Homo sapiens
aagaaatttgaagtgcttgtacttacaagaaattatttcttcttctaggatgtacttacagaaactctggtacaagtatacagagacattcattgcagcactgtttgtgaaaatgaaatattgtaataaaccaaaatagtaatcaacaacaaaatggatgtttaaatgtattgttccatggatgccaaaaatgtcacatgtgtactctgaaatagactatttttggcaacagatttaaaaggtgacaaggagtgttggagataaaatataaagaaaattttaaaaataaaacatcgaataaaaaaggcaaactgcagaaaatttaaatgtaataaaatttatgttgaaaataaagttcaggtaagtaagattatgacaaatctagagttctatttcaggcttgctgacaatgtaactattaaaataaaaacaaaatattttcttgaatatctttaa

SEQ ID NO: 200185 - DNA, 409 bp, Homo sapiens
ataaataatcataaaataggtaggttccatgatatatatacataatgcaaaaatgtcagaatctctcctcagttgacagcattaaaatcctcctctgaatcaaaacctgctacaatatcagattaggcttctgaaggctagtgcctaatattcatgaacacgtgtttatgttttgattttttggacctactaactggtttggtcaatgatgcctatgtaagtttttaatcattgttttacctatgtgaatttttgagcatctgcttattttgacctcttatccataatagagagtctgagtagtcagtgcaactttatattgagtgtagcataataacataatatgttgaatttgaaaaaccattgtgtagtactaacctttaaataagaaaatttcatatacatgtat

SEQ ID NO: 200186 - DNA, 371 bp, Homo sapiens
aagagatgagggtctccctatgttgcccaagctggagtgcagtggtatgatcatagttcactgcagccttaaactcctgggctcaagtgatcctcccgcctcagcctgccaagtagggaagactacaagtgtgtactaccacacctggctaattgtatctttatatttaaaagaatggaaaaagatactgtataaacagtatcactaaatataaaaaagctaagtataaacactaagtataaaaaagctagagtgatttttattagacaaaggagacctcagaacaagaaaaatattgctaggagtaatgaagcatgattcatcacgaaagaaggatcaattttttgagaagacacagcggtcaaagcttt

SEQ ID NO: 200187 - DNA, 343 bp, Homo sapiens
tttttgctacacagaattcttttatcccctaaggactcggttgttatagatttagtatgttgtttgttattatggtaagaattttcacctattatctcaaatatttaggtaccattttcacacttctacttgacatttaaagaaaatgaagtacagagtaaaaagtaacaatttaaccaaggatatgctgtgggatacactgaagagctggatgttgaaccttggtctgactaaggcaagtctgtgtcccacagtgggggagagggctggcaggggacgactcccggtttgttgttactagttaataaaaccccaaattctgaacaaatagacaaaccctgcc

SEQ ID NO: 200188 - DNA, 145 bp, Homo sapiens
tgctggctgtatttcttattcatcatgagaaaatgtatcagctgatggagtgttcaccattctttcaattgagaggtgggaaaacaggtgaagttaagttacgagacattgagacatgccctggctaactaaagggctgatagat

SEQ ID NO: 200189 - DNA, 310 bp, Homo sapiens
gccaaaatgtagagggagaaagatgtaaagtcatctcaaaagctactcagagcctgatgctgggcccagctctaagctctttgcatgcctaaaatggcccatttcaacctcacaacaatgtgttactgtcctttttaatgtgcagccagggacactgagattcaaagatccaagcagaagctgcagagatggacttcgaacctaggttttcatttccaaagctcatactctcaaagaacttgaatgttttactggaagatccaatgctattgaaaaaaaattgagtcaggcatagtggctcacacctata

SEQ ID NO: 200190 - DNA, 492 bp, Homo sapiens
agagattcactgaaagttgtaaaaatggcacacagaagcccatgtactctgcactcagtctcccccattggttacattttacagacttgtaggacaatatttcaaaccagtatactgacattggtaaatgtatgtgttgtagttctgtttcattttgtcacatgtagattcatgcaagcactgcagcaaacaagatgcagaactcggccaggcatggtgactcatgcctataatcttagctcttttgaaaggcccaggtgggacagatagcttgagaccaggagtgtgagaccagcctgggcaacatagtgagatcctatctctacaaaaataaaaataaattagccagacatggtggtacatgtgtgttgtcctggctacttgggaggctgaggtgggagggttgcttgataccaggaatttgaggctactacgagccatgatcacaccactgcactccagcctgggcaacagagtgagactgtctccaaa

SEQ ID NO: 200191 - DNA, 416 bp, Homo sapiens
caaaaggcctgtaaatcgattatttagaatgctgattgggtttctcttgtacacttttgctggcccttggctttccaggacctactttgccattgctttctgttccagaccatgaaatctttgttcccataaaaacatagctgacccagtgttgataagctaattacagctaacggattcctggctgacagtgatagaggttgccttgcattttaaaaataacctttgaaggctaaaacaaggaactttttattagccaaatccagtgaacaaagaattttgatcatagcagaattctgtaatcacttaaaactgtttctactcttgggaactaggactaagagcttagtctgagtatgtagttgtatgccatggtctgattggactcgtggaatatcctgtcctgcttccactga

SEQ ID NO: 200192 - DNA, 497 bp, Homo sapiens
gaaggaacataactcaatgaaggtcatatatgacaaacccacagccacctggggaaaagctaaacaccttctctcttagaactagaacaagacaaggatgcccactttcactattcttattcagcagagtaagaaaagtcctcaccagaacaattaggcaagtaaaagaaaaagggtatccaaattggaaaagagaatgtcatattgtcctttgcagatggcataatcttatacatagaaaaacctaaagattccaccaaaatcttttagaactggtaaaggaattcaataaagttgcaggataaaaaaatcaacaaacaaaaattagtaggtgtggacatgatggctcatgcttgtaatttcagcactttgaaaggatgaggcgggtggattgcttgagcccaggagtttgagactgtcctgggcaacatggcaaaacctcatcagtacaaaaatgagctgggcgtggtggcctgcacctgaagttcagctactca

SEQ ID NO: 200193 - DNA, 487 bp, Homo sapiens
caaagaatatttactacatcctatgacccttatcaaagggcagacagcataaactttataagccgactgctaccagcacaacttttccctagagaactccactctccagaattcgaattccaggccaccatccaaaattccaaataccctcagagagggaactctgaggtaaacagatcccatcttcagagagtaaccaaagacgctctggccatgactcaggagattagccactgccttgattcatctctgcaaagtcagcctgtggggcttcccagagccatgaggaggaagtgggccaggaaggaatcaataattgccacccacagatgtgcctgtgagtgctataaagggaatgaccgagaacacctaggggaggttctcagaacacgcagccagtcctctatgttggagcaagtcttagttcttccaggcacgaatttttagtgcccacttctgttccttagcaaaaaaggaaaaaaaaaaa

SEQ ID NO: 200194 - DNA, 593 bp, Homo sapiens
acggctgccttcttcctgtgtcttccctctgtgtgtgtctgttttaatctcctcttataatgacaccagtccgagaggattgggcccatcttgggcctcattttactttgtatgtctaaggtattgtactgggctttagggcttcaacatgggaatttttggagtcacaattcagcccctaacactaggtgtcgtatatgttagtagacatttaatagagctgcacaaagattagaataaaagtgagctatgagctctgcgtttagataacccctgggctcagctgtggccctgggaattttatgtgtagccgactccaggcaaggcagtgggggtggccatgtgcaccccgaaggcagacgcctggggagctcacaggcagagtgtgggacttctcaggatcccaggagcgtgggctgggatggtggccatggcgatggctagagtgaaggagtttggggactgtcagatgagtccctgatgaggccccagcccccatctcctcatctgtaaaatgggataatactctcccctcactgggttcccatgaggtgatgtgaaatgacctctttgtagcaccaggcaccagtggg

SEQ ID NO: 200195 - DNA, 399 bp, Homo sapiens
tgtgagctatctcaggacagtaagattttctgcatgtcagcagcccttccaagtccttgacaatgcgtaccagaaacttccagaagccgctgggcagcatgtgctttgtgttttcattgcttctctataaccaatgttgggcatcaagatctggcccttgaatcttctatgaacgcagttgtctctgggtttccaccggttatgcttaattttgacatattgttctgactggtggtgaatgaacttcttgctcctctttttgatgatcttgggcttcatgaggggtctgatggtggccatgatggtgagtaagagatggctctaaaaatcaaccccaaatggatcaaagaccttaaatgtaggagctaaaattataaagctcttgaaagaaaacataag

SEQ ID NO: 200196 - DNA, 469 bp, Homo sapiens
agtggtttgctactgtgcatatcttcccagctcccttttcactgttatcacagttgactatggtggtagttgttggcatttcctgaacatatcacactgattgtgggggcggggagggagaatcaaagttggagaggtcatgagaaaccatgtacaaactaaaattatgggagaagaaactatgagtgaaacgatgagaaaaacctaatgcatgatgtagaactgagtggtgttaatagcagagcactggagggaagggccacaaaactcttcaccccaaggtctagaatcattctagaatcatcctacaagcctagttttcatgagattcagccctattttatttcttgctcttggaattatatgaaattacgaatttctgtgtgttgccagctgtaatagaataccctggaattttatttacttttaattttgtttatttatttatgcttatgtgccatcttctcat

SEQ ID NO: 200197 - DNA, 523 bp, Homo sapiens
gatcaaaaatattcaggaaaaaaggttggttacatctgtactgaacatgtacagacttttttccttgtcagtatttcctaaacagtatagtataacaaccatttcatagcatttgccatatattaggtattgtaaactagaaatgatgtaaagtacgtaggaggatgtgtatagcttatatgcaaatactatgccatttcatgtaagagacttgagcattcttggattttggtatctgcaggggaccctggtaccagccccctacggatactgagagacaactatatttcctcacttcctggtctttcagaaaaagatataacaccgatccctttccttttgggatttaaaagccaaaccttgcctttgtttttccctcctcccttcctagcctttgttttcttttttccttttttttttgagacaggattttgctcttgttgcccaggtggaggttgcagtgagccaagatcatgtcattgcactccaggctgggtgacaaagcaaggcttcgtctcaggga

SEQ ID NO: 200198 - DNA, 164 bp, Homo sapiens
aatgaaattcttatacatatagtcatgtgccaatgttttagtcaacaatggactgcatatatgatggtggacccagaaggtaataagggagctgaaaaattcctcctagctgtcataactttgcagtgcaaagtgttaatcatgtgtttgtggtgatgctggtg

SEQ ID NO: 200199 - DNA, 417 bp, Homo sapiens
gaacctgggcagcggaggttgcagtgagacgagattgcaccagtgcactccaacctgggcaacacagtgcaactccttctcaagaaaaaaaagaaaaaaaaaaagaatatgggtccagatccatatggatcctagatccagatcacggtgttagaacatggaaaaacattgcaagattctgctaagtgaaaaaagcatttgcaaacagtatgtacagtctatattcagaggaggaactgctgggtcatagatgatatttcataggtattgccaaaccgttctctggagaagtggtatgggtttaccctgggattcttctatggagggaatagttgagctcccgggcttgctcttctgggtgcccctccccgcttcctatccaccacaaggagctgcaggggagcggggcatgccggt

SEQ ID NO: 200200 - DNA, 202 bp, Homo sapiens
gcaactattatacatcaggcattaggttaggcctccacatacaagcagagaccatgtctgtctagttccttgcaattgtgatcttaaagcctagcacatgggcatgtgcttagtatttgttaagtggaaggatggatggatagatggataaatggatgaatggatggatggataaatggaaggatagatgaatggagagatg

SEQ ID NO: 200201 - DNA, 559 bp, Homo sapiens
gaaatgataaaggagggtgaagttggtggttaatcagaagtaggttttccaatcaagcctccctcttggaagagatgcaaaaagctgcggcaagcattacattttgatgtgtgtgttgggatagaggggatttcactcgtgtaatggaaggggtggtgatggaggcagatccaagtgctactccgttcttgtttattttgacgaatcacactgccatgggtgaagcacagcagcttaaaaacctggatgtacatgcatatttattagatatatgacaccaaaacccctacagtactaaagctctataatcagggggacagaaccaatatccaaggcaggtctatggagcttcaaagtctatattcttacacagttttgggccccatttggatacaggaccacagtgggatgaaactatcttaatgcacctattctctctctctctttttttttttttttagatggagtcccatttcttcgcccaggctggagtgcaatagcgtgatctcagctcactgcaacctccgcctgctgggttcaagcaattctcctgcctcag

SEQ ID NO: 200202 - DNA, 817 bp, Homo sapiens
tttcaccacggtggtcaggatagtctcaatctcctgacctcatgatccgcctgccttagcctcccaaagtgctgggatttcaggtgtgagtcactagtgtagcaactatttatggttcatgccaccataccgtatggatccgttggtagaacaaacctgtattttttcgtcttctgtcaactggtcctagggagcgtcccgtgaaaccacagatgtagactgaggggtgtgaagtagaagaggcggcagcatgtgtttggtcactcacttgggtcacatacttatgccttctgaatctgttcaggcatagttttgtgtatattatttccagtttcagtggaatgctgtttatgtccagtttaatgatttgtgtataggctgtcctcctatggtatgcctcatgcttctgtgggctgtattgggatcagagtcttgggggtctgcaagcaaggtggtattgttgggttttgagaatcagcatctctctgtgaggcactgtatttgttctcacactgctataaagaaatgcctgaggccaggtgtggtggctgaggcctgtaatcccagcactttgggaggccaaagccggtggatcacctgaggtcaggagttcgagaccagcctgaccaatatggtgaaactctgtctctactaaaagtacaaaaattagtcgggcctggtggcgtgcacctgtagtctcagctactcaggaggctgagacaggataattgcttgaacccgggaggcggaggttgcagtgagccaagattgtgccatttaagcctgggtgacagagcaagtctccatctaaaaaaaa

SEQ ID NO: 200203 - DNA, 655 bp, Homo sapiens
agtgatgaaccctgaggagagggaggggtgcggcatcagggggccccaaggaggagtggagacgaggggagagggaactggaaagcgagagaggaggaggaggggtagggctgggtgctgtgggctgaatgtccatgtctctgcaacattcctgggttggaccctaacctccaatggcatggtgttgggggtgaggcctctgggaggagactgagcccttgtgatgggatcggtagccttataaaagggaccccagagagctcgcttccactttctccctctgccacttgagcacagcgtgagaaggcggccatctccacaccagggacaggccctcgccagaatccggccctgccggcatcctattctcaggcttcagcctccagaactgggagaaaatcaacccctgttgggttttgagacggagtctcactctgtcgcccaggctggagtgcagtggcacgatctcggctcactgcaacgtccacctcccaggttcaagggattctcctgcctcagcctcctgagtagctgggattacaggtccccaccaccatacccggctaatttttgcatttttagtagagatggggttttgccatgttggccaggctggtcttgaactcctgacctcaagtgatcctcctgtctcggc

SEQ ID NO: 200204 - DNA, 544 bp, Homo sapiens
gcataatattcaatgaaaaacgcacaaggtctttgaaaattcatagcaattttgcatgagcttttgaatctaacattcagccctatttggtagcataatccttattttaaaggtaataaacactgaaaagaattttttccaacatgtggattgtgtcatgttagaatcctgaagttttcacatcaaaagtaaattatgtctgggtcagttcagataactctcaattatccggacttaatttatattaagctttagaatcctttggtgtcttaaccattctttcaagaggttgcagttctgtaagcagctggctatggcgaatgtgtaaatcaatttgctgtgcctgactgagtataatggtacttgaccatgaggacaggccacaggaggaagtcaagctgaaatttaaaactcacaaaatgggtaattccagaggataattgaaagttgactgtaattaacttcatgcttttgttgttgtttttaattaattgtttcttagacttgggttacaagcattcagatatgtatggtgctgttgtga

SEQ ID NO: 200205 - DNA, 435 bp, Homo sapiens
agaccagaagttcttaaagcctggtccctggaccagcaacatcagtacctcctgggagcttgttagaaaagcagattttctgtgctcacccctacccactgaatcagaaatgagggtgaggtgtggtggctgtttcacagccctcccgggattctgatccatgctaaagagtgggaagcactgctccggatctgcagagaaatcctgctttcaaagaactcactaacgcccctacaaaactacaatttttatgactagaagctctgtgaataccttaaacaaggaagctgacagatttagtaagatcgcgtaggtcatgatcgcaaatgggctgcccaagggcacgtctttcccttgggtttgtgcatttgtcctgcacacaattaaaaacatttaactagttgccagtattaaagaaatagaaacttccacgta

SEQ ID NO: 200206 - DNA, 174 bp, Homo sapiens
gccttggttttcagtgcagttttatttcattaaataacagtttaaatgaagtagcacaagacagtatttcattacactgctgtatgtgggctttattcacctttattacagctgcatttctgttgtgaggttttttataaaactctgagctagaaaattagtgaagattgtact

SEQ ID NO: 200207 - DNA, 782 bp, Homo sapiens
ctccacctccaccttcaagcataaggacgtccgcgtgttttctctttcagttagctggaggacaggatgttgggaaaggaaaggacagatgtctaaaggaggttgcagagcaggccaggcagacagtgggggctcccttgaagagcttcctccctcccaaacctgggtctcaaagacctagaaagaggcaggcacagcccctgcggacagcagggagccagaaggtttgtagcctattggtgcaaacattggacaaattcctgtgtctttcctagaagcgcactatcacaaacacaggagtgttttgctcctttgtctcctcttccccatctatgtccctttagtcacagttaggacaaatggggaggggacaccatgctgaggcagaaactagcccagaactcactcagttcttctagtgggtgagtgcagagagagaagaactcagatcaccagtagggagaggtaaaaaagcaaacaaagcaggctctaaggcacacaacattgcagaaaatgaggaagggaggggagggaagggacagaagcaaaaaggagcctgtggtgttccccagtggggcagggtgagcaggggcttccaggctgcatgaggctcatggaccagctctgatcccatgcatgtgcgcatgctcagagccctgctgcccacaacagagcactgcgctgcgtgggagtccccacttcccaagctatcagagtcaacgtcctgcctgtgcagctgcagcaaagccagtgagaggtgggtctcgccatgcagtaaggcc

SEQ ID NO: 200208 - DNA, 776 bp, Homo sapiens
aaatatccagaatagtcaaatctacagagacagtagattaaagcaggacagagagaggttgccaggggaaggggaaagcagggaatggtaagtgactgcttaatgggtatagggtttccttttggaccagaaaaatattctgatagtaatgatggttacacaaccttatgaacacagtaattgtcactaatggtcaattttatgctgggtgccttataccacatttttttttaatggatgtgatagacaaggttgtcaattcacttttctctgttcttcccttctaaaaataactaaatattttggaaatagttcaacagacaaccataaaaggattctgatggctggaaagaaggcagtgactgactaggcatctcaggacttgaaggctgacactatggtgagttccctggagttttcttttcatcactcacataacccaaactgggcaccacagaagcctgacacacagatctgccgacagcataaacacacactcaaaagtagaagaaaaacttgctttctccagccaaaagacccggaaagaggaagcccaacagagagggtctcccagtggggagccccaatcccttctccatacctggagcagtgacagaccaatccaacctgcagtggcaatgtcagcagaaccctggatctctgggccctccacccagcatcagacattttaccagaccctacatcttctggcctcccccacccactccagtgataacaagtggcccagggaaatgccttctacccctgtggaagca

SEQ ID NO: 200209 - DNA, 120 bp, Homo sapiens
agaatgccacttttaatatttgaaaatatgaatttttggtagaaataatgtaaaataaagcttctggtaagccttaggcagttaaatttacatcagtgtaaagtaggatgaaaatctgta

SEQ ID NO: 200210 - DNA, 832 bp, Homo sapiens
atgataaatgattggttatcattgttaatcctacaaaatagcagaaagagtcttcaacataagctttaatactatggccaaaccaaattttattatcagaatgacagggcagtggattactgtttctggatcaccagagtttaaacatcacatcttttgctgtgtcgcatctagttgcaaaaagattaacttgtgtgatgggtatcaatttaatttttgttaacatagtaaaggaaatttaactgaaaaaggaaatcgcttccagactctctgcttaggtttaattcatcttgttagcatcaaccaggttgtgtactcttagcaagaattagttgtttgataatccagagtttgaaatgtttttttaatcttcattttcttttttctgtttggggaaatcaccttaatctcagcaatgcatcagaataaatattactacaactctacgaatgtgtaagattaagtgcagaaataataaagaaccaacttatggtgttgataatgatattttagagtagagtagagtagagtagagtagagtagagtaggaggccaggcacagtgactcatgcatgtaatcccagcactttggaaggctgaggtgggtggatcacttgagatcaggagtttaagaccagcctatccaacatggtgaaacccagtctctactaaaaatacaaaagatttagccaagtgtggtgctgtgcacctgtaattccagttactcgggaagctgaagtagaatagcttgaacctgggaggcagaggttgcagcgaactgagattgttctactgcactccagcctggtcgacaaacaagacactggctcta

SEQ ID NO: 200211 - DNA, 1082 bp, Homo sapiens
gatcatttgttcaaagctgtgtatgtttaacatccagagcataggacctgaagggtcatgggcataagagctctcaggtccagtccatccgagggcctcagtcaggtgagtttgccaggttggtaggttggttccacctgtgatacagggtgtcacttaagaggcaggcagatacacacttcagcataagagcaacttgagtggtgtctccagttgatgggaggtgctgcattgtttaaagtcctgctcaactgagagcagtcacctggttggtcattcctgtgtggcagaacgctttctctcaggaggacaaagaaactgaagacaggcgctcctgcctttgggcccagttctttctggcaagggggtcctagttgaagagaagcaaactcatgtttcttgattctgggcaagcagcatctgcccttcagcaggatgtcaagtcaacaggaggatggcctgcagtaggatttgtaggaagccaagcgtgggtgtcctggtcagagcccgatgtttacctgacttcagggaggcagattctaggacagggacagtccaagatgtggctttctgagactctgaaaggggaggaggctccaagatagagttctgaggacagcagcctaaggaagaatgcaaaggggaagcgtgttgaaaggccagagggcacaaacaggaggtctcagaaatataaaattatccatgaacactgatcaagaaatggcactgcggcctgaaggaagacgcttggagagcctagtcactgctgacagcacctaaccatgactgaacatttcctcagtgttgggcagttgtaaagtgcttttctttttaaagttactttattttattttttagagacttggtcttgctatgttgcccagtctgatctcaaactgctggcctcaagccatcctcctgcctcagttcttctgagtagctcggactacagttgtgtacctcgatataacccaacagctctataaggtagatatcattaataccctgttttcatacataaggaaaactgaggcatagaagacctgaagctcacaaaactgttggactcccttgcttccaag

SEQ ID NO: 200212 - DNA, 173 bp, Homo sapiens
agccatgcatagtaattcattatattacaatcagaatcaaataattttgtttaatatttgcttctgaaactggtgcaccatttagctgttttgataccataaacaagtaaattttataaatgtagatatatgagatctttcagttattttgattgactcatttataaaatgta

SEQ ID NO: 200213 - DNA, 941 bp, Homo sapiens
agttggatgatactgaaaatcatgaatgatgtgatttgttccatgtatctgtggaacatccctcaccttcctccggtatgcgccttctgcactccacacgtggtcgcctccatcctccctagtgtctgtcagcttgcctggtcaccaagtcaggaggaagaagatgaggaggctcaccagttgtaggcaagactcttcctctcgggagatcttgtaataatggcccagtttcagggcacagttgtacacattctacttaaatggaggagttcagtgatgccgtggccaaaagagttatgcccatttctaaaagcctggcatatttggtataacttaagcaccaggtaaaatctggtgcttaagttgtaccaagtatagccaagtttaactgtcgttgtgtattaataagatttaatttttatgcttgtgcttttcagagtaaagggcttgctttcaatagtagaatgacaaagcttctcctccaatgacaatctgttagcaccctgttgacttagctcaggacatgagactgacttagctcaggacatgagacatttcctggaagtgatttccatgagaacaaaggcttattcctttaacttaaaccccaaactttgttattttaattattttcaggcaatcatctttatatactttccttacaaacccagtggttgagagcataggccttggtggcaggtgcatctgggcttgggggcttctgccacacttactactctgtgacttgggaagctcttaaggctcccaaggctccgtttcttatgtggaagaagaatagcaggaggactcacctctgcgggttgttgtgaggattaactgggtgatgactgtaagcagctgggagagtgccttgtgtgcagtgaccactgttgctgccaccatgattatgtcacctctcaacatggggtggtgggaggccc

SEQ ID NO: 200214 - DNA, 930 bp, Homo sapiens
aggaattcagaataatccttttaaatgccattcaactgtttttaaaaactctgttgactcccccaccaacctgtcttgcaagcctacctctgtggtctgacttgctgatgttaggccccggagagatggtcaaggttagattatgtggggggttgtaggtgatagcaatgagtttggattttctttcctctgtgccatcaaaaagaagcacaatgacattgtttgctttacattttaagtaaatgtttggaataagtcgtagcaggttaagaatgaaattagggagaccagttatgctgcttcagtagaagaggcaaaaaaccacggtacctggataaaggcggcagtggtgaacacggaaaacagtggatggatgcaggtaataatttggagatacagccaatagaagttgctgctgaactaaatgagagggtggtgatacaagagaaaagacagaattgaggatgacatctgcatctggggcttcagtaattgggtagtggttccaagcacagaattggaaaatgttgtgtgaagcaggttttcagaggaaaatcaataattcccttttggacatgttagttttgagattcttgttaaatatccaaatgtcagacagttaccttcactagcacggagttcaatgaagtgagtttcttgagatacaaatttggaagttatacttttaaatgctcaactggcatttaaagtcatgggtatggatgaaatcacctggggtgaggaattaggtaaggtgaaaaataaaaagattaatccacaatcctcgttctcaaataatgtaggtgagaaaatatacatctatatatctatatgtatacctatatatgattatgtaagtagtagaactccaagatcactcactgcctccaagctccatttttgttcttccaaccacagataatttattcc

SEQ ID NO: 200215 - DNA, 369 bp, Homo sapiens
tgtgttggtatttatttctcattgaggttgagaaggtcttggtgctttgaacatcttcccacctatcctgtgcacaactgcacacactctcaaataatgaaaacatttttctttttgattttacaagctgatattattctctttggagctttggtgtcttagaaatgcactgtaaccttaattacaactcgtatcaggggagttgtactcagttttaagggactgcttcaccgttctaactgtggagaaatgggaagttatttcccagtggctcgaattagaattaatgcactgagctctccagaccacagacagaatcatgagacattgggtaagcatctgaatcggggaattttcagcctcctggca

SEQ ID NO: 200216 - DNA, 386 bp, Homo sapiens
cagtttattttcctctcatcaatctgtcatagctgactgcctatatatctctgtataatacatcagaaagagagctcccgcctaaaacctcaatttactcagtacacttcaaagcctaaaggccttgtaactcctttctcccactaatagtagctggaattcactagatacttaatataactgtaagcactttatagacactctttaatgtaatcctaaagatgccacatagcattataaattatattatgcaacttttacaaaggagaaaactgaggccgggcagtggtggtagttatatacattgtctgagatcacaaagctaaactcacactcaagcagtttaggatagcatagaatcttaaccactagagcatatctttaaa

SEQ ID NO: 200217 - DNA, 576 bp, Homo sapiens
ttttttttatcagggaaaatttgatagtttaatgtttgtaagaatgaaacatctttaaaataaataacattacctccaaatttaacaaagaattaaaaactgagaaatatcttccataaatatgggaatgtactaatgttcaaatattaagagttattataaaccaaatgggggaatagcaacaaaaccccgtaagtattgaaaaagtatgtaaactcacaaaaagaaacaagtagcaaagtacacaaaatataaaagtcaccgtttctagttaacacaactcattgagataccattttctttcaagtaggaaatcagtcaaaataaaaaaagaaaagaagaaaaaggaccttaaggatgccccgtattgatgagggttcaatgcaacaagctcccttataacatacagcatgtactttaaaatatttctgcatcatgacacagggctgtattactaggaatctattctgaggacataattagagatacagacaaaaatgcttgtgtaacggctttcaacaaaagtataccagtagggaataatagtataaaaacaattacactttcaagacctga

SEQ ID NO: 200218 - DNA, 150 bp, Homo sapiens
gacatctaagtgaggctgtcaagtggccagtttgacagagtagtcaggagcccaaagaagaggttagagctgggggtagaagtgtgggagccctcccacagagaggacacagacaggcgcggaacacacaagaccccagagatggagtcg

SEQ ID NO: 200219 - DNA, 179 bp, Homo sapiens
ttgctgagttgtagacagattacaatcgaaagagtatccatagccaaatcctaactagaatgaagggaaaattttaatagtgtacatagctgatgtcctaaaacgttccagaagctttaagagtgtgataagggcctggtacagggactcacacctgtaatcccagcactttgggaggc

SEQ ID NO: 200220 - DNA, 439 bp, Homo sapiens
agtcagataaagaatccaggcaagcacaaggcaggatattaatactcccagataaatgagctgagaactgtggtcctggggggcctgagacacttaacaaagtaggggttcatgactaagaaaaatacaaggccagatcccagttctagtgacaaggtcagagagagtggagatgtcagcagagtgacctggagagtactaagcctcagacctcactgtgtcaaaaagtgattagaatctaatgagagtgcctgggtatcaaacccagtcaatggatactaacaagggttcatgatagtctgagctccactgaacttcactcttcccaaagattgaagtggtggaaagctcctgataactttgccaagagcagaaatggtgtgagtcctgggtacccttaggcttcctggaagctcagaggattgagccttaagaatat

SEQ ID NO: 200221 - DNA, 198 bp, Homo sapiens
tcaaaatgttggggcaaaaaagttgtgaaactcacagtttccaatttaaaacttactaccaaattacaataataaagacagtgtggtgctggcttggggatttggtttatagattagtggaattatagatttggtttatagattagtgaaacccggtctgtactaaaaatacaaaaatcagccaggtgtggtggcatg

SEQ ID NO: 200222 - DNA, 246 bp, Homo sapiens
ctgggctcaagagatctggtcaccttggcctttcctaaagtgttggaattaacaggcatcagccacagcagccggctgaccatgagcatttgagtgaagtgaagccaggcacagtggctcacacctatcatcccagcactttgggaggctgaagtgggaggatcacttgagctctggagttccagaccagcctagacaacatactaagaccttatttctgttatttaaaaaagaaaaaataatggc

SEQ ID NO: 200223 - DNA, 396 bp, Homo sapiens
gatgtgattcagttcttatggagtagagctgtatctgtatttcagtatgtgccccatgtgattctcatacatccaaagttttagatccactttcataaggaatattcatccaagttcataattaataaagaatatcaagacaccaggtaacaatacagatttcaaagtctgaagcaattagtccataacatgtatctttagtaagattttagaacaaatgagctggcaatgtaaagaaagtgttagttacattattccttgaaaaaaattaagattacaattccttttcatatctacaaaataggttagtatagggagtgggttttcagtacagtaagttggctctcagaaatcccagctcatgcaagctcagaaaaaaataaatgaactgaatgg

SEQ ID NO: 200224 - DNA, 294 bp, Homo sapiens
gtttgtgtaactggattttttttttctgcaaagcatgatgctaaatgagatttagacatttaggcctaataataaattgatggctatctgactaaaatatgtaaatctatctatctatatatctatgtatatattcagcttggtgggaactgaaacttatttcttaaatatgtattcagcacacactgtgggccaggagctgtgcctggctctggagatgcaaagatgaataagatgggccctggctgcaaagaggccttagtcagacaagtgggcaggtgggcaggtgctgcg

SEQ ID NO: 200225 - DNA, 494 bp, Homo sapiens
aaccaacttcttgttatctagaaaattactagtaataataactggctagtaactagccagttactaataataactaattaataaccagtagcagttactagtaataataactggcttatataaccctgattttgagaccaatgctagtctatgttaataacatattaatctcattttttccttaccataatcataggagagaggcctggttattatgctaattttacaaataaagaattaaggcacagagaggcagtaggcactcaataaatattggttgtgttatcccattcaactaatagtcactgagtgtaccctaagggccagttctccaacttgaaaactcagaggaatatcagtttgtgtatctcagggagtttctgtaagagggaggaaaaaatgaacagttgaaagcaggaaagtgttaaatataaagccccatgcaaattgttcagatgccctatttcaattactttcacttggaatattttggt

SEQ ID NO: 200226 - DNA, 432 bp, Homo sapiens
aaagaaaataaaaagaaatctatgagctgaagactacctcagggatttcaaatcaatgggaaatgacaaatatactgtatatattgcatcctataggaaacaaatagtggagtgaaaggaaaaatcacccacatggctggacctgagataaaggttcatttagatttcagaattgaattgcttattttaaggtcatgtcaaaaaataatgaggatacaaaggaagtgggtctattagaagagaataatggaataaacccagagagaaacagagatgggaaaccgtggtcactgaaaaaggaatagaacatccagattcctatgtgatttccagtacatgtgaggtctagctttactgttttctgtccttctgtcttaagagatttatctttacttcagtttctccatttaggattctctatgtctcgcaaaa

SEQ ID NO: 200227 - DNA, 487 bp, Homo sapiens
atccagaaagtgaacacaactgaggttctggtttccagtaataatgaagtagactagttcgttgaataactatttcacagataacaataataaagcttaataaaatactatattttgctatatagaaaggcacactgtttagaagactgaatgaagattttatctatgccactgtggaagagataaggattggggtttgaatctattcaaattaactccctcttaaaataataattttcaaagaaatacaacagaatccagagtccctgtagttcctatcacacaatttaaaaattcatgagatgtgtgaagaagcatgaaagtgtaatcgattcacaagataaaaagcagacaatagaacctattctcaagatgtgcaagatgctgtaatcagtagataagatttgaaagaagctatggtaagtacgttcatgggggtaaaagaaaacagtctcatgacaaatgaacagaagcgtaactgtacatt

SEQ ID NO: 200228 - DNA, 256 bp, Homo sapiens
tggtctggttctactgcaattcaaagtgttttataagggtcccaactggtgctgggaagcaggccacgcactgaagcagggcagagagaaggaggatgcagccagtcaggcctggggaccgacagccctgtcacgctgacttatgatggatgagggaaaagtctatttctcatccgcagtgggggaggtgaagtgtaaagaaagatgctcccagagtctctgggcgattcatcttgcagcagataaactctagaag

SEQ ID NO: 200229 - DNA, 109 bp, Homo sapiens
gaggtgtggctcccggtagagggggcgtggcgccctcaccctccccgggccaatgggcaggaggtgagaagtggagaggaaggcgaattatcccatcccaaggtggctc

SEQ ID NO: 200230 - DNA, 352 bp, Homo sapiens
tggagtgaacaccccagaggtgggcaggggacaagtccagcatgggagacaggacccctgggtcaaaggctgttcttaggtaagcttcgtgacaaacatggcatttgagctgggtcttgagtggagccaggagaaaacaggagttttgaaaattcctgagggaaaaaatgtgaacaaagaaagggacccaggaagtagtttattgttaactatcattttcctactatggtatcaaatacaagaatgaatttcttctatccaactgcatgttggtgcccattagtcaacttctcttcctccccacttcccttcccagcccctggtaaacactgttctactctctacctctttg

SEQ ID NO: 200231 - DNA, 297 bp, Homo sapiens
cccgcacccttctaaaacagaattggaatgccagttaaggatgttgcctcagttagcggctccttttctctgatcatcataataagctttgggagacaaaattgaaagtggagaaagagatataagaagtattatggttgccaaagtctggcttgcatgacaaaaagataagttttcttttttggtaattggagagctcagaacacaagagttggaaggagctgactccaagcccagcctcattcccacccaccatgtcctcattcattgtgaaaagagaaagtaggagttatacag

SEQ ID NO: 200232 - DNA, 177 bp, Homo sapiens
acaggttagtacataactagttcacctgagtccaaaactaccaaatgtgaagtagaagctaaatatagaagatgaaaatgtttacctgtttgagagtgagagttaaggtaattattaaaatgaaaatttcatgcttctcctttattcccattaaaaataaataagttcaattccaca

SEQ ID NO: 200233 - DNA, 215 bp, Homo sapiens
tggtgtgcgcctgaagtccctgctactcaggaggctaaggcaggaggattgcttgagcccaagagttcaagtctgcagtgaggcatgacagtgccacaggactccaacctgggtgacagagtgagaccttgtctcaaaaaaaccccaaaagacaaaacgattacagataaggctcaagtatcctctgattgcaccctgttttcacagcaccttct

SEQ ID NO: 200234 - DNA, 322 bp, Homo sapiens
cacggaacaagatgatttatttggtcgaagttttagcaaaaaaaaaatgaagatcatcaatataaggatgcattttatattgactgtcactaaaatccaagggcatgaaacattctcattggaaactatatgtaaatttctctttgaaaatgtaatattcatagattttataagtaaaacattacaaaaaaatgcaaagtaccaaaagatattacaggaaaatggaaattacccaaatcccacgacccaaacactgctagtgtttactttctttccacactgtctcacgtctattctctccactatagtgagagccccaaga

SEQ ID NO: 200235 - DNA, 451 bp, Homo sapiens
gggccacctgccggcgggaaccttgtcacactcatcatagtatccccaaggctacatagtaaacacacattaaagggcacagagtaaacacattcaatattttctgagtggataaattggttaacattgtataattttcaaaactaggtaatggccttaagaagtacgactggcagaataggaaactgagacccagagacattaaaggattcagttggtaagaagttgcagaggcagggctaacaacaaaagcttacctcagtatgggaaaggtgatggccacaggtccctcaaaactggcctaatacactaaactccactcaggaagcttgggatactttggctcttcaagggcaaagcccttgatttactcccagacaggttgctttctgccccaaaaccaaggatgctaagagagggtagctgaggttgccagttagtgagacacgtg

SEQ ID NO: 200236 - DNA, 418 bp, Homo sapiens
gaatagaatgggaggcaggtttgtcctgagcagttccgagcttgtcttttcccttagtttagtaattttggggccccaagattttcctttcagaaaaaagaaaatgtggtatatatacacaatggagtactattcagctctaataaaagaatgaaaccctatcatttgccacaacacggataaacctgaggatatcatgtaagcaaaataagacacagaaagacaaatacctcatgatctcactcatgtggcatctttaaaacgaagttaatcattaagatatttaccagttgtctgaggtattgggttgaattttctttttttttttttttttgagacgcagtctcgctctgttgccaggcagaagtgcagtggcgcgatctcggctcactgcaacctccgcctcccaggttcaagc

SEQ ID NO: 200237 - DNA, 224 bp, Homo sapiens
cagctgaggaaagaaaggaccagaaatgaggggaggaaaatcatagtttgctctgttttctgcatgatccccacttggacagagacacatacagtgtgtgtgtaatggtggtgtgtcttcataaagcccttcctcactcctgactttgatatacagtattcataatcttaaacatgcctttccaaaggaaagaagaaagggattaggaattctacgcagaaagt

SEQ ID NO: 200238 - DNA, 383 bp, Homo sapiens
tgcaactaaattttggttttcaaaatttaatgtgactccaaaatggatgcgtggcctaaaaatctaacaaccattgatgtaacctcactgctatacgaggttgtgacttggtataacaataccccttttactaagagctcaattagagcagggcactggatgcagctgctgcctcaaaagaaaggaggaaaatgagatcggaagaggcagtaggctaaaatcactggctacccttttgcgtggtcaaaggccaatgagtaacatgcttcaaacaagttattttattcctgagaactgtgaaatcctttaaagagatcctaaagtaccatcccaacatttaattacctcccagaattaccatacacatgtaagatatttaggta

SEQ ID NO: 200239 - DNA, 803 bp, Homo sapiens
caggggaggacttttggaggagatgatgattcgagctgagatctggagagtgagaagccaaaagctttaagagcaggggcaggagtgttgttggtaaagacttcaaggcatggccgggtgcagtggctcacacctgtaattccagaactttgggaggccgaggtgggcggatcacctgaggttgggagtttgagaccagcttgaccaacatggagaaaccccgtctctactaaaaatacaaaattagccgggtgtggtggcacatgcctgtaattccagctactcaggaagttgaggctggaaaatcgcttgaacctgggaggcggaggttgtggtgagcagagattgggccaaaaaagacctgaaggcaggacagagcctggcacgtctggggaggtaagagacctgtgtagctagagcatggagagtacaggggaacggagcatgagaaggtttgagaaggcaagaagaagggccttgccatgggttctgtttagtccgtttaggcttctttaacaataccatagactgggtagcttgtaaacgacagaaacttatcacagttctgcatcctgggaaggacaatattggggtgctggcgtatttgatgtttggtgagggcctgctttgtggttcatagatgctggttttttcttttcttctttttctttttttgacggtctcactctgtttcccaggctggagtgcagtggtgatcttagctcactcccacctccgcctcccaagttcgctttggtgctctcagctcactgcaacctctacctcccaagcaagcgatcctc

SEQ ID NO: 200240 - DNA, 441 bp, Homo sapiens
tgtagtctatggcagagatgccaaggaatgggaatcagatctcaggcactgaaggtttctgcagaaccaggaagggcccagggcatccctggtttaggaccctgagtattcactgatccttttgtttttctatttgtttatcaacagtatatgtttacataaatgtaataatctaaaataagcaaaagaagtagattaatcatattatctgtaaaaatctgcttaaataacactctcaactcaggcccaagggctgtgaacaccacactgcacacgccagccccagacctgtcagcactcagaaaaccctgctccacagctggtcatgtccctagctgtgtcctcagctctgcctctctcctccccagacagaaatgtgtactgtgtattacaggaataaaaataggccaggcttgagtcaggtgtaacgttgtgaaaagc

SEQ ID NO: 200241 - DNA, 214 bp, Homo sapiens
tctggagtgtagtttaaactgctccttctgtttcctactgctttgttccagcaatcctttgtaaatttagatgaggaacaaaaccttcctcaaatatttctccaaaggaactacacattaagtaaataggttctacagataggactgccaatgccaggttttaaagttagttaggaaggtgcatttatgaaatgcttacccagtgtggagagag

SEQ ID NO: 200242 - DNA, 376 bp, Homo sapiens
acagatcacatagggaaggaggcactgtgaagactttggattttactctgcatgagatgagaatcttttaaaaggtttttaaaagaagagtcatgtgatctgacaatgttttaaaaagttcattctggctactgaattgagactggtttggtcgagatgggggacagtcaaagcaggaagcagttagtaggttcttttagtaatccaagggaaacatgatggtagtgtggactggggtggtggaggaagtcctgagaagtgatcaggttctggatttgttttaaaagtagaaccggcaatatttcctaatgatttggaagtggagtgtgggagaaagagaggtcaaaggtgacttcaaaagttttggcctaaacaa

SEQ ID NO: 200243 - DNA, 387 bp, Homo sapiens
aatgactcctaaggctcctttcagctgcccaataattattaggtaataggataaaaaatacccagtgtaaagggggaggttttacgtggggtataggaaatatctgattcctcactatgataaaaaaacaaacaactaaatggctccattccaagaagtttagttaaaacttgactgatgtgggctgggcatggtggctgacgcctgtaatcccagcacgttgggaggccaaggcaggcggatcacaaggtgaggagatcgagaccatcctggctaacacagtgaaaccccgtctatactaaaaatacaaaaaattagccggctgtggtggcgggcgcctgtagtcccagctactcgggaggctgaggcaggagaatggcgtgaacc

SEQ ID NO: 200244 - DNA, 433 bp, Homo sapiens
gatcctggattttccacttcctagtggtggatcttgggcaagtttacccagcctgtttaagtctgtttctccagttcagagttgctgtgactggtaatgttaatgtatagaaagcttcacagtatgtgatatacagatgtctgataaatggaggctcttattaggtacaatgacctccttggggaaaagggtaaagacttccagaagataaaaataaattctacttcagacatgtcacagtggcccacccctgtaatcccagcactttgggaggccgaggcaggcggatcacaaggtgaggagatcgagaccatcctggctaacacagtgaaaccccgtctatactaaaaatacaaaaaattagccggctgtggtggcgggcgcctgtagtcccagctactcgggaggctgaggcaggagaatggcgtgaacc

SEQ ID NO: 200245 - DNA, 834 bp, Homo sapiens
cacccctcctcctcctgctccgtcctgactgctgtggcttcggcgtccttctgggctgtgttgatgttgagctgctaggggttgggactgctgtccatcctgggtgagctgtttagattatcctttccctctgcgtgggtatcaagacttgaggcagagcccatggtgatgcccgccacatgccagggctgctccagctccaactccaggtagctggcaggcctgggacctcacctgggagaagcagcgaggggaaacatggtcttgtagggatggggtagggacaatgaaggaagcgatgttttacagggtatgcttttccccagcctttctcaaatctggagtacagataagaatatattggggtgtttgggggtctccatgtgcaaaggacagccgagattccagaggaggtgtagggacagagtcttgtcccctgtgggttttctgctgagggaggaggctccctggggagctgggctgcaggcggagtttcacccctgccttgtcgtcatgcctagacctggaggtctgggagtgtcagggtctgagatgaattaggaagcaaagggagtgaagacgcgtcgctggaagatggcgccctgacactgatgacaggagggcagagtgagggcttggcctggtctttgcctcagaccaagcattggggcgggaagggtgtagttggagagatgaggaggcatttgggggcacctagagccgtgctctatggcagacagatccttcaaccagcggtggaagccccaagctcttgtcctgtctccgataccacctggccaagtggccatgggcgggtcactcagcttctagggc

SEQ ID NO: 200246 - DNA, 183 bp, Homo sapiens
agctgttcaggaagccacatttagagaccaaaatcgaaggtccccaggcaaaatatcctatgaagtgacaaaactttggcttactttaataaccaataaagttaatttgaccgctgctgatttactttgaaggagcctaagtaaccaccttgcctgttcatgggtgctttactaaatagaaag

SEQ ID NO: 200247 - DNA, 590 bp, Homo sapiens
acaggagggaaggaaatatacagtatgaaaaaatagggcccttcacaaatctctgaggagccccacatttaaggacagacagagaaaaggaaggtaggccacaaagaatattcacaaaaagcagagagaggaggagttctaggaaactgggtgtctcatggagaagcgaacaatcctaccttaggtagctaacaggtcaaatgaagtgaaacctgaaagggtttattggatagtttattgataaagcgcataagaacagtgtcgttggagtgtagaatagaaatctgattatggtgacaaaggacaaatgggaagtgaataaatagaggcagcaaatatggacaaccttttaaaaaataatggggtagggagagccggaaagagatgagtgtcaggcctctgagcccaagctaagccatcatatccccagtgacctgcatgtatacatccagatggcctgaagcaactgaagatccacaaaaaaagtgaaaatagccttaactgataacatttcaccattgtgatttgtttctgccccaccctaacagatgaatgtactttgtaatctcccccacccttaggaagtttct

SEQ ID NO: 200248 - DNA, 944 bp, Homo sapiens
gatagacgatgtattagtttggagggagaagggaaagctgggaacgcagaatgctcccaaatgtcagtaaaaggtcaaatatgaccagtttgtcataaatgttcctgatgctacctttggctgtgaaggaaggtagaatgtagctcttcactcagccaagttgaagagaatctgaacctatgttcttgagagaattaagacactggtgtttgtgcccccaagaaatactatgtattttctcctgtgttattagagtcagccacttgtgtgtgtcctctgtgctctttacaaacctgaattttcaagctattaaatttactcctagatttcctgaagcaagttatgcttgagcattagtgcccaaagcagcatggtggcttttcacttgagaagaaaatgtggttaagctactgatgtacagccaacatgatgaggagcttatctttatctaaagtagtttgcacattttcaactggaaagcgaagatactatgtcacaggttctcacaaccaacctggcagaatgcatccccagtttaacagggttcaacttctaactcatctcaaacgtttaccctttctatttgacatcatgaagttttgtctaacatgtaaatgttacttctaaagcctcgaaaattctttcagtctttatgttgaggagaatgtctcctatacctgttatcaaataatgctatgagttttggccactagatggtgcttttagaaaaatacagcatctttttcaatttctgggagaaattgagttgagtttactgtatgttagtgagcagttgaacactcatctggttgctgagccaactgtgttggcttagttagttagaagttcatattacttaaggtacaggaggcctgtgtgtgtgagagacagggaactttggcaagatcagccagggttaaggggcagatggtgactggatacca

SEQ ID NO: 200249 - DNA, 574 bp, Homo sapiens
gtaacagtatctgatacggttctaaaggtatgtagaaagatttaaggctttaaggctgggcatggtggcttatgcctgtaatcgcggcattttgggaggccgaggcaggcggatcacctgaggtcaggagttcaagaccagcctggctaacatggcaaaaccctgtctctactaaaaatacaaaaattagctgggtgtggtggcgggcgcctgtaatcccagctactcgggaacgggaagctgtggcagggataattgcttgaacccgggaggtggaggttgtgttgagctgagatgacaccattgcactccagcctgggcgacagagcaagactgtgtctcaaaaaaaaaaaaaaaaaagatggataaagataaaacgttaatcaaaggaaagcaggagtgacaatgttagtatcagtaaggcagacttcaaagaaaatgaccagagacagagaaggacattaaataatggtaaaaagataagttcatcaagacatagcaatcctaaatatgtatgcagcaaacgacagagctggaaaatatgtgaaacagtatcagatagaaatcagataga

SEQ ID NO: 200250 - DNA, 332 bp, Homo sapiens
ccttaactcttaccatgaacttacaatacattctagacaaaaaataagtagcattagcagccacaatacagaagaatagtaataattctgtttgatccaagttgtttttagaaaacccattaacaccattgggtcaaaataagtagatagtcaattacataatctaaatcagcagctttcaacttttcctgtaagacagtctctaatatatatacacgtacactatctattcacagatctcttgcaacaaacccacagtcccctcaagtgaccagagctcacaggttgggaacaactggcacatcttcatcttcctttctaccaacaagaca

SEQ ID NO: 200251 - DNA, 118 bp, Homo sapiens
ttaggtgtagtcaccaccaaaggcaggtagaaggccaaccccaggctcccaaggacaaaactagtggctaaaaccttcatgtctcggtaggcgttttgccaccctcagccagcaccca

SEQ ID NO: 200252 - DNA, 771 bp, Homo sapiens
aaaaaaaaatgtcaagccgactgtcctcagaatctaacctgtagataactatagatgaaactcacattttccttcccctggttcaccttgacagcattgcagctctggtcagccacagaatgccaggcagtggtggacaccatgatagccgtgtggtcagaagggaagggcacgggagtgagctgggaaccttggctgttggggaagttgcaaagctccagtttcctctaagtgtgcctttatgatccgcactggcgacagcaggctttgtctttccttagaaagactttgtgcctgttctcacttgaccagatatcgtgtacggagcacttgctggcagtaggccaagctctgcacattcatgaattgctttgtctcacaacaccctgagccgtaggtatctttattgaccatattttccagatgaagagacgaaagcccaagagaaccctgttaatgctcggccagatcagaggagacaaaacaagcacccctgccttcatgggttgtgtggatgaatgagggtcggcctagggctgtcccctcgcggtctgtccggtctgtcggtacaggcagcagatgggccacttgttcctggaattgcagaagcagataaccaagtgtagaaaatgtatgtatccctcttctaccccaacagaagcaccgtctttttgctttttctttttttttttagttacagatatgataggtaggtttttttctatggtgtaagcatttctgctgttggattttgtttgctgtttgaagacc

SEQ ID NO: 200253 - DNA, 633 bp, Homo sapiens
aatttggtgagagattatatagtccttcatgttcaccccatttgtaggtattaatgttgaaacaaaatcctaaagcaacatgaccagagtattattgcagtcatcatgagccttatcattgatctctgcagtttttttcttttctcagataaatagaagcaagaaaaataatggtatatagagaatacatattattaatatattgggttctcaaagttcctaagtctaagtgtttataacctagaattaatttcccatggaaatagtgtaattaattatggttagatgccaaggctaggccacaaaacctcatataatattagtaggtgtggcaggataaattgattgataaaccatattttattttcttgtctactggctcataatgggaaaacgagaagtatttctttatctcttctctctggagggcgggttaagctgtggtgattttctgatgcctaagcccatgaaggcagatgattcaatgatttggaatgggaaggactccaagaaaagggaaatggcctgatgtcaggagaatttaggtctcttgaacctgtctggagagaaccagacaggagtcagtttctataaatggtgaggagctgtgtccactcccaaatagaccaaaat

SEQ ID NO: 200254 - DNA, 340 bp, Homo sapiens
ttgcctgaagccaagtgcccatgttatgatttgctgttaaacttaaaacttctgcagtcctctctatatgtaataccatcttttgtaaaagtctgttgtaagctcttagcactgataaaccacacaacatacctataaggaaattattaattttatctgtattttaaagacggagaaactgaagcacagagagattgttaattcacctgggacacatagcttaaatgctatttctcatttctttttttttttttttttttttaaagagagagggccttactctgtgtcccaggctagagtgcagcagcatgatcctagctcactgtaacctcaaactcct

SEQ ID NO: 200255 - DNA, 908 bp, Homo sapiens
ttcccaggccgtcgcgctccttgccgcgcacccagccaggacccagaggccctcagccccgggctctgcgcgtacactgagggcgcggcgcagcaggacagcaagataaggaagcagagactgaagggaggaatccccgctttccggggatgatggcgttcgagttgggtctgtgagggatgaaataggagttggccagagggagagagggactctaggcctcgagaagagcacgtgcagaggttccgtgacacgaaaacgccaggtgggtgcggggctgggaggacaggaggcagaagggtttacggctccacatggtcgccgaaattttaggtccctgagagtaaaggggtgcagctgatttcatctagaaagcccctggccgggaggagagaacgagcttgcttgcctggggttgcaaaggagtgggtagctgagacggccagcaccccagcatcctgactcagggccagacgcttcaccccattgggcggcgtctggaggagcagacacatctcttgtgggtaccctcgaaagtgaatcatgggtcgcagggaactgtggtcaaaccgtctctagctagatgctagagagccagctctgcaggctcaggctactgtgagacacgaaaggagggactcgctgggcacagcctcaccctggggcatgccagcaggccctgccctctgagtgttggcagacttgaacatccctagggaacgagagaagttgggcaacgatgggagagcagtgcaggccctggaggtgacgagtctgttgagattctgatggggatgggtcagaggacgtagaaagcagtgaaggcctagacgcccccaggtcagtgtagcctgctctgcttccagtgagctgggctcagtcccccacatgtcattgtcttagacgcc

SEQ ID NO: 200256 - DNA, 407 bp, Homo sapiens
ttccttcattcagtcttttaaaggttatttgtccttctcttcactaggagaataaagtatgagattttttacttttctactgcttgacttcaggaatattaaaaacattattaaaaggccgggcacggtagcccatgcctgtaatcccagcactttgggaggccaaggcgggaggatcacctgaggtcaggagttggagaccagcctggccaacatggtgaaactccatctctactaaaaatacagaaattagctgggtgtggtggcaggctaattactcaggaggctgaggcaggagaatcacttgaacctgggaggcggaggttacagtgagccaagatcacaccactgccctccagcccaggtgacagagcaagactctgtctttaaaaaaaaaaaaaaaatta

SEQ ID NO: 200257 - DNA, 220 bp, Homo sapiens
catcttcagacaaggcagtcatagagggttttttcctcatccagaaatctactttttgggaaattttttgatctattggcaatcactctgagggcaaatattatgggtagtgattatactgatcccaactccactccactacctcactcaagtcagggataagggtaggtctttttatatactttagtggcaactataaagagcaagctggaacaattgt

SEQ ID NO: 200258 - DNA, 207 bp, Homo sapiens
ggttctcgcctgtaatcccagcactttaggaggtcgaggcaggaggattgcctgagctcaggagttcaagatcagtctaggcaacatggtgaaacttcatctctacaaaaaatataaaaattagctgcttgtggtggctggaggatcactttagccccagaggcagaaggtcgaggctgcagtgagccatgaccacactactgcact

SEQ ID NO: 200259 - DNA, 500 bp, Homo sapiens
ggttctcccttgcgtggtaggctcccacatgaggagggacatgagacactgcctggtgtaatcaccctttggatgctaatgtacccattcccatagtacacagccacccttgcccacacacaacaacccagccacttgtcctgcctccacttgaatatctccaatcatggggaattttgtatgaaatgttatggcatctgttataaataaaagatctggccgagcacggttgctcatgcctgtaatcccagcactttgggaggctgaggtggacggatcatctgaagtcaggagttcgagaccagttggccaacatggtgaaaccccatctccataaaaaatataaaaattagctgggtgtggtagtgtgcacctataatcccagctactcaggaggctgaggcaggagaatgcttgagcctgggaggcggaggttgtagtgagccaagatcgcgccattgcactccagcctgggcaacaaagagtgagactccatttca

SEQ ID NO: 200260 - DNA, 659 bp, Homo sapiens
gaaattgttctttttctgggtagttggtgttttagtgatgagacgtaatatttgaaggtcttatttctggaatgtcttctcttatgacagtggatggtcaacagcacagaataaatacagtgtgaaacttgttgatgatcgcttggtttatcttctacttgaaccctactccatcactattattacatgcttatgatcctgatttagacctgtaagtttcaatactacattgcttcctttattcctaaggttcattatcatgaatcctattgaatactagttctcagcagtttttaccctctctttctggaatacttccccatcttcttagttctactcatgctattcctttttctcggtaagctgtccttctatcagctttcccttttcatccttgatttagaaagtgagtgctctctctggcctctcaaattgcccctagagcagtttgtttgtttgatttgtaaggtgcttttaccattcttcttggagatttttggtacatgtctcagtccttggactgattgtaactttttaagataagaatcatatttttactttttcagcccatagcccatagatttttttccccatctctgaagaccacagaccagttagtagtcatgcaaatgacctacttactagctatctttgaaata

SEQ ID NO: 200261 - DNA, 285 bp, Homo sapiens
ttatgcttcttttcgctctgcatcagtcaccaggtccttgcacacagaatgaccgactgggaggtgggtacgatatattggaaacgtgagaaatctcatttctaaccccagttctgccagtaactaactggatgacattgagctaatcgcttaacctccatgggcctcaatttcttcacttgtaaaatagatggattctaatatctggggttcttactggcttaagaaaaaaaagaaagtgtaactagttgcatgtgttatttccccaatctggaagactcgaca

SEQ ID NO: 200262 - DNA, 502 bp, Homo sapiens
ccaccatgtgctcagtgctgcatcgggcgcctgggttggggtagggaatagtggtgggaaaagagtcataagatattctcctgacccttacgaacatgggcattggtaagatgaggcagggaggcagcaaccgttgacatcccccgtagggctgcctccacatttatgggggcactgattacatcataggcatggcagctgcgaatagttattatgacagttttcccagaagatggcagtagagagtgcttgttcttgcaaagttggtctatttaggacaattttctcagagatggcagtaaaatgtcttgagagcgatgcctgtttctaatctcacaaagacacctaagggttagcagcagtcctggccaagatagacagtgagggttccaggagtgtggggaaaggcggcaaagtgtgtgggctggaggatccagaggagtcgccgtattaatcagcacaggctcagctctgcacctgccgagtctcagtggcttttacc

SEQ ID NO: 200263 - DNA, 164 bp, Homo sapiens
gtcacgcagccgcaccgcctgagaggactaacccttctgttttgccaagaaagatgtcagcttcaactacttttatactggagaaacaatttacaaactaaaattgttttaaagcctctattttcatgcagttttgtttctgtaaagtgttatttaatctccaa

SEQ ID NO: 200264 - DNA, 204 bp, Homo sapiens
attcacttcaagagcacttcttatatcccatggttatgacttagccatgtggtcacacctagctgcaacagacactggacaatgtggtatttattcaaagaatacatgtgcccagctaaaagttggagtattagtaccatacaagaataaaagaaggtgttactaaagacaaaaggaggaggggggactgtatattgggagatg

SEQ ID NO: 200265 - DNA, 156 bp, Homo sapiens
ttctcatctgattcaggttaaattattaatccatggatgcatgtctttgttatatcatttaggaagcataaaatcataaatatgttacagtgaactcattttagaaaaaagtagagggctgtatgtttattttagttaccaggttttctgagagca

SEQ ID NO: 200266 - DNA, 394 bp, Homo sapiens
aagttgtatctgttggttggattttaaaatagatgatttaatcagtgcatttaatatcctaatatggcatcaaaacttgaacattgatatggcctgaaatctgttgaaaatgatcatattgagtaaagaaagtctctacccaccggtattaataacagggtgatctgtttagaaattacattttctctgatacatcaatgagttttgcaaaggagagaaaattgatggtacctgtagtcaagtccagttccaatactgccacagaatttttcttaaaagttctattgtaaataataggccacagaatattccttcactttctgggatgcaaaatggattcgtaaatgctgtaccacaggagtgagtatttacaaaaaatatgccaactggccca

SEQ ID NO: 200267 - DNA, 345 bp, Homo sapiens
caaattcttatcctgaggactggagtggagttgaagtatctatctcctgagcttgtctttcaaggacttaactatgaaagcaactcctccttcaaagcccttatcattttccgactcctcttgcagctgctccacaacctctgtgtgcagccactactttcggggtggcatttgttgatttctacctctgaattggctgaggtggcacctgacgtttagtctttgggtaattagagatgacatatttgcggcatgtttactccttcccccagctcacttggagtcatgctgattttgtttagtcaatgctctgacagatcgcctttggtattttttcaattgtac

SEQ ID NO: 200268 - DNA, 555 bp, Homo sapiens
cgcataaatcaggtgtggtacaacgatcacttggaccacagtggtagcaatggaggtggtaagaagtgctgggatactcatactatcttaaaggcagaataaagcaagatgtccagaaagactggtatgagatataaaagaagatgactctaaggttttggtttaagcaatagggaaaatgtaattaccataaacagatgaagacagcatatggtgcagcctgagtctggacaatgggagagatcaggagttcagttttgaacatgttcagttagggtatgtgtaaggcatagtgctaggaagtgtgagtagaacagagaggaaaactgatcattccaacacagatgacaattaaaatgaccagtccatgcgctgactacttcactggggagaaggttgggatcaggaaggactatctgaaaaatgagttttgaaagagtatgaattagccaggtaaggtcaaagggggttcgattggtctctgctagtgtggaataaatcatattatggccagggtcatgatggcaggagtaatcagaggttccttgtgtagtg

SEQ ID NO: 200269 - DNA, 358 bp, Homo sapiens
tgtgttggggaacagggaaagaaaaaatatggatgtgtaggctgggactggagccaagtactcactgttataggcagtaggaaataattggaagtttaagagctgggaagcatgacaataaatagcattgctggaagagtgggttttgtttgtttagggtatgagttgggctgtagaaacagaccagtcaaggagcaacaagtggcagtaacggtgtagtacgggcattcattggaatttgcggaaataataggtaaaaagaaaaaggggaatggttatgggagaagtgttagggaagacttagcagtaatcaattagatgtgtaggcataaagaaatgatttgactaggtgctgtta

SEQ ID NO: 200270 - DNA, 691 bp, Homo sapiens
agcagatagaaagatcagtactaatccgtcaccagacccagaaaacaaattcaaaacacatgccctatggatagtacactatctgtggctctttaatttatgagggtatcataacagatttttgtaattttcttaaacagatttttttttctgattaataataaactgcatgttattgaggatcctgggaaaataaagtatgaggaaggaaacaaaattcactatttttcccaggactgacagaggttacattttggatttttccatccttgatgttcccttcccttggcctccatgacaccacacttggttgactttcctcttcctccctgaccccacccctacattctccttttcccctttcctcctgaatttggcttgtaaatgatagtgttccttggcactccgtcctgcctcttcatttctcgtggtcctgcattcccatggatggtgtcctttgtcccagacttctgtcctgaaatccagattcaaagatccaagtgtctacaccacttctagctggatgctaatgtgtccagtaaatgatccccttatccccaccatctaacctgcacccctgtgttcctcctctctaggagtcacagccttcacctaggtgcccagcccttcccctcccctccctgactaatccatcaccagattcaacaattctactttccaaatatctctc

SEQ ID NO: 200271 - DNA, 586 bp, Homo sapiens
tctggcacgttgaaaacgtcctccgcagcttcgcaccggcttcgcggcgccctgacagctgggtgaggagggagcgaatgcccaccggcgtccttggggtaacttgggacagaggcaccgccgcggggggcggaggactgggcgcgaaggcgctggccctttaagggggggacggagcgcatgcgcggcgcgggccgtagtcgagcctggtgggcggctggctggcaggggacgtggtcggcggcagcggggcccaggggcggcggggctgcagcagcggcggccccagcttcgccgagcagcgatcggctggtgggcttctcgttggcgggctccgcgttggcgggctgctccccaggcaccagcgcagcgcgcgctcgcccggcttcgtcactcgcctccagctacatccgccggccgaggctgcgcgagcctccgggcttgcggtccccgccccgcggtccttcctccaccctcagccagggcagctgcagcccgagcgaacagccacggagcatcctccgcccgcccgggccgcgccaccgcccatgctgcagccagtcccaggcagcgaccccgcggccgc

SEQ ID NO: 200272 - DNA, 522 bp, Homo sapiens
tctggcacgttgaaaacgtcctccgcagcttcgcaccggcttcgcggcgccctgacagctgggtgaggagggagcgaatgcccaccggcgtccttggggtaacttgggacagaggcaccgccgcggggggcggaggactgggcgcgaaggcgctggccctttaagggggggacggagcgcatgcgcggcgcgggccgtagtcgagcctggtgggcggctggctggcaggggacgtggtcggcggcagcggggcccaggggcggcggggctgcagcagcggcggccccagcttcgccgagcagcgatcggctggtgggcttctcgttggcgggctccgcgttggcgggctgctccccaggcaccagcgcagcgcgcgctcgcccggcttcgtcactcgcctccagctacatccgccggccgaggctgcgcgagcctccgggcttgcggtccccgccccgcggtccttcctccaccctcagccagggcagtgcagccagtcccaggcagcgaccccgcggccgc

SEQ ID NO: 200273 - DNA, 539 bp, Homo sapiens
tatcacatgtggcttagcagaaggtgagagtaatagcggtttagactgcggatagctgaaggctccacacaggctgaatgagataaaacctgtaatgtcctgtacactgtgactggtctaaaggaagtgttccatagatggttgtttttaatgttattatgtttacaattttttttggtccctaaagccttggaaaaaaatcctcctcattataaaatacatagtcacatatgcacatggcaaaagaaaaaaagccttatctggctcttgcttccacagggcttcattttctgtaatttttagatagaggtggtgattgcaaaacatatgactaattgtggttgtcatttaattgttcactttaaaattattagttacattatgtaaatttcaccttaaagtgttttaaaacaaaaaattataaaacatacagattttcagccattctaatatttatcagttgtgtttttcttatctcaatatctgagcaatttttgaaaaatagtctgtcaacttaataaaaaaaggttctgctgtca

SEQ ID NO: 200274 - DNA, 545 bp, Homo sapiens
gtactagaggacccctcgcgaacgtgttatcccagtgactttccagcttaaaatttggaagcaaattttccttaagagactaagtacccatatcttcacatgttgatcagctgttatgtatggcccacagttcacaactgaatagcatgtatactacatattcaaatttttagtatttcacttcacaataacaaagttattaggaaaacaggactaccacaaccaaagatgttacagagtgcccacaactccaacagggtgagccataatcaaggagttgttttctttaggaaacaattctactacaaaacaacatggggatggaagtaatttaaaatgttcaagacattaaatgcaggactgactccatattgccatttaatatgctttgtattacaggatataaaaactaacccccatctatggaatgttaagctgacacccgagactgtcaaagtctcccataattcaatatcctacacaattttctggttgtaccaaaaaataaacaaccagcaaattgtgtaggataacacgttcgcgag

SEQ ID NO: 200275 - DNA, 213 bp, Homo sapiens
aacttttttatcttgcaaaactgaaactctatccccatgaaacaatcatttcccattctcttttctccccagcccctggaaaccatcattctgcttttcatctctgcaactctgactgttctatgtgcctcatatgaaagatattatatagtatttgtcctttgtgactggcttatttcacttagtttaacatcctcaaggttcatccacatt

SEQ ID NO: 200276 - DNA, 367 bp, Homo sapiens
aaatatgagcaagctcaaggaagaatttgggaccatggacattcaaatactcttggaagaagaaactggtatcacctctccagagggtaatctgacatctgtaccaaagctgccctattttgtctagaaatttgtcaaagcagctaatcagagacatactcattaatgagtattacaaagatatttatattagagctatttataatagtagaaatttggaaaaaaaaaacaaactaaatgtccaacactaaggaaagacttgagaaacctttaacaattgtgatacaggctgggcatggtggctcatgcctgcccaactttgcaatcttgatgtctggtatactgtcctgtccccacaatttatcca

SEQ ID NO: 200277 - DNA, 345 bp, Homo sapiens
ttttgttaagagttgagaagtaggagcagttatttctaggaaatctgtctgcgggccgtagactgagctgaatgcctgaaaaggaaacagtggggggcagtactggtagaggtaaatttactagcgctagcagaggtagatttactagtactagtagaggtagatttactagcactcacagaggtaggtttaaccacatcacaagtggtcttggatgatgggccagggatttgtgacttaattaagcacaggagtaatcaaagcttttgagcagggggcaccaaaatcgtctggctgtaaatagatcctgaaatttggaatctcatttttgagaatgaatttgga

SEQ ID NO: 200278 - DNA, 328 bp, Homo sapiens
ttcaccctccctacccctaatcataaccatccaagaactttagagcttctcagtccaatgatcaatactattgtactgcctcttgcagccatgtgatgtcactgttgaagatgggttctgcacagtctaaaggttttaaggatgggcttttccactgtgacctgctcagcccacattagttccccatactgggtccaagatcataagccattttagtctacactcccatgctcagccattactctccaaagcaaaaccactggcccagtctgtgttgaaatcattcccttttaaccctcattgagccttgctcatcagcctggatttc

SEQ ID NO: 200279 - DNA, 440 bp, Homo sapiens
tggaagtgttgggattataggcatgagccactgcacccagccggctttgttttataagtgtgaagaaaattgtttctggtcaaagtggagacaacaactaaaccaaatcaagaaatgggaaggacagacagactgggtatacatcagcatatcataagttctgatattctgcaataaagaaacccaatgttttccaacttgcagtgttttttttttttttaatgatgctaactagttacattaggaaaatagatttgcttttgtgtcactgttttttgtttttaaacagggtcttgctctgtcacccaggttgtagtgtgatcttgctcactgcagcctcagcctcctgggctcaagcaattctcccacctcagccctcactacaggctcacgccaccatgcctggctaatttttgtattttttttggtagatacggggt

SEQ ID NO: 200280 - DNA, 555 bp, Homo sapiens
cttctcttcttcttggttcttccagtccctttcatagaaggatccttttctgttaacatccaatggggtgagctcttcttcctcctgcccctacactgaagccctttcacactggactatgattggtttctttgtctttcttcctaattaagctgtgagcgcccccagtagacatgtaatcttaccacacagctgaagactcacagcagctcctcaaatctgtgttaaataaatgggagtaatgttttatttcatttagatttgtcagcagaaaaggacttattgtgtaatatttctaacaagagctcacatgtattgagtgctaagtatgtgctggtatgtataaccttgtttgatcatcagagttgcaattttacatgtctttgggtaattattggactgatctgcttgtcctacccatggactggaaatgtcacaaaggaattacatctctttttgctccctcttttgttctcagtattggatacactatgtggaacactgttgatgctaaatatgtattttctgcatagatgaagaaatgaccccctgagg

SEQ ID NO: 200281 - DNA, 249 bp, Homo sapiens
ctcccggtctccgctttccaccaccttgggcacctcgcccgcctgtggtctcgaaatcccccccaccagtggcgcacggcctgacgggagttgcagtctcccggctcccgtctatcatctcaagtcgagacaatggaaggggatggggcggggccaccggcaaagatggcggctgcagggccggggcgactgcgacatgggatgtgtagtccaggcgtctggcctcttccctgcggaaatgagggagag

SEQ ID NO: 200282 - DNA, 329 bp, Homo sapiens
cacttcaacatctcatttctggctaatattagccaggaagggggatgtttggtattttggggatgacacggtagccttatttttttgcacatttagaaaaaaatgtgtgtttatcttgtattgcatcactttagcatggtctcagattggccttgtctaatgctgatgttttgtgaaactatgtccaacaggagagcgccaaagcctaccagtgagtgccaggctggccccacaggtcaagggctgcccttctctttctcagcatccctaatatggtacatatgattttaattgccagcacttaaaatgaacttgtgataaaatagctg

SEQ ID NO: 200283 - DNA, 316 bp, Homo sapiens
aatccaaatacttcacttcgtgtcctttttgtgggggtgaaactgagttctagaagccatgtgtataccttcagctatcatctctcttcccttacctccatttacccagcttcttaatttgttaataagtcctaagagtggaagaggaaatttgatactgagccttagctcttcctgctctctgttgttgtgaggagcgtgccaggacagagtgcggggtgtaagcatcctgcgggtgacagccccacaattccacactcatggcccttaccacgctactcctacctatctccccttttatactaatatttttata

SEQ ID NO: 200284 - DNA, 558 bp, Homo sapiens
tcttaggccaatatcacactgcttgattgctgtcatttgaaagaaagttttgaaactaggaagtgtgtgtcggaaacttcctcatctttttcaagatgattttggcaattctgggtctcttgaacatccgtgaatttaaggatgtttgtcaattcttacaaagaagccagcttagattctgatagggattgctttgcatctatatatcaaattggggagtatcccacttaacaatattacatcttgcaactaatcaacagaagatgtctttccatagatttagggcttctttaatatctttgaacaaatcgacagagactttgtattcaattagtaatcagtgaataaaggaataaatgagtgaataagccaaaaacacaaataaaaaggagcatccagatggctcttagaaatacatacacaatggccactgtcttgaatcccatctcacttctcagaaagccactgttaattagtcacaactttcaaaatactgatttcagcccctttttacataacttttgtcataaaatctattgtttctttttcttttgccca

SEQ ID NO: 200285 - DNA, 401 bp, Homo sapiens
tcagtatgcctgacagctgtaggtctgtcgtatatggctttcattattttgaggtatgttccttctatccccagttttttgagggttttttttaaaatcatgaagggatgttgaattttttcaaatgctttttcagcatcaattgaaatgaatctttcttttcttgaatataggtatttgcagctagaaatttctctgagtactgctatcactacatccaatgttttgatatgcagtgttttcattttaattcctctcaaagtattttaaaatttcttttgtgatttcttctctgacccatgagttatttaggaatgtgttgttcaatttacacttatttgtgaattctgcaaatttatttctgttattgatttctaatttaattatattgtgttcagaaa

SEQ ID NO: 200286 - DNA, 490 bp, Homo sapiens
ctgacgtcaacccaatcaactgtccagggacttggccacctaccttctctgactgtacttaaacttatcacttgcatctgagacaatgcaaattcaggtagtaccaacctcacttggaaatgagaggttccagagcaagttagagcttggctacagaatcctactggggtgagggacactgtgctgctggcttctttccatcagaaccagcaagagatcacatttccttcccccttttcagcgagtgaattagtttctgctcatatcatatggcaaattccactccttccatcatttactttttaaaggaacaggaccacattacttctcagtaacttagagaggtggagaaaattcaatgagaaatgtattttccatgggttccaaaatacagcaggcagaggggcactgcttatctcaaggatgatttccacacaggaactggaatttttcttgtacgtagtagtcgtagatagggttgacgtcagga

SEQ ID NO: 200287 - DNA, 485 bp, Homo sapiens
gcacttcacagcacatctcatttcagattagcctcatttcaggggctcagcagctgcatatgattcgtgcctgccgtattggacagcatgggtcaaccagggcctcatccaccttcctgcctacccattagggcaatccctgaggtcccttcagggaaatcctagactccttgaaatatggtttggcagctatggtgattcctgagaaatctccatacatacttcagacaaaaggacagatttgccaagagccagtttttcagtttactgtaatatcttcctcctctaaacttcctttgcatcacctctcagactgttcccagaggactagattaaaagcacagctgttatcatttctagaaactatctgactcatacgtttcactggatgacagagtaattatcttaattttaggaagcattctatttcacatattgctaggctagaataagccaggattgggaagggcagaatattaaaacaa

SEQ ID NO: 200288 - DNA, 1353 bp, Homo sapiens
ctgagaagttgagtacatttacatggtatcaaaaatttagcatctgcagccaaaagccacacctgtgctactcaaaagctgagaaagtacatgtatgtaacacagcaactattgcatggtccttttcttatttaaagctttctcaggtaagttttaatagctggaggatacatattgaaaaaaatctcaatatgaaagaaagaaaacttcagtgttgaaatacattaatacctcctgtgacatctgaatctctggctcaggatcagaacttaggatcacgtctctggtggccataaaatatttacaatctagttaaaggcacagtggcatttaaaaataaagtcttggggacccatggtaaaagattcactgtaattattaacctggcttcaattggtagaattgactcttgccagataacatgcgagggagatggtgattcggaacctgctagctggttatgaggcatagcgagtcctttacctcaagaacaggtggaaacaaactcacggaaacatgcccgtgtttaattctggtgatttacatctttcccgcattttttgctaacctgagccagaatgtggagcgtgggggtttcttccatgactgattggcaggttgtcagtatagtcttccagctcaggatcctggaaatccctcttattattattattattgttttcttctgtttgaggagcagctggataagctcattctgggttagctgtgcataggcaaaagcagaatctgaggggttttcttgatcgtggtcttgttgatcaagttctcactgatgatggtggcagttcccaagctagagatagcaatcttggtggccattgtgttcattggcttcacaggatgaagtcaaggtttgacagctctggtttttggagccatcacagagagaattggtgattctgttcagacttggattctgggtcagtttttggttctgtgatctgcacatcttcaaaggggttcagggagttaccccttctggagacaatagctgcaatatctttctccaatcttctcgtaaggtctttaacaggccctgaagcatgctacccggcttgacctccataagcatgccttccttcttctccaggatggtaagagggttttcaccttcactgttcttagccatgtccttcttccccgtcacccgagaaagcaaagaagactctcgttattctgcttcttgctctctttggtttcttttgcagcttccaagtttgctggagccatgttttctctaatgtccccacagaacagtggttggtaggatggcggagacatggacttcagagagttcttggtagaagactcaaagagccacctgtcatgaga

SEQ ID NO: 200289 - DNA, 325 bp, Homo sapiens
tgtgaagcagcaggccgaggcatcagacacctctcccaccacacacctctcccaccagacacttctcccaccagctgcagggctcttggcagcgttctcagcccagccattctgtgacagttgttttaaggaatcagctgttgacctttttttctcaagcggcaacaataacatcaatattacagtggtcttatgaatacacccatgtgatcaacttgttagtaaacacatgggtatacaacataaagtaggcaaagcggaaaaagtatttacaactgtcaaagtctctctctctctctctctcacacacacacacacacacaca

SEQ ID NO: 200290 - DNA, 189 bp, Homo sapiens
ttcctgaataaacttgagatcctaggtgaaccacaccaattattttaagttaacataaacagaagacaattgaggtaaatcatcagtaaaaatttaaaaaccaaaaataagttattttgaaataattctgtgttggaatagtcttctccttccaactctgtctttacatggctaaatccttttcattct

SEQ ID NO: 200291 - DNA, 343 bp, Homo sapiens
gaaaagagcagaaaagataactatcgggtacaaaggcttagtacctgggtaaggaaataatctgtataacaaatccctgtgacacaaatttacctatgtaacaaacctgcacatgtaaccatgaacctaaaagttaaaaaaaataaagtggggatattaataggagtacctgtttcacagggtagtgaaagtaaatgagtatggagatgtaaacactattattttcttaaaattattttgtattattttgttacaattataatttagttacaagaactactgaagaactgccagttcattgagccaaatgataagataccaacccctgtcagctgcccaacaa

SEQ ID NO: 200292 - DNA, 493 bp, Homo sapiens
ggtctagcaaaagggactgagaaggagtctgccatgaagtgaggggggactcagaagagtctgggtttctggtggacactgaagaaagttttcagccttctgccgtcagcctctcttggaactgctctgagcctagggagctacctcacttgaaggctctcctagaagccgccagccaatgacgagttgctatgaggtgtaaagaccccacccccttgccttactttggaacacctctgcagggccatctcagttccagagcttccattaggtcaggctgaggcctctgttgagactacatcagcagttcagcttcttcttccgcccaacccgtcattcccctactggtgatattcgcaagagcactccgataaacctacactcaaatcttgctatcggagtctgtttcgggggacccgacctaaaacaaccattgtagccccagcccagagccgtgcacatagcagatgctcaataaatatctgttggctga

SEQ ID NO: 200293 - DNA, 480 bp, Homo sapiens
ggtttcatcttgatccagaaatgtcccttggcaaatccacccttagctaatcacccaggaatagcatgactcagtaatgagtatcagactcgtgcgagacaaaaccattttcatggtgcacgtgtgactttgcaagtcacaccacaacctgctgcacgccctcatttccttaactgaaaagtgggctattagtaattcttacacatgggggtactttaaggttgaaaggaaatcgtgtctgtgacgctctcagcaaagacaaaggggtcagttcctgttagcttccatttttactattgttttaaattcaatttatttctttcctccagctcagtaactttcaggagttcctgtagggacaaatccactttctaccaagcctctggggtcttttctgtagggtcctgatgacccacttcaatcactgagccactgagtccagaggtgcttgtggagagtctaacagatgcagagctcctg

SEQ ID NO: 200294 - DNA, 295 bp, Homo sapiens
gcccaacactaggcaggttctcctctcggagcctgaaagtatcatttattaagcacctcctgttgtgcacacctgattcagggggttcgggacacagatataaaccttaaacccttacagttaatgaatcttgagaatatgctatgcactaggcattgttctaagcactttgagtggattaatttatttaatccttaggacaaatgtatgagaaaggtatggctcttcccattttgcggtagggagatgaaggaaacttgccccaaatcacacagccaggaagtaggagaggtag

SEQ ID NO: 200295 - DNA, 388 bp, Homo sapiens
ttagcaaattgctaaatccagggatctttttcagttctcatttgacactgttaattctctactgtttaagaatccatctcaggtgtatgaacttggcagaataatgaagcccgtttgacctcagttttcctgtattaaaacttaaaacagctcctaagtttttttgagtatcaaatgcaacaatgtgtctgaaaatatctcgcatctagttagtagcgcaccccaacctgacggtctgtgatgctttagttgctgcctggctcgaaatatctaagatagttttttttcctattttttttcctccctccaccttctttgaataaagacattctctaaggcgcattctttgaactttatctctttgccttatctgttggaaatctcatct

SEQ ID NO: 200296 - DNA, 521 bp, Homo sapiens
agctctcccctggtaggcaaagtgacagacatcttgattgacaactccatcctgtctctcggagtcagggaggagttccccagagacaggaacatgggaaagtgtggaggacagacacactcttcagtgaccagtgcctattgtcccagggaaacaaaagactcccaatcagcaggggaaagagatgctcctcccaagcacaaatcagccagtgagtgactttggtctttcttcaacagaaactcatcttcttccctcctgctcttgagctcttggtggctttcagggataaactaccaccatcgccttcaataacagcatctttcaactcattctgcctccacatcctgccttttgctgtttcctgtccccttcctatcacctagccaaatgctagcatctcttcttcagggatccttgcttgaataacccaaccaggaatgtctttctcttctgaacttcataccccatccaaatacattttttaaaactaacaatgactatgtgcttggctttactgg

SEQ ID NO: 200297 - DNA, 460 bp, Homo sapiens
tggccagtgacccggtgacgacgtcacctccgcaaaggctcacacggttccacctatcccctgctcttctccacggagcaccagtgtgagcctgagaaacacgccctctggcacctgtcctcataaggcctctcctggctttctctggagtccagcctcaccctggcctctacctgccaccatgctgttcccgccaccctgaatgcccccttccaggcatccttggccagcacagcctcaccccaggggaaccttctgccatctcctccctggcacacaacgtgaaccatgggtgcccagttcccctcagtcccctacctgctccaagggtagggcccagactgatggcctctggggtgggccacgatgagacccctgcccctgagggcccagcctgcacctcctccacctcactggatgctgttaaccccctctgctcctcctccaggtacagggaagc

SEQ ID NO: 200298 - DNA, 829 bp, Homo sapiens
gggtttcaccgtgttagccaggatggtctcgatctcctgacctcgtgatccgcccgcctctgcctcccaaagtgctgggattacaagcgtgagccaccgcgcacggcagcggtaattttttttttcttgagacggtgtctcactctgttacccagactggggtgcagtggcaccatcccagctcactacaatctccacctcccgggttcaagtgatcctcccacctcagcagccatatggtggaacttcaggccctgagcacctctgacctctctcacctgcttcactttacttctctgtaaggcaaggggaccagagctgaattcccttagcctgcaggaccaagcccactctctgcacctccatatgacccctcacctgcctcaaggtttctccccgccagatctttctttctttcttttctttttttagagatggagttttgctcttgttgcccaggctggagtgcaatggtgcatctcagctcactgcaacctccacctcccaggttcaagtgtttcttgtgcctcagcttcccaagtagctgggattacaggtgtgtgctaccacacctggctaattttgtacttttagtagagacagggtttcaccgtgttggtcaggctggtctcaaactcctgacctcaggtgatccgcctgcctcggcctcccaaagtgctgggattacaggtgtgagccaccgcacctggccccaatctgtctctctttctttgtttctttttttttttttttagagagactttctctgtcgtccaggctggagtgcagtggtgcaatcttggcttactgctacctctgcctcctgggt

SEQ ID NO: 200299 - DNA, 200 bp, Homo sapiens
ggtattattataaaaatatcttgaccttttggagcttatggtgagaaataaagcttatattctttatttttatcttttaattccattttttccatgaactttttgaagtcccttcatatagggctattcaggttatctatttcgtcttgaatgagctttggaagtttgtcttttaacagatttgtccatcttatctatgt

SEQ ID NO: 200300 - DNA, 321 bp, Homo sapiens
aatgctctacatttggtgaggtgcaaataaatgctacattgagaacgaagagtatattacttcctcttttattcttgttattctattattattctatttgtgctttctgtacctaaaattctttgtttctctatcagttctccccgcattctatttttgaggtctattaaaatgtgtgggtaggaacaaaaacattgattcttacttgcaatcccaatgagaatcccactttaaaataagtactattgactgactgcgacagggagctggcaaatgctgaaaaacgactacattccttaataagctgccaaagggagagca

SEQ ID NO: 200301 - DNA, 945 bp, Homo sapiens
acagagttttgccatgttgaccaggatggtctcaaactcccgatctcaggtgacccacacgcctcggcctctcaaagtgctggattacaggtgtgagccaccatgcccggtcttattattttctaaatgtaaaaaaaaatagacctcaaaaaaatgatttggcctcctgtgtccagagtcagtacttttttattacaccacagcaatctcaaacatctttacagctcttaatattttaaaatatgcttcattttatataagataaacaatctcaaagcatttgtagaagagtaaatttttgtcactctaattacattttaaatgtagtgattcttaccacatctgagtaaatgtagagaggtttgggggtttttgtatgtgttgcatgttttattaataatagatgtttcttcccttacacctgctaagttagaatcttttctgagattcttaagcatcttaaaaagttttaaatgactataatgggcccttctataccaacagagtaacagtgtacaaacagaatccacatattcatctcagtatcactcaatgaggatgaccagacactatgtttctcatgacatgatgcaataccacaacatcaactataaaggattcttaccaaaaaaaagaggaagaaagaaaagattcgacctgaattgaatcaagccttcggttctaactaccagtttgcagggaatagtggggatataggatcaagttaaacaccagcacaagagagcaatcagtcaaatccagaatgtggaacattatacaggacaaatgacctggtttctccaataaatcagtggcataaaaaagcaaagggaagggaatctgaagagttaaaactgttataaaagaggcaaaagcgaagatttttgagacaatcaggaaatttcaagattatattactggaattgttaatactcttttaagtgt

SEQ ID NO: 200302 - DNA, 688 bp, Homo sapiens
aaccctttaaatgtgaacatggagaaaaggagaattgctaaacacattgctggaaaacatcgcccatataaacgtctgtctaaaagagcaacttagccagagcaaaatcgtctgctaaatcaaaggcgactggcacaactaaatggtgtagaagcaaatatttcattttcagcttaaagaatatcactgcaaaaaatatgttcattctgggttatcaatgcgttttctaaatgaagatgactctgaaaacatactgataaagttaaatacatgccgtttcaatcccaactgacacaaacactccaaggagtcaaggactgcaaaccaattatgtttgcaaaatcctggctcaaatgtcctccctcaaacacaaatgttaatgtcttactcagtatactaagaaatatgtcctctctgttgagtctttaaaatcaagtggcttatgaaataaacctcccatccaataagagctcttggcctcatcaactcatattgaaaatatgcacaagggttctgttctgacaatcatctcactgtcgaagggtcaaatcaggtgattctcagcgtctgttaccagagaccaggtgcttccactcaagatgacttcccggtttgctcaagcaagaaccacttaatgagcaaatgagcaaaccctctgggctgctccagcttaggtgagagtgcacat

SEQ ID NO: 200303 - DNA, 266 bp, Homo sapiens
tggacagtgggacaatgtgaaagttctcttcaggttgcttctattttcttgagtgaaaaaacataaatgagattgagaaaggagaagagggtgttgcagggttggagaggaaaggtttgaaatagtatcccaaccatctaataatgtgttctctctctctctcttttttttttgggagatggagtctcgctctgtcacccaggctggagtgcagtggtgtgatcttggctcactgcaatctctgcctcccaggttcaagcgattct

SEQ ID NO: 200304 - DNA, 565 bp, Homo sapiens
ctctttcacccaggctggagtgcagtggtacgatcttgtctcactgcaacctctgcctcccgagttcaagcagttctcctgcctcagcctcctgagtagctgggattacaggcgtgtgccaccacaccatagcaggtcctattttcttgtcctcctttagtcaaaccatcagcatagtgtctgctactgaagttatatttaaaggtggtaggaaatgttatttaaaataatattttaacccagctaatttttgtatttttagtagagacggggtttcatcatgttggccaggctggtctcgaactcctgacctcgtgatccacccgcctcaacctccgaaagtgctgggattacaggcgtgagccaccctgcctggcctttgccattacttttaatggcaagaaccacaattaattttgcaccaacctaatgcttagtgtgaggctattgtaaaaaggtgaaaagagcattgagtgaaagttggtacctgtaatacacagaagtggcagaaaccataccagagagcaggtgaatgactgaagttgaagaacagggaggggagggt

SEQ ID NO: 200305 - DNA, 971 bp, Homo sapiens
cgtggctagagtagggtctggagagagctcccactgtggcgagtcctgtcgttggattcccgcggcgccccgtaaggctccgccccggcggtgctaccaaaccctgttcgattttagaatcgtacattcccagagggaatcctagacccctcattttacagttgaggaaacaggcccaagtagcatgacttgttcgcgccgctagtcgaaggagcagcagccccgatcccttgactctggggcactgctttccctttagctcatttttggaggaaatgggtgcgcccttgctcgacctttggtgattgccgccacaggccttcccgccggctaactcagcgtgcccaagtcccgtgacttagtgccaggacggtgctgtgacccgttatcccctgtcgggttttacctccccccgggagagctcagccctggatcccggcgggcggcggagcctctctggagcccggacgggacagcccaccagggtctgcttctgtgaggggccgaggcgtcattccgcgaagccttctccttgctgttgccatgtgaagaaggatgtgtttgcttccccttctgccatgattgtaagttttctgaagcctctccagccatgccaaactgaagctgctggaaggtacacatcttgggagtttgccctttgaagctcacctgtggaccttttttcctttcgaaaagaagcataagctgcaataaaaatttggtttcaagataacaaagtcagtccccaaaaatcagtattgagagtcactgacattaaatgatgaagatacgaggatggtgtggggacctttactcttcgaagatgagctatacatgcccctgaaaaggctgtctgaagacaggggaaggctggagatggcaactttggcctctgccaagtactcgtgctattttctgtatgtgatactatctgttttgtaactcagaggcaacaccacatacctagcata

SEQ ID NO: 200306 - DNA, 328 bp, Homo sapiens
tgaagaaaatcctagggcccttcagactccttggtcttggagatccctaaggaccacacttggaaactgatggtctatggcaatgggtccttttaggccttgaatccctttaagaatctgacaatatgaaactctgtctctaggaagctgctggaaggtacacatcttgggagtttgccctttgaagctcacctgtggaccttttttcctttcgtaagtccactgactccagttaggaatgcttggtctgataagcgtcctttttatgtaatgatggtggataaactgctttttccaatacctacacatacagtttcaaaaccaagga

SEQ ID NO: 200307 - DNA, 637 bp, Homo sapiens
agaggttaaaggccttggcagagtgaagctaagccagggtggcggatttgccacctcccctggccgcacccaggaggaagccgtaaaggccactcccttcctctgtcccttggcccaggttgcgggcccctccgtgcccctccaggtcggcaagcagctgagcttccctgctcagaatctaggacagccgggatcttctctggacccagcttggacccttatgtgacctgtgtccacttataatcaggcactgccctgggtttaggcggccaggtcacagccctgacctccacagaatgtccagtctgtgggtggacaggcatgaccagggctttaaggacagttgttagacatgggaggcagtgcttcctaggtctccaagagggacatgagaaccctcccaggaaatcagctgagatctgaaaattgaggggaaaacacagggtgtagggaggagagagggaaaggcaagtctctggtgtcctaatggaccttaccagctcttttttttttcttttttgtggtgacggagtctcgttctgtcgcccaggctggagtgcagcagtatgatttcggttcattgcaacctccatctcccaggtttaagcgattctcatgcttcagcctcccgagtagc

SEQ ID NO: 200308 - DNA, 539 bp, Homo sapiens
ttgataatttcagaaagagatttggctttaaaaatgtcaagataataggagaaacagcttctactgaccaagaggcagcagacaagttcccaggcactgttaagaaaacagctgaggaaggatatctgcctaagtttttaatgcaactaccccagtccagaaaaaaatgccacaagagacatttattatattagtaaggtggggaagtaagcaacaagatttaaagcaggaaaggataggctaactccactgttttgtgtaaaagcagttaggtttatgatcagggctgcccttatctataaagctactaactcctgagcctcgaagagaaaaactaacaatcttttggtggtacaacaaaaaggtcaggaaaacaagaactaattttctagactggttccattgatgctttgcccctgaagtaaaaaagtaccttgccagttagggactgccttttatggttcttttgatattggacaatgcccctggttacctcatgaatttaacatcaaaggtgttgaagtggtctacttgccccc

SEQ ID NO: 200309 - DNA, 685 bp, Homo sapiens
aatagagaaaaactggagaaaatagactatgccacctagaaaacttgatgtatatgtatgcatgtacatacatatatacatatacacacgtacacatacagccatatatagatacatatgcatacacacacacatatatatatacaaatacccagatatgtgcatgcagaaagactggatgctgcacccataaagcaagaatgggatatttaaaaaaaaacattcagagaacaaaaaagaatttttaccaattaagaacatatagtagaaaagaaaaactcaaagaaatattggacattaagttgaggaaaactttctagaaagtagagcaaaagggcaaagaaataataaacagaagataaagtaaatatactagtgcaggagggccagctctgtattattaaacattccaaaaaagggaaaacagaataaatgaaaagaaagaaaaaatgaatagtatatttcaagaaaatttctcataattgaaggcgaagtacttattgagtgcttggcgtaatggatgaaaagagaccaatactcatttaaagaataggaaatataaaaagcaaacttagatgcctaggctccataatattcagggaaatacaaattgaaatgagatactatttttcatccatttgatagggtaaattaattatatcaatagcattgggaaggatatggg

SEQ ID NO: 200310 - DNA, 642 bp, Homo sapiens
cactaggatagaagtttcctgtgggtgtagaaggtctggaagaggaagctgtcagttctgttgagagaaccaagaaaggctttccaagcagatcaatgatttgtctcagaaataagtagataaggtcgtgtgtgtgtgtatgtgtgtttccaactttattaaggagattctcctcactcttttttggagttatgtaatcctttattatcatttcctatgcccaaaccaagccttattataaatcaagacattgaaaaggccctctctcattagctctttcaggatgacatgggagacaaattaactttaaatcaacttggtgtatttgtgatttaaacaagatagaagtttattcctaaccttcataaaagttgggcagttggaagtccaaggaaggcacaatagctccacaaaacattagagacccaggattcttttagttctacaatctgtcatctcttggtagggcacttgtcctcctcacccaaggtatctgctggaggtcaaaccattcctgctgcattccagtgagaagatagaatggggaaaagcaaaagaaacctctctcagatgactccacctttggtttaaacaaccttcctggaaatcccacgcaacacttctgctaacatttagtagatc

SEQ ID NO: 200311 - DNA, 362 bp, Homo sapiens
gcctccttccctgcctccttccctgattcaaaggtttccttctggggctcctgagccagggcctctgcctcacacctgggactcgcctgccggcctggtttgcttccagggagggcgcaggaaaggagtggcctcccctttctggcaggagagcaggtccttaggagagaaacgggctcaggctaacacaacagattcccctaccaggaaatacgagatcgctgatttgtgccaacagcgtttaataagcacttcctggatccctggctctgggctgagttactgtttacttgaatcacatgaggaaacagttgaggcagaagtcaggggtcagaggtcaggtcaggctcaaagccacagca

SEQ ID NO: 200312 - DNA, 339 bp, Homo sapiens
gagaaagttattgttttcatttttttcagacgggctctgttgcccaagctggactgcagtgatgccatcacggctcactgcagtctcaacttcccaggctcaagcaatgtgttgggattacaggtgtgagccactgcgcccggaccccactctttctttgtaggacacattgacagggcaggtggtaagcattggtctcaaaattatcagccacagccagaattgtgtacctactacatttcggccctagcctaaaaatgtacaatatgtcaaccagcttgcctggcttctgtgtgttgcagatagatgaggcagcacttttcttcctggaattaatga

SEQ ID NO: 200313 - DNA, 192 bp, Homo sapiens
cctgggcaacatgacgaaaccccatctctacaaaaaatatagtagctgtgtaccagctactcgggaagctgagcctgggaagtcaatgctgcagtgagctgtgattgcaacactatacttcagcctaggtgttggagtgagaccctgtctcaaaacacacacacacacacacacacacacacacacacacac

SEQ ID NO: 200314 - DNA, 392 bp, Homo sapiens
cagccgttcgacatcttcgtgctgcgcgctgaggatggctgcatcagcaccaaggagctggggaaggtgaagaaggagacggtgaaggagaaggcaagccggaaagagcgaacgaaagaagtggtggaggaggaggagaacggggctgaggaggaagaagcagaaactgccgaggcatgagcaggcaggaagatcaaggggcaagaagaagcatgcggaagacgcaagccgcaggctcatgaagggcccgcgcgtgaagagagctgccgaagggccacggggaggtagtgacgaaaaataacaatacaggactctttcgaggccctgtaattggaatgagtccactttaaatcctttaacgaggatccattggagggcaagtctggtgccag

SEQ ID NO: 200315 - DNA, 747 bp, Homo sapiens
ggttgcgctcatgcactagattgcccagctggtcctttgacagctggcccactgtgcgacgggctcgggccgtcaggaggcccacaatacggaggcggatttccgcaagcttttccatctggcccacccccactatgctgggcacggacttgcacatgtatgacaccaaaatgtacgcggacggattgtctccggaactcaccgtggcattcaccgggtccactctagataacctcgggccgatcgcacgccccccgtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacctttaaaatctccattgtctgtagttcccatctttgtgtccgtgagtacccaatatttagctcctacttataaatgtgaatatgcagtatttggtttctgtttctgcattagtttacttaggataatagtctccagctacatcaatgttgctgtgaaggacatgatttcattcctttttatggctttgtagtattccatggtatatatgcaccacattttctttatccaagtgaccactgctgagcacctgggttgattccatatctttgctattgtgataatgctgcaataaacatatgagtgtaggtgtctttt

SEQ ID NO: 200316 - DNA, 758 bp, Homo sapiens
  misc_feature (62)..(62): n is a, c, g, or t
caggcggccacctagtcgctgaagcagaaagacaggaagatgaaggaaatcttgctgcattnggacgactagctcatgatgtattggataactgtggtaattctagagctaatacatgccgacgggcgctgacccccttcgcgggggggatgcgtgcatttatcagatcaaaaccaacccggtcagcccctctccggccccggccggggggcgggcgccggcggctttggtgactctagataacctcgggccgatcgcacgccccccgtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacctttaaaatctccattgtctgtagttcccatctttgtgtccgtgagtacccaatatttagctcctacttataaatgtgaatatgcagtatttggtttctgtttctgcattagtttacttaggataatagtctccagctacatcaatgttgctgtgaaggacatgatttcattcctttttatggctttgtagtattccatggtatatatgcaccacattttctttatccaagtgaccactgctgagcacctgggttgattccatatctttgctattgtgataatgctgcaataaacatatgagtgtaggtgtctttt

SEQ ID NO: 200317 - DNA, 875 bp, Homo sapiens
ggcaccttcgctatcatcggacatcgctatcatcggcacctcgctattcatcggcaccccggacagatcaactgaaatcggcaaactactgagttcctacttgcaaaagacaagtgacgtggaggatcactcggtgcacctgcttaaaacagcaaatcgctgggaacaagtgccgttaattaaggaaaagttgagccagggcgtgaccctcgtcgtggacagatacgcattttctggtgtggccttcaccggtgccgatgaatagcgatcgctattcatcggcatcaaaaccaacccggtcagcccctctccggccccggccggggggcgggcgccggcggctttggtgactctagataacctcgggccgatcgcacgccccccgtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacctttaaaatctccattgtctgtagttcccatctttgtgtccgtgagtacccaatatttagctcctacttataaatgtgaatatgcagtatttggtttctgtttctgcattagtttacttaggataatagtctccagctacatcaatgttgctgtgaaggacatgatttcattcctttttatggctttgtagtattccatggtatatatgcaccacattttctttatccaagtgaccactgctgagcacctgggttgattccatatctttgctattgtgataatgctgcaataaacatatgagtgtaggtgtctttt

SEQ ID NO: 200318 - DNA, 755 bp, Homo sapiens
ggttgcgctcatgcactagattgcccagctggtcctttgacagctggcccactgtgcgacgggctcgggccgtcaggaggcccacaatacggaggcggatttccgcaagcttttccatctggcccacccccactatgctgggcacggacttgcacatgtatgacaccaaaatgtacgcggacggattgtctccggaactcaccgtggcattcaccgggtccactctagataacctcgggccgatcgcacgccccccgtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgacgaaaaataacaatacaggactctttcgaggccctgtaattggaatgagtccactttaaatcgcttcagaccagaggattcaccagatcaccaacgttgtgaaacagacaggccacggcaaagccagcatccatacaggacaactaaagaggatcaccccaggtagacctaaccgcaggtagggatgatgacggaggactatctccgtgtacgatcgagcaaatagactggcccatgcgagggtcggtcaaaggttgatgaactcaggtacgcatccaacagcgtcgctgagtataacggagggagcaa

SEQ ID NO: 200319 - DNA, 613 bp, Homo sapiens
atggctcctcagccaagcagcatcgccaccattgttctgaacctgcgggggtccgaggctcgaattcgtttgtctgtcgttctatagtctctagataacctcgggccgatcgcacgccccccgtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacctttaaaatctccattgtctgtagttcccatctttgtgtccgtgagtacccaatatttagctcctacttataaatgtgaatatgcagtatttggtttctgtttctgcattagtttacttaggataatagtctccagctacatcaatgttgctgtgaaggacatgatttcattcctttttatggctttgtagtattccatggtatatatgcaccacattttctttatccaagtgaccactgctgagcacctgggttgattccatatctttgctattgtgataatgctgcaataaacatatgagtgtaggtgtctttt

SEQ ID NO: 200320 - DNA, 582 bp, Homo sapiens
agtatgacatgattacttcgttatggtaccttgcctgtggctggtactcttctagataacctcgggccgatcgcacgccccccgtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgacgaaaaataacaatacaggactctttcgaggccctgtaattggaatgagtccactttaaatcgcttcagaccagaggattcaccagatcaccaacgttgtgaaacagacaggccacggcaaagccagcatccatacaggacaactaaagaggatcaccccaggtagacctaaccgcaggtagggatgatgacggaggactatctccgtgtacgatcgagcaaatagactggcccatgcgagggtcggtcaaaggttgatgaactcaggtacgcatccaacagcgtcgctgagtataacggagggagcaa

SEQ ID NO: 200321 - DNA, 634 bp, Homo sapiens
gcacccaggcgcacttctccagaagcagattgtcaacattgaccgtattacaaagtatatgtctcgagtccacggtatgcaccctaaagagaccacccgtcagctgagcttagctgtgaaagatggtcttattgtcgaaactctaacagtgggctgcaaaggttcaaaagctggtattgaacaagaaggatattggttgccagaagtgcgcctgggtgcgcatcccaggcgcacttctcggagagggagcctgagaaacggctaccacatccaaggaaggcagcaggcgcgcaaattacccactcccgacccggggaggtagtgacgaaaaataacaatacaggactctttcgaggccctgtaattggaatgagtccactttaaatcgcttcagaccagaggattcaccagatcaccaacgttgtgaaacagacaggccacggcaaagccagcatccatacaggacaactaaagaggatcaccccaggtagacctaaccgcaggtagggatgatgacggaggactatctccgtgtacgatcgagcaaatagactggcccatgcgagggtcggtcaaaggttgatgaactcaggtacgcatccaacagcgtcgctgagtataacggagggagcaa

SEQ ID NO: 200322 - DNA, 730 bp, Homo sapiens
tgaggcgaggggctgtgtcctcagcattgcctggccctggagggacagcagtgatgccactgccagaatgcagctttcacatcaaggtaaagccgggtctcctgctggcccctgggtggtgagcttcgacttcccaggggaaggcagtgagtgggagagagaccaaacctgggcttcccaagcatccactgagagatctgtcaagagccgatccctgggtcctaagagagagccttgcctggttctgcccatgccaccctcttggaagagcccaagaaggatacatgtctggccatgcctttggggaaaaggagtcggagagatgtttcctgctgaccatccaccccttcatttgggaggagacactgctgagaagaacaggctttgctctagggctccatgtttggttcctggtggagccctgttgggcatcatcaccatcacctccttctctccaccacctcctcctcccagccccactgctctagattgctgggacactagggagtatgatagggcagtagccagggccatggcttagtgtcctggagccctggatctccctgcccatagcctggatgcagcaagagctgggaggcgaagtggaaacatgcagggctcagggttggggagtgattgcaattgccttccttgccaaagtgacttggggccccaacgttcccagcagaccccttgaggacagaaataggtagagtcagtctcaagacct

SEQ ID NO: 200323 - DNA, 328 bp, Homo sapiens
cctccacccccgctaagtctccattctcaggccttcaacctcaaactgagagtcacatcactggctcccttaattctcaggcctttggattcagcgtgagttatactatgaacttccctggttctcctggttgctgatagcatatcatgggacttctcagcctctataatcatgtgagccaattccaaacatgaacatcctcttatgtatctctaaatgtcctattgattctttctctggaaaaccctggtttatctgctatatctaacaggtgtttctaatattagaaatatctaacagcatctaacatattcaataatgtactgtt

SEQ ID NO: 200324 - DNA, 405 bp, Homo sapiens
gagggtctctggagtgacaatcttccaatagcatcaggataggatattaagtttaataattagctggagagaaaagtttagaattgctgttttggaaaattggacaagtggctgtataagagttcataaaagttaagaccaggaggagccaagatggccgaataggaacagctccagtctacagctcccagcgtgagcgacgcagaagacgggtgatttctgcatttccatctgaggtactgggtgcatctcactagggagtgccagacagtgggcgcaggccagtgggtgagcgcaccgtgcgcgagccgaagcagggcgaggcattgcctcacctgggaagcgcaaggggtcagggagttccctttccgagtcaaagaaaggggtgacggacgcacctggaaa

SEQ ID NO: 200325 - DNA, 622 bp, Homo sapiens
tacgaatttgtgttgagccacattcaaagccgtgccgggctgcaggctggacaagcttggtcttccgccatgctgctcacacagaagcaggctcacgccaggcagtgccagttgggtttctgaagtagctctacctctaagtctccagggcacacgatgcgagatgcaaatatcacagagctttctaggcagccagcagacgtggaaagcaggttagtcaggctatgattcagtctccagctctctcccttctcccctggcttggctgtgcctcctaggagggagttctgggccaagaaggccacacacgcccccaggcaggccacaggcccagactgcctggtcctataatacagaagatatgagagccaggaagccacagaaacagccgtcaatggggcttggtgtcccacacacaaccccagattcatcagactccagctcttactgtgccatctgggccacaagggaaatgggagcagtgaagtggagctggaccaggaaccagacacgaacctactctgctcccaggaaagtaactatgacctctgcgtcactgtcctttggtctctcaaggatcccacttccattgcctgtcccttaaacgcccgggaagcggcct

SEQ ID NO: 200326 - DNA, 504 bp, Homo sapiens
aaaaaacaaacaaaattagccatgtgcattggacgtctcagcaatttgggagtctgaggcgggaggatcactagagcccaggagttggaggctgcagtgagctatgattgtgccactgcaatataggctggatgacagaatgagatcctgtgatggttaatgttgagtgtcaactttattgtattgaaggatgcaaagtattgttcctgggtgtgtctgtgaggtgttgccaaaggagattaacatgtgagtcagtggactggaagaggcagacccatcctcaatccggaaaggtacaatctaaacagctgccagcaaggctagaataaaagcaggcaaaagaatgtggaagaactagactgcctgagttttctggcttccatctttctcccgtgccggatgcttcctgctcttgaacatcggactccaagttcttcagcttttggactcttggggacctacaccagtggtttaccaggagctctccagcccttggccacagaa

SEQ ID NO: 200327 - DNA, 193 bp, Homo sapiens
tttcttactctgtttaagcattgtaagactgtcagaagctgaactttgtgggaggggagtcaagtgaggagagaatgcaagtaagaaaggaaaaagagtgaaatcacaagttggtgtttcccgtcctggcttttcggttcatgggaagtggcagaatctggatttaatgcctccataattgggaaaaagagca

SEQ ID NO: 200328 - DNA, 690 bp, Homo sapiens
tatgagacttctgtgtccaatgtaaggtctcagaagatgaaaatcaagaatttatgtaaactagaaaaaaaaaaccttctctttcagcaccatgggtgataccagaatataatgtgttataaatactcagagatgttataaatactcagagatgttgttaatatttagtaaagtcatactgaatgtctgaaatttctcctaatatttggccaaaggaacaataaaataattgcctatgatgtcagtgggcatattgtgaatttgaaagcttctgagctgggttcccccgtggctcagaatgtctgcacaagtatcagaatccaaagtgtgcattacatcatcttccaaatggcagtgaaatgaagactcttttcatgtttctctagagatagaagcaagaaactaattacattcttcttacagaaaaaaagaaagcagaaaagtgaaaatcaaaatttccaagaatctggatatccttcactgaagctaatttcttaatatccaattatcttgtttactgttactgggtatacaggtctctatcttgaaaatgtacttggcaaaattgtaaaagcaacaaaaaccaccacttggggacagaaaccacattttgtaatttcatttattgctaatttgtttgaaatgaaattatagctcgttgtcatatggacaccagtgagattaaaagca

SEQ ID NO: 200329 - DNA, 826 bp, Homo sapiens
ctcttctggctgaaggctggtggcccccactgggggtagggggattgtgtgcaccccacctccactgtaccgtgccctccagcctggcaagtaacagcacgacagagacaggggcccctgacactgaggcttgcatgttggtgcacaggcaggctggggctgtcccctccgggaggcaaggccaaattccccatcaggtcaggtcagcactctccctgaccccatgccccagctcacatcctggccaggtccaggccagctgcattctcccccttctgcccttacttccaggtctaggcagcacccgggtaggtgggcgcctggtcgggtggcctagccctttgtcttgctcattctaagtttggccacgtggttcttggcgtgtaggccccggagggctgtgagaaacggctctgggctctggcctggcctgtgtcctccctgcttcttcttgatcccaggtcctcccagcctccccaagcgcagggtgctctagagggcgctggaggcccctcggggctgcctctttcagggtctgaagggtcatgtgtccccgtccctggaggccccatttcctcccccctgcggaccgaagagaacgcttgtgctcggagatgttcaacccatttgtgatgggcaacttggtcatgcagacatccagctagaagcatctgtagctgaaagaaagccttttgaaattgttaagagccagaatattgtattggtttttaaaatttagctgcatgtatttttttaaaaaaagaattataccccagatcactttgctttggtctgtgtctatatatgatctagtttagagagaaaa

SEQ ID NO: 200330 - DNA, 332 bp, Homo sapiens
tatctggtcttatgagaaaattaatatttttattatattccttgtcacagccctgatatgaatggctgctcttagagttatatatagtgattctgaaagatactgtgatcctacatctgagtaaaaagctatggtgaactgccacaaaaactacaaaaaaatgactaatgccaaatggtctagaaaatacggattcagggaaagtagagccttagagattctcttaaaaatgtgcaattcaaagtactgatgtccatgatgtagaaatgcatgaatgtactgttaattaatctcaactcttgctaatttctctcggaccaatgagtattgca

SEQ ID NO: 200331 - DNA, 250 bp, Homo sapiens
ggacaaacttggggaaactgtttgcaattgaaataacaaataatttacatcctcaatattcaaagaatgctcacaaataagtaacaaaatattcatccctcaatggaaaaaatacacaaaggtcctgaataagcaattccccaaaaaaaggaacacaagtggctaacagacatgttattttaaatgttcaaagaaatgcatacttttaaaacttaacatgctgtttcttttttttttttttttttttttt

SEQ ID NO: 200332 - DNA, 718 bp, Homo sapiens
tggagactccatttgcagctagtgtctgaagtctgaagtggggggcagttttgtgggactgagcccttaatttgtggggtccacactaactctgagtagttagtgttagaattgaactgtgggacacctagttggggtcacagttagttggtgttagaatgacatatttgatgtcaggaaaaaaaaaaccacacaactcctaatgatcctgtagaccaaagctcaaacgtcacctctaaggaaagatcttcctgctcccaagaccagctgagaccccagctttccttgcaagcttgtccagcccagggcccacaaggtgcatgtagcccaggtggctcaggatggctttgaatgtggcccaacacaaattcataaactttcttaaaacattgaggtttttttgcgattttttttttaagctcatccactatgattagtgttagtgtattttgtgtggggccaagacgattcttcttcccatgtggccccaggaagccaaaagattggatacccctgctttaaagtatacatatttgttcacatattaataaatgtctgtcccatcaattagacagtaagcttcataagggcttattttgtgttgaatagttatttgttcctagtttttaattagttcttttaagctagagatcctctcattccatggtggttatgaggattgaaagagttagtatacatagtgtgcatttacatacta

SEQ ID NO: 200333 - DNA, 629 bp, Homo sapiens
tactggcagacaaatagacatactctctctcctcaatgccctttctgactagtacagaaagcagaatataaattagtgaataaaaatttataattacaaattgtaagagaggttgttgcaagagaataaggcagagtggttaattatttaaatgagttgattagggaagatctataatgaggtaatatttaagctaaaacccaaaggagaaaatttaaccaagtgaaagatgatgaaacatggtgtcatgaccactcttgtgcctagagaaagaatgtagccagaaaaagagggcccaggtctgaagctgaggaactccaatatctgaagttcaggcagaataaacagcagccaacaaaggaatctacatagaagcagcaagacagataagaagcaactaatctaggaaagtataaattcttcaaaaccaagagtaatgaaaatgttttaaagaagaaagagtatgccaggcgcagtggctcacgcctgtaatccccacactttgggaggccgaggtgggcagatcacgtgaggtaaggagttcgagaccagcctggccaacatggtgaaaccccatctctaccaaaaattcaaaaaaattagctggccgtggtggctcatacctgtag

SEQ ID NO: 200334 - DNA, 577 bp, Homo sapiens
agaccagcgcggggaacacaggaagacctcatcactataaaaatttttagaaaaaataaattataaaaaaaagaaaaagaaaaaaagaatttgagtaaaaactataagaagggagggcaatccgtgtctatgtctggggcggagctctgcagggagaggcaacacaagcatcagtgctctgaggctgcagcaggagaggtgtacacagaacagcagggaggccagtgtcaaggcagtgagcaagctggagagtgcaagggaaggggccagagaggtgaatggggcagtaaacttggggaggaagttaattacctagcgggataatagatgagttctttccattttccaaatgttccaatatgtattactacacagtttcacaagatattaaaggaaacaattcattccgacatacggcttgtatgagtgaaaacagggagaacggtgagagcagttttaaaacttactccctaaacgcactccagggtcggaagcgacctctaggggttcatttagaccattacttttttctttttcttgctcttaaaagtataaaacagcacggtccacatttaat

SEQ ID NO: 200335 - DNA, 362 bp, Homo sapiens
ctcccaaatggatcccacagagtgaagataatgagttaaatgctttagctctagggatttaaaatatatagaaagcaagttacttctactggaagttaaacttaaagaattctcatggttatgtcatctctcactgcagtaccgagtgtgctacttggcttccctctctccttccatctactgccttgccctatcatttacagaggcattaatgccggtttcaaactaataataattctttttcttctgtgctgcaaatacccaatcactgtggttaaataccatgtataacataaacagggtcaagaatgccagctgccagaagagtcatgtttaaattagcattaaccagcaagcccttc

SEQ ID NO: 200336 - DNA, 599 bp, Homo sapiens
aacttccatcttcccatattccagcagttctatggataatttcaaaaacaattgatattcacaatttcattttcatttttgttgttttaataagcaactagagaaacgtgaataagatctgcattttcagttcccaagaagtttcctatgtggcaaaatcttatcttttattgtccaaggaaaagtacttccctagactctacaagcaaaaagcacagcatttcaacctgtaagaacaagaataaactgttatccaagggttatgtaaaccagcagtaatctctccctatcctttacctcagttcaaaattctgaccatacatggctgaggatataaagccgattcaaaccatggggtcaagctgctttctccattatgattgcttgttcctcagaaaaggagctattccaaatgagtcatgaaggaaatgatcacactgaaagaaaactgcctgctcttgcctcacacgtttggctggtgctacctctaggtttaatcatggtctctcagaaatccttacaccactgaatatattacactaactcactatcagtcaggtgtatggacaactgtgataatcccgtctctaaccatggaa

SEQ ID NO: 200337 - DNA, 488 bp, Homo sapiens
attattttgagatatgttccattaatacctagtttattgagagtttttaacatgaagggatgttgaattttatcgaaggcctttctgcatctattgagataatcacgtggtttttgtcagtacatctaattaatgagttccagtatcatgaacataaaaggtagtttaggaagagggatgcctcagaaggtttcccatgttgtttcattcatcagagatcaagagacaccataaatcactgcaatatccccattagttcctaaaattttgctttctgagacagcatatcttaaatgccaactctgggttataaaattcaaattgactctgaaatttaaagaggaaacatatgaactgtaaatgtgtgaaggaaatcttccaaccccccatcccaaaatccactacagcaatgtttactttgtcctttataattatgggatgaaatgataagactgatgacttcactctttgattgggatgagtggggt

SEQ ID NO: 200338 - DNA, 272 bp, Homo sapiens
tgaaaaggttctggagaggccagggcttatctcacagaggttggcagcctgtctgccccatcccctgcctgcctctcccagcctggtagcttcaagatcatttgagcatttcctccacagcaggagccggatgcatctgctccacctaataaccccattagggccatttgcgcctctcaggggcaggcgcctgggaacccagccagcgccctcctccctgacctcttgccccagagggcggggcccctccacatggcacagggtgtcttccg

SEQ ID NO: 200339 - DNA, 232 bp, Homo sapiens
aataatttttaaaatcttttaaaatgtttttaaaataatttttaaaattattttaaaatgctttgtcatgagaaaaatccattttaaatatctttttttgtttggagactggagggcagtggtgtcatcatagctcactgcaccctcaacctctcaggctcagatgttccttctacctcagcctcagcctctcgagtagctgggaccacaggcatgcaccacaccccaccta

SEQ ID NO: 200340 - DNA, 542 bp, Homo sapiens
gtggccctagaccagatctatgattttaggcataactctagccttacatgaacctcggttttcccatctgtaaaatggtcagtaaatgcacccacaccaggctatttgaggaaagttaaaggggttaaagtattcaaagtgctgcaccatctaggcagttattgttacgagtattttccagaaagcttgtcttggatacccgctctctcaactgctgggagatcactgcctcacctctgaaatgaagaaggcttccaagcttaactctctcacgctatgaaggtgacaggccacttccaaggccacgttccctgacactaagcctgctaagaggaaaaaacaacagcatcacctcaactagaagttaaaaataagacacatataaacagattctataacattgtatggcatcaccctgcaagacaatgccaagaaacagatggctctgtggaaacagctgtatctcagaagaatcccggagaaagcccagaatgcattcctgctctcacgtgcgagccgcatgtcgccaactcttcagtcac

SEQ ID NO: 200341 - DNA, 633 bp, Homo sapiens
gaagttgcagtaagccaagatcgtgccactgcactccagcctgggcaagaagagcaaaattctgtctggggggcagggggaagaggtatattttttggattaaaatggaatgctttcctcaaactgttaaaattaggtagtgttacaagtttaaagaataggtttagccagtgtgattattgcagtgtaataaaaaggatcccaggtggcacacatgctagtgtggtgcccagatgctcaactgaagtgaaggataacatgcgtttcaacattttctatatactaggcagtttttcttaagtcttggtttattgtgatataatacagtaaaatttactctttatacgtatgattccattaatattaacaaatttaaacagtcttacagctaaatacaatcaagatacagaacatttccatcactacaggaagttgttttttgctaatttaactaaacttcttaccatgctcaaccccccacccccaccctgagaaccactgctttgtttttctgatcatatagtttggccttttcaaaaatgtcatacagttggaatcatatagtatgcatgaatcatgtagctgaagttttcatttcacttaggtaaacacctaggaataggagtgctgggt

SEQ ID NO: 200342 - DNA, 548 bp, Homo sapiens
cttcacacttcctgtaccttaatctccagtttttgtgacgctttgagaattcttttttaaaaatttaagttttaatttttttagagacagtttcttgccgtgttgcctaggctgagtcttgaactctggtctcaagtgatccttccacctcagcctcctgagtagctgggattgcagatttgagccacagtgcctggcagagtttttgttattattatcaaattaatattatttttacattattaattttttctttctaggcttcttaaaattatatctaattttctatccatagttaacccagaccatgagatttaattctatttagatttaattctgtgcctaactggaactggtactactgctagttcattcattgataacattgaatactctgaactatgccctgttctatgtcctagggataaagaaatgaataaatagacagaaatccctgcccctctggagtttatgtactagagggggtggcaaacaatgtaataaatgagtaagtcttagaatacgttagaagagaacaagtgctaaat

SEQ ID NO: 200343 - DNA, 470 bp, Homo sapiens
ggttcggaggcacatggggaagggaagaaaatgggggagatgatggagccatgggaatgtgcttggctactttcttggtcttcttaagccttttctgaggatctcttagcgtgtttagactagaggctgataactggtgctcaaagtcagccaatgggcatgttttatttggtttcacaggagttaaaaacctaatttaaaaagtcaacattttaaaaagagagttttcacatgaaaattcagttggaagatcagctgtgttcagttggctttcctacaaggtgtctcattagctggagtggaggagcacctgactctatgtatgtcccttgcttgaatcttgttatcctccagagtacagcttggctgactctggtttgtggaatggatgcgccaatatcactcgctcctgccttttgccatttccccctctaaaaatcagcattgacaagagataacagccctataaa

SEQ ID NO: 200344 - DNA, 248 bp, Homo sapiens
tcatctccagcatcccacagatgaagcacacgttccacttacctacataataaatgggcacatttgttacctacataataaatgttgcactgctgatatcacaggacaaataaaactagacttctgatgctaggctccagcttcattctcacaggttatcaccctcatcagggagatgatgatctctgaacaacttctatttaaatcgtgctcatattgcactgttgatgctgagtccatgacagcct

SEQ ID NO: 200345 - DNA, 296 bp, Homo sapiens
acctttaagacatcatgttgttttcatattaaaaacttaaaatattcagtgaccaattaatttggaggcaaaattggccaagtataaagttatgcaggggagaattcagatttgaacacagctaacttggaatctgagttcatgtacaacatatgtatatacaaacccacatgttgcatttgtgaatgtaggcacagagtgaaaattctccacgtttaggtccacaacacagagccatgtcacgaagaattaacacatgttctaattctcaccagaagatgtctaaataggttaat

SEQ ID NO: 200346 - DNA, 176 bp, Homo sapiens
ctttaggagtaggacaggaattgaatagctggaagggatcttggaggttatgtaacttgatccgaattctacagaggatggagaccctgcacagatctgtcagctacttggtggcacagcttctccccctggtggctaactgccccactacaccacagggatacatagtccagtct

SEQ ID NO: 200347 - DNA, 323 bp, Homo sapiens
atacattttctgaaacagctttaaatgaccacattcgtatagtcctttaaagaaccattttccaaaatcatacatgccaatgtccaagctgggatcaacttcataagtcgcagcaatcacaatgagtaagagaaaacaagtgaggtcaaatgacttcatggcagtaggattactctttatgcttcatatctttcatttcagagactaaacagaacagtatgtgaaaaatcacactacttctagtgtgtttaaaatatgcattggaggatattactgtatatataccacaatatataaaaaagacttggtatgttcctattttg

SEQ ID NO: 200348 - DNA, 451 bp, Homo sapiens
aaccactcagtctttcattgaaataaagttggtattctggtgagaggatggattctgcaacacagtttaggtctgttgttattaatatgttttagatacaccatccagttgtaaagtgcagcccattctttgcaattatgtaccatgccttgcctgggtactaaaacgaatcttttccataatggtagatgtgcctccagaatggtgctacctggaaataataataatccagacctttcatctctgaattgtactagtgtaatgtgggtataactcagcacagcacttgaaggcctacatctgaatggctgcttcctccctgactcctcatttctccatagctcccactccctactggtgtcagtaaactatggccagtgagtaaaatccagcctataacctgttttcatatggccctaagtgaaaaaatggtttttacattttaaaaaat

SEQ ID NO: 200349 - DNA, 555 bp, Homo sapiens
tggaaggactttttcctacattatatccttctcttgccatagacctagcatggcagttatagttggatggaatatctcctctacactcccttttgtatgggcatgttggttgatatagaaaagggagaaaaagtattttggaaaagtctttaagatgacttttcgcttataaactactgttttcctgcatgtcatagattatatttttctctgcttgttcattctcccttccttttccgtgtgatatgcaacacctcctatgagaggagtacacatccttgccccattgatgttaggcttaaatcgggcgcggtggctcatgcctgtaatcccagcactttgggaggccgaggagggcagatcatgaggtcaggagatagagaccattctggctaacacagtgaaaccctgtccctactaaaaatatgaaaaattagctggttgtgttggcacgcacgtgtagtcccagctactcgggaggctgaggcaagagaatcgctcaggaggcagaggttgcagtgagctgagatggcaccactgcactccagcccgggc

SEQ ID NO: 200350 - DNA, 373 bp, Homo sapiens
gtcaaatttctagcagaaaaaagtaagataaacttcaaactaaagaaagcttgttaaaagattttgcatctacatttacaatgttattgtccccttttacaccattatgcctcgtttctaaactataatcacccagtatccctgatatcatcccatatataatctttcatttagaaaatccttgtcatatccagtacattctgtatatgtcctcatgtttttttcttttaaaaaaattatttgtctgtttcccaaatgatcacagatccagtaatgttaaagtacatataaaaaattaaattgatttttgttatctaagtactagtacagattctgcttctcttgcacacacacacaaataaagacaaatttg

SEQ ID NO: 200351 - DNA, 374 bp, Homo sapiens
tcgtccccggtaattcagtttctctttctctgagttatggagtgttcttctaacagaaggatgaaatttgtttagcttgagggtagacctgtaaagaggagccagggaggccaggcacgatggctcacgcctgtaatcccagcactttgggaggtcaaggcaggtggatcacctgaggtcaggagttcgggaccagcctggccaacatggtgaaactccgtctcgactaaaaataaaaaattagctgggcatggtggcgcatggctgtaatcccagctacttgggaggctgaggcagaagaatcgcttgaacccaggagacaaaggttgcagtgagctgagattgtgccactgcactccagcctagatgacaga

SEQ ID NO: 200352 - DNA, 650 bp, Homo sapiens
ttctcagcctcccaaagtgctgagattataggcgtgagtcacggcacccagccagataactatattttaaagacactttgaatatatcatgaaagtaatatcttcataaacctaatttttttaaccatacaggagacttaaaaagcctagatttcttttgctcataacctacaatcttatgtttaatttttatagtaatgagtttgttctgtgtcatatactggtaagttttaggcagcatgtggagttgagagaattcattgagtctttaagttacttctccagccattcctagagtcttcgtctgcccttatgattagttttggtaaaccaagtagcagacggttttttaataatgtcatggcacataagtttgcctaaacatgacattggcattctttctgcttaattttcaagtgagggccctggaccaagtggtgcgtcggcccctgtcagctctgaggtgacacacaagtgcggggccttgctgtgcatttgtttttttacgttgactgttcagtgagagaggaggcttactcctggctctgcttttaccatcctctttctcattattttcagtgtatgctttctggagggaaagttaagagctttatataccacacaaactacctaaaatccttaatagggta

SEQ ID NO: 200353 - DNA, 447 bp, Homo sapiens
agcctttttatgtaagaaatacctgaaagaacagaagggctttgtcctggaggagagaagactgtggtcatgagtgacatccttcatgacaccaggagcattctcaagcattttctcgtaagctagcacgcactgcctttcactggctcattagtcctcacagcagcactctaaggtaggcgtaggatccttatttcacagccagtgaagctgaggcttagagagggacaatgacttgcccgcagttgactcaatgatagagaccagtctctaagccaggtctaagcccgtgtctctgcctgttagacaaatctgattggccttgttctctgtgagtttaaggaacagaacgaggataactgggcagaaattaatagaaagacagattttgggctcgttatataaggaatcactaatgagccgtccaaggtgggaacaaactgcttc

SEQ ID NO: 200354 - DNA, 780 bp, Homo sapiens
  misc_feature (681)..(681): n is a, c, g, or t
  misc_feature (710)..(710): n is a, c, g, or t
  misc_feature (717)..(717): n is a, c, g, or t
  misc_feature (745)..(746): n is a, c, g, or t
ttgaaaaggaaggtggctgaacaggaggagcggcagggcatgaaggtccaggcgctggccagagagaacgaggtgctcaaagtccaactgaagaaatatgtaggagctgtccagatgctgaaaagagaaggtcaaacagctgaagtgccaaatctttggagtgttgatggagaagttacagtagctgaacagaagccgggagaaattgctgaagaactcgcaagctcctacgaaagaaagctcatcgaggtggcagagatgcatggcgagctgattgagttcaacgagcgcctgcacagggccctggtagccaaggaagccctcgtgtcccagatgaggcaggagctcatcgatctccggggaccggtgcctggagatttgagtcaaacgtccgaagaccagagtttgtcggattttgaaatatcaaaccgggcgctgatcaacgtctggatcccctcagtgtttctccggggcaaagcagcaaatgcattccacgtgtatcaggtctacatccggataaaagacgatgaatggaatatttatcgccggtatacagagttcaggagtttgcaccacaagttacaaaacaagtaccctcaagtgagggcctacaacttcccacccaaaaaggccattggaaacaaggatgccaagtttgtggaggaacggagaaagcagctncagaattacctgcgcagcgtcatgaacanagtcatncagatggtcccccgagtcgctgccagcnnccagaaagagaccctcatccagctgatgcccttc

SEQ ID NO: 200355 - DNA, 1028 bp, Homo sapiens
acactatttgtcttctcgctctttctgtatctttcagtgcaggcctggcatctcttgggcacacaccgattcgtgcatgtagttgacagtgaataagctaaatgtgcatttgatgccactctagggcgtatgccagatactgggttaggcttcatgtgctccaggtgaccaaagtctgaccccctagcctggacaggtttcctgtctggccctcgctgatctctgaacctgtgccacttttgttctgctgccctgccattcctctcttacacacctgatgtctcctgcagttgtgccaaatctttggagtgttgatggagaagttacagtagctgaacagaagccgggagaaattgctgaagaactcgcaagctcctacgaaagaaagctcatcgaggtggcagagatgcatggcgagctgattgagttcaacgagcgcctgcacagggccctggtagccaaggaagccctcgtgtcccagatgaggcaggagctcatcgatctccggggaccggtgcctggagatttgagtcaaacgtccgaagaccagagtttgtcggattttgaaatatcaaaccgggcgctgatcaacgtctggatcccctcagtgtttctccggggcaaagcagcaaatgcattccacgtgtatcagctatttaaaaatgtgaaaatcattcttagtctgtgggccgtatgaaaacagccagcaggccaggcgtccagcctggtttgagaggagtgcgtctggagggaacagtgtgtcagaggaagatggagcatctgcctaattcctgccgggcctagggcctgcgtgggctttctctgtcatgctccttcctatggaagctgctcagtagatcctgctggggacatggcattgcggcactgagacatcagagcagggtcacctgtgtgctactagaggggcccacgctgttcctccctgactactctaccaacccctggccaaggcagcagagagagtctttgcgcagatactctgataaatcaaactacaatggaaaaaa

SEQ ID NO: 200356 - DNA, 928 bp, Homo sapiens
  misc_feature (829)..(829): n is a, c, g, or t
  misc_feature (858)..(858): n is a, c, g, or t
  misc_feature (865)..(865): n is a, c, g, or t
  misc_feature (893)..(894): n is a, c, g, or t
acactatttgtcttctcgctctttctgtatctttcagtgcaggcctggcatctcttgggcacacaccgattcgtgcatgtagttgacagtgaataagctaaatgtgcatttgatgccactctagggcgtatgccagatactgggttaggcttcatgtgctccaggtgaccaaagtctgaccccctagcctggacaggtttcctgtctggccctcgctgatctctgaacctgtgccacttttgttctgctgccctgccattcctctcttacacacctgatgtctcctgcagttgtgccaaatctttggagtgttgatggagaagttacagtagctgaacagaagccgggagaaattgctgaagaactcgcaagctcctacgaaagaaagctcatcgaggtggcagagatgcatggcgagctgattgagttcaacgagcgcctgcacagggccctggtagccaaggaagccctcgtgtcccagatgaggcaggagctcatcgatctccggggaccggtgcctggagatttgagtcaaacgtccgaagaccagagtttgtcggattttgaaatatcaaaccgggcgctgatcaacgtctggatcccctcagtgtttctccggggcaaagcagcaaatgcattccacgtgtatcaggtctacatccggataaaagacgatgaatggaatatttatcgccggtatacagagttcaggagtttgcaccacaagttacaaaacaagtaccctcaagtgagggcctacaacttcccacccaaaaaggccattggaaacaaggatgccaagtttgtggaggaacggagaaagcagctncagaattacctgcgcagcgtcatgaacanagtcatncagatggtcccccgagtcgctgccagcnnccagaaagagaccctcatccagctgatgcccttc

SEQ ID NO: 200357 - DNA, 738 bp, Homo sapiens
aagatgctttttctataccaagtgatatgttcatgtggtttttctcctgtacagttaatatggtgacttatgttgatcttcaaatattggaccaaccttgcattcctggaataaaccctacctggttatggtgcactatcacttttatatattgctggatttgatttaaattttttttgaggattttgcatctctgttcatgaaggacatttgtctataattgtcttttgtattgtctttgtctggtttttggtatcagggtgctgtgggcagaaaatcgagaccaggagtgggtttgttgtcatcacaaatgctcgaaaaatgtggaagcagctttggaactgggtagtaggcagaggccagaagagtttggaggagcgagaagaagcttagatgccattcatggagtgtaaagggtgattttgttgagggctcagaagagaactgtagggaaagtctgaagcttctttgagaatacttaagtggtcatggtcagaatgttggtagaaatctggacagtgaaggccattctggtaagatctcagacagaaatgaagaacaaggtgtcagaaactggaggaatgaccatcctagttataaagtggcagagaacgtggctgaacagtgtccatgcccagtccttcctttgtggaaggaactgggatatctggctgaagaaatactcagggtgtggcatgttttcttctaactgcagagagtaagatgtgagaagagaaa

SEQ ID NO: 200358 - DNA, 445 bp, Homo sapiens
gaggtcaagaacattcatgcttatttacattgagctagtatttttaaacatttgtaaagatctgcttttttaggccttgtgactacaattgggacatctcagctaccacacccaatatcaccaggctgccagttataaaaaactggcaaccaagcttccttaccctcttagctcctttcttccaatctaaggggactgtgtaccataggaacttataatctgtcagtctgacttttccttctcttgtcttacctcttttaattttgtcttacctcttcttttaatctacctattaaatcttgtgaattaaaaaactattttatgccagggacggtggtgtgtgcttataatcccatccactcaggagactgaggcaggacgatagtttgagcccagcagttcaagaccagcctgagctacaaagtgaaaccctgtttgcgggaaa

SEQ ID NO: 200359 - DNA, 620 bp, Homo sapiens
ccacgtggcttgattggcttctttccagtcttagatgtcgccccctcagacagacattcccagatccccctctctaaagtactcagtatcacatctccttgtttcatttacttcagagcagacatcagtctcataaatgacttgtttgcttatttgcaatcttctcattagactataccatccgtggagcctgtgaaaggccctcaggacattgtcacatgatgctttcttactctgaggttttttatttttagtgccatgtttcatggcggggggcggggagtctgagttggtggtggccagcagaggccacttggtccctctgggctcttgattttttaagtattgacaataaagactggcaccactttacgatatgaaaataatgatggcaaatatttgtcctcactggttaattattaacattgcttataggactgacgatcaactttctgccttccgtggctctgtgagttcatataaggtacacaaaggtaggtttaggaagaagtgtttgaaacttgacccagttttctgtgagcaagagctgcttttcggagcagcggttggaagcaggagcagttcccatggtgaggtcttcgtaagggtgttgagttagc

SEQ ID NO: 200360 - DNA, 536 bp, Homo sapiens
gttgattattgcagactaaacaacttgagtagtaagctagaaatgtttttgaatctcatgtttaatttagacattttcagctaaggaaagcactggtttacccgaaacagtcataaagatgaaaacagtcatctttatgatagcgcagcagaaatatcattttgtaattccaaaaggaaccctggactgcaaggagcaaatcaatatatagcttactgaattatgaccccagttttgacactaactgaagggtagagtagggaatgggatatttttcagtatttctgcataatacaggaatggaaagcatgttctcttatctttgttatagtcagatttcatgtgtatctttttggtaacatgttttagttgttttaaagacttgtcttctcagtggatttgacaaaacactcaagtccttgaaggcaaggaatggagtctcatttgttcctagcaccaagtatcaggtcacgtatattgttggtagctgatcaaagtgtattgaatcaaattggatgttaattagttgaagaata

SEQ ID NO: 200361 - DNA, 205 bp, Homo sapiens
tgctgggattacaggtgtgagccaccacgcccagcctcttccctgccttttagttagcatatgcccttcttctcccccttgtagaagcagtaggggacagaaatgataagtcatatatggccggtgagtttttcttccaaagactggtccacactagagggtgcagcctccacagacactgggaattgctcctgacctatggaaa

SEQ ID NO: 200362 - DNA, 206 bp, Homo sapiens
aaatgtattaacaaaacatttctgcataatctcttttgtctctttctgtctccctctttgatttagaaagattgttctgcagtatgtgaaaagtagattggaggagtctgaaattgggggacagaaaagttagcttgaaaaacccattgcagtaatccagggcaagagattttgctggtctggacagagctgagccaataggatgg

SEQ ID NO: 200363 - DNA, 744 bp, Homo sapiens
tttttgtattggtagagacaggctttcgctggtctcgaactcctgagctcaaacagtccacccacctcagctcccaaagtgctgggattacaggtgtgcgctcccacacccggccagcagcttattcttaattatgacatgacaaattaagttattgctctacacaggtacatatggtagtgtgtagtagcaaatacaggcatttgtttgagctgcaatgagtagaaaatctatgtaactggaaaacaaatgagtattactaaaagttttgtgtgtatgtgttttaatttctttactttaataagttaatgatctcccttggaatcttaacacaatttgttgaacaaatgttttttgggttggtgtaagtcatgtctttctttgctaagtcacaattctaagtgaataaggggcacaacagtgtgaacttcggtcatcgtatttctttctgatagcttctcaaatagacttctgtcactttcgatgaaatacttcaggtatccatatacttttaacaacttagagtatatccttctagaatcatataaccaactttacagccaaaacttagaattaagagccattgtcatttggtgagcagtgaataagataaagtattcttggaaatggtgaaatctggtataccttttcgaaagcatctttatggggatggaacattttcttttaactacgtgagctcttctgatagggattttatactccaaaactagtctataagttcca

SEQ ID NO: 200364 - DNA, 247 bp, Homo sapiens
agatggagagtctatacttaaggtcccgtcagtacggacgtccaaatatctacatctttattggaagggtacctagtaaaatcagctatcacttcccatgacactgcaaggaaaattggttaatttaaaccttgacattgagcataggaatgaaatatctctttgatcatttgaatatcaagctggtattgtgggtttgctactgaagttcacactacataagtgataccaaaaaacaaaacagaac

SEQ ID NO: 200365 - DNA, 1206 bp, Homo sapiens
tctctttcctgttctcagataggacacaaggggttccattcggagttggctcaggacattcagatgccattattttagtaatgatcacatgatgttttgagggcagcctgaaaaaaatagagtctctaacagaggagctgggtaaaatcagagtaggaccatctctaatgccttttctagctctcttactctgattttgtgaatttatccttagggacagtttttcatcaggatgagaccctgctgtggtctgaatgtttgtgtctctctcccctcaccaaatttatttatatgttgaaatctaacccccaagttgatggtgttaagaggtggggcctttaggagacagttacatcatgagggtggatccctcatgaatggcattcacgcccttataaaagaagcttaagggccaggtgtggtggtgcgaatctatagttccagctatatggaaggctgtggccgtgagaagattgcttgaggccaggagtttgaggctgcagtgagtgaataacccctgcactccagcctggacaacatagcaagactctctcttaaaatagatagatagattagatagacagcctaagggagcctgattgcccctccaccatgtgaggacacagcaagaaggcaccatctgtgaaccaggaaaggagccctcaccagacatctgatttgtaggtgccttgattttggacttaccaaccccgagaactgtaagaaatgaatttctgttgtttgtaattacccaggctaaggtattttgttaaagcagaccagatggactaagtcagccccataatgacccgttttatatttttatttataatctatctgctgcttaattttgtgattagtggccagctactgtttactcatcttttattcatctgtaaaactcttttaacttgtctttgtaagaaacggttggctaacagatgaattttcaggttgttcagttttaaaatgttttacttaaaagggtaagacaactccccaatgcaaagtgtgacttcagagataactttcatttctttgaaatgtaggaagtccatagccattgctggctgacatctttctgctcaatatgctccaggggaagattatcaaattttagcttctgagctttcaaatggctcttattatcagtggcatattacatgaaactggttttgggctcttcaaatttatatttttggcaaa

SEQ ID NO: 200366 - DNA, 519 bp, Homo sapiens
agaaacgcccgagcccagcccctaggagggggtggggcatccctggccaacccttaaacattcccaactcctctcataacactagacacatgtgcccagcaaaaaaaaagacaaatgcttcgtgatttcacttatatgaggcacctaaagtagtgaaattcatagagacagaaagtagaatgttggttgtcgggagctgggggcagtggggaatagggagatattgtttaatgagggcagagtttcagttggggaagataaaaatgttctgaagatggatggtgtggatggtggtgatggctgtgccatacataatgtgaaagtacttaatgttcttgaactgtgcacttaaaatggttaaatggtaaattttatgttatgtatattttgctgcaaaaacccacttatacaatataaggtgacattattcctgatattttcttacctctccccctcatacacccacccctactgctgtgcatattccagattttgataaacacttgctaaaccaaaaaa

SEQ ID NO: 200367 - DNA, 287 bp, Homo sapiens
acccacccctccaaaggcaccgaggccctagaagaggtgagaacatctgcctccacaccgaccccaaacagcgcagacaggcggtgcggcgcccactttcatgaaagccgctccatcttctccttccccacctgccacctcctcggctgctcaagcatctctcgaccatgcaagactctacacagacgtgttttgtcccacccacgcctccagacaccggggagaaactctagagggggaagggactgctgatgagggaaatgaaaagagtttcgcccacaaggagc

SEQ ID NO: 200368 - DNA, 384 bp, Homo sapiens
ctttccagtagctggtactaaaagcgggcaccaccatgcttggctaattttcatatttttcatagagacggggttccaccatgtggccttgcttggtctgaaagttctgagctcaagcaacccacctgccttagcctctcaacgtcctggaatgacagcatgagttgccacacctggctgcatgccgaatactttagagttgtttatgcctgacacttccagggcatgcagaactatggtggcattaaccgacacattaaccaactgcctcacttacttttcttttgactcagtttataaattttcttaatttaaattttaatttcaacatgtatacatctttgaaataaataaaataagctctttgaatgtttgacataacgt

SEQ ID NO: 200369 - DNA, 560 bp, Homo sapiens
cagttcaggccattaaagttaagtgaaatgcttaaggttagaaagccaataaatggtagcaaaataatttttaagtcaatggactctagatatgatgtttttatttttacttttcactactaagtaatttgggtgtcttttaaaactttattgtatcaatacaaatgatgatggatgataataatgatagtaattcaaataaatagtgccactactgctaacagtgtacctaacacttactgaaaacctacatgtacaggcactactgtttcaagtgttttatacgtgtatcaactcattgaatccttgcatcaacttcataagggacatattattattcctatgttattgatgaggaaaccaggcaaagagaggttaggcaactcacactaggtcacacagtattaagcagcagaggcagaattttaaatcacatgggtaagctccagagccccctactcttaatctctgttatacaattaattttgctaaataatattggatatatttattaggagtatattagcctataaaagaataccatggaacaggacataaac

SEQ ID NO: 200370 - DNA, 568 bp, Homo sapiens
acgtgggtaacgagacacggtttcgtaatcctgggttctaagctttttcccgggggcttttataccctactccaaagtctttggtttcaggacctctttacactcttactatgtattcaagaccccaaagtggattatacctatcaatatttactgtattagaattagaacggcaaaaattttaaaatatttattcatttaacaaataacatatgttaacacaaataatatatctattatatgttaacgcaaataatattttagaaaaaggtaactgttttccaaaacaatttagtgagaagagtggcactgatttacatctttgcaaatctttaatgtctgactgaatagaagacagcaggattctcatatgtgatttttgcattcaatctgtcgtgatatgtcgtgctggttgaagtatataacgaaaatctaaccttacacagatatgtagttgtaaaaggaagagtattttaacaaacttttcagctaactgtggatatttttctttggtactacatcagaatccaacaagtggttgtttcttaaagattggttgcaatgtgga

SEQ ID NO: 200371 - DNA, 239 bp, Homo sapiens
caagggcaattcccataacttcttccttatcttgatttctctgcctctgtaggggctgaggctgggctaagcttggagatgctggaactcacagtgatggggaccctcacaatggagatctgttctttactgtcattctctccataactgtgagctctatgaggcagggactgggcctgtcttgttcactgctgggtctctaatgcctagcccagctcctggtgtttgtccagggtgga

SEQ ID NO: 200372 - DNA, 452 bp, Homo sapiens
aatttggggtggatttggagggaggagggaggtggacatctagcatggcttccaagtctctggtgtgtgcctgggtggagggatggagggggcactcgtggtgccctgaacagaggcagggaagaaaggagtggagcaagctgacgcagcagggaacaagaccatgcttgttataaaggtctggcttcagcagttccttcaaaaacctcattcttagcaacttctctaattggccacacctgactctggggacaatcatcttatacatggaacgctaatgtactcgttcatttacctgttgttttgtaagtgcccatcagtcatttcttgcaagtgatggtgagggcttcagtgttgccctctcatgcagcccatgggatgttctggaagggagcccctcctcccaattgtttatcctccacccctataaggcacagagcacagcatgttct

SEQ ID NO: 200373 - DNA, 701 bp, Homo sapiens
gcatttttaaaagatgatctatttgtacagagctaatagaaagaattctaagacatgttgataaacaaggtggtggtgaaacaatgcatatggtctggtgtcttttatattaaaaaaattatatatttgtatatttttatatgtatgtaattttgtagaaaggagattggaagaatacacaccaaattatcagctctagttacctctggagagaagaggggctgagtatgaagaaggtcctcagcattttgcttatataattgtatataatttgagtttttcacaatgagaatgtattcatgtaactgctgagtaatttttgtttttgattttgttttgtaatttatacaaatattttacaaatgtataaagtacatgtgagtagtttttacatgtatagaatgtgaaatgatcaagtcagtgtatttggactatccatcatcttgagtatttaccatttctatgtgttagtaacatttcatgtcctctcttagttactttgaaatgttcaaggcattgttgctaactattgtcaccacactgctatggaatgttaaggctaactttttcttagatctcaccttcttcaggtttaaaaatgtaacaatatgcaaatttttactttcaaataaccaggttctgtgagtgccatgacttgatgtacaaagaagaaaggatatcaggaagagaaaactagagta

SEQ ID NO: 200374 - DNA, 827 bp, Homo sapiens
tctgggatgtgtggttatatctgatttctgagctctgggcgtggaggtctgtctgcagaggcccgggcctgggcacaaagggagaggggcctccattgtcccgcaggggccaaaatgcagaccgtgcatccccggtgacctcggggaccgttctctgatcatcaggattttcttggactctggggtccttgtcctgctcaggcatccctgccccgctctccttgagggccctcaacactatcttccctggacacaagtctggggacagccgggtgttgtggaccccaaaggggtgactacctgctcctgggccccacagagtccttgtgctcagtgtagtggctgagctgggggatgccctggaactcggagcacacagcactggcttactgtggtacctgtgcagtgaaattgaagacagaatcaccaggatggaacacaggtcttgcaggatcacggaaaaccttcttagagttgtcttgacaccactgatgtcgagtgtgcgggtgtttgtaggatggcctgccactcagtccaggggcaggagcaacggggagatcccacaagcaaagtgaactgggggatgggctgaaggggctccaggcaactgagccctactcgcaggtcctcggccttggcccaaacaggaatgaggggcacagagtgcccgggtaaccgctcctgggagcagtggggaactgtcggatacttgaactctcaagagctgggctctgagcgtcctcgtccagctgccaacttggccaaaggctaagccagcagattgttctgttgccgggcaacgcgacttctaaacctgagggagtggg

SEQ ID NO: 200375 - DNA, 491 bp, Homo sapiens
agcatcaaagtctcagtcgctagcatgtgacttacagaagctctcatgggaacaagacaagaccatactgttaccgtgacactcacggcctccctgactggtttctgctgttgattctgcctcaaatgctcctcaaatgcaccttgctgctccgcctccaccctagagctcgcctgactgcccacttgcccgttaagagtcggcttaggcttcactcctgccagaaaggtcctgccaggtgctctcaacagtcaccccctcctgtggtctcacaaaaccccagcacctctcggtcactctctccctcctatctggttgtgactgtcttccatgctcacttagaagctctctgaggccaagaactgtgtgtactgttgcttctttgtttacctgggcctagcccattgcctcatacacaggagaatgcaaataaatcatatgcttaatgaatgagtcgatgaatgaatgatgaataaagggaatctaatcta

SEQ ID NO: 200376 - DNA, 443 bp, Homo sapiens
ttttttaaagccaaaagactgtgactttcccttcaaatccaaacaatcagttctaaccattttactgcttacatatttctaaatccttaatatcactagttcatgccttccatattttttaccaagactattgcaataggtcagctgttttacccactttcattcttgtcctctaacctttgttttttaactgctctatataagctgtaaaatggaaacctgaacatgtctttctgttgtttgaaactcttcattggttcttcatcatctgtagaataatgccaagaccaaataacctagagccatacagggctcctgtataagattttatttccagcttcagttttggtcattcctgctgctgcctttttgctttggtaatgctaaactatacttctttcattgtgcactttaaggattgtaagttttctctcagcaaaaaa

SEQ ID NO: 200377 - DNA, 406 bp, Homo sapiens
ggcactctttgctatagagctactagagaatttagttttgaatgtgtcgagaggagatctgcccaactccaagagttggggactgaattagtcatacacatagatacatatagataaccaggctaataaaaaaagtcagacatttattaactcccaagaggaaaaaaaattctcattttcttgtttcatagtatactatatgtcaactctgactacattgtaactataaaaacactaaatattgagtattgctctaaccaaaattataataaatgaggagggtgggtaggaaattgtgtgtgcacatgtgcgcacatatgtgtgtggtggagtctgtgggagagtggaaagagaattaaattctaatcttcattggtaggatgtcattagataatgcctaacacca

SEQ ID NO: 200378 - DNA, 500 bp, Homo sapiens
ttaaatcatttttgcaacaaggttgggcataaataaatgattttgtttcccactcactgcagcccatttcacagatgataaaactgagtcccagagaagggcagcaacctgatccagggctgcagtgagtcaatggggaagaagagactctcattcaacctctccatgcttggtgggttcctttcctgctctgtccatttctgaagagatcacttgtctctcatttgccaactgtattaatcagaagtctgtattaatcagaattgccaagtgacagaaatcctgttgaataaacaaagagaattacttattcccttattgccccataaggtgcaaaccaaatggagttcaggcatggtttgatccaagtacatggacaggatcagaagcaggcctccgtccacactcagctttgcatctctttttgcttggtaatatcatcctttcctgcttcagacagcttcattccatgtggcataaatatgacaccagcagcccca

SEQ ID NO: 200379 - DNA, 680 bp, Homo sapiens
tctccttttttagaaaccaagaaataaggcaaaagtatgtcaacagcaaagtggataaattatgctatattcagacaatggaacgttatttataaaccaatttaaaaaatgattacaactactggtaaatgacatggatgaatctcacaatgttgaccagttactaagtgagtcaaggagggaataagagttgtgactaggaagtagcagaggcagtttgtgactggagaccagtaatgttctatttactgatccagttgtgaagagatgggtgtttctactacaacgttaaactatgaatatctggattatgtactactttgtatgcatatttttgtttcacaatgtgaaataaaaagggtattataaactttatgccagtaagtttgaaggtgtataagaaagaaaccaattcctggaaaaaatgcaacttgccaaaatgacataggaagagatacaaaatctgaatcttcttaaatctatttttaaaactgggccgggcccagtggctcacacctgtaatcacagcactttgggaggccgaggtggatggatcacgaggtcaggagtttgagaccagactgaccaacacagtgaaactccgttctactaaaaatacaaaaattagccgggcatggtggtgcatgcctgcaatccgagctactcaggatgctaagaca

SEQ ID NO: 200380 - DNA, 234 bp, Homo sapiens
ttaattgtgaaatccatgaaacattaataccacagataaagtgtatatctgtttatataatatatgtaaatctgtgctttatacatgaaaagaataagaatcttttaatctcccccaggaaccaattttagcctctttggggtttatatatctccactgagactatatgaagtagacaaagctcaaagtttcaaattgtagaaaaaaatattttcacttactttcaatgaggca

SEQ ID NO: 200381 - DNA, 837 bp, Homo sapiens
acaatacattaggtaatgttggggtttataaatcgatacccccaaatatagtactgaaccgaagaagcaacctgaagatctctctgaccttccccgctccacacggtctctcccaaaaagctgaagttcctttatttgcctaagatccagaccctccaaggagaacagtaggtttcttttcctcctgtaagaccaaaaatgtaaccacacctgaacagaccttttcatgagttaatgcctgcttctcatggtcatctaaattccaaagaaaactatttacaagttaatttgtttcctgatcaaatcattctctttagtaatcatttattgcccatcaacagaattccttttctcccgcaggatccaaactcattctttctgtaacctcatgatgacgtataagcttttgcacctcactgggaggttgggtcttcattctgaaggcttctatgtatacatattaaataagtttgtatgccttttttcctattaatctgccttgcgtcagtgattttcagcaaacttcagggagccaaaggccttggctcccacagtgataataaacaatatgacttttggctatcaaaattcctgctgttagttaaggaaaaattgtgacagtttctgaaatggacaaatacaggcatccttccagtggattactaggatttgtctagactagaggacaggatgcttctgggggttttctgattctctacaggtcagtatccttccttgtcttgtactgttttgcaactctagaaagaaaagttaaatatgtagaagcctgacagtgatacaaatgatccctgttcatattaatacaaatgcaaattg

SEQ ID NO: 200382 - DNA, 566 bp, Homo sapiens
gaataaaattattagccatgaatggaaggctatctgacatatggccatagcatcctttttcagtcttgctcctaggattcccctgcctgtccactttgctctagtgatactgaaccaatggccactccctgattatgcctcctgcttctctccttcgttgccttattctgtcttaccggctttcctttcttcttctctttttaactacttaatcctacagactatgcaagattgaactaaaatactcttatacctttaggcacaagagatgaactgccctgtcaatttgtttctcttcctttcttgttgcaaataaccttatttattctgctttatgtttagttgtttaaggacttattctttctactaggttacatacagatgtcttgactactgttccattttcatcttcataaattctgtaacagctattagttctaataagaactttttaatttaattggttgttattttcatattttattttttattcataaagaatcttacaggtgtgtctccatttcacattatatgccatttaatgagttctatttttttttccattt

SEQ ID NO: 200383 - DNA, 592 bp, Homo sapiens
gtttggtccagaaaggcaggataagtggaaggggggataacttccaggccataggtagattcacagattttctgattggcagttggttgaaagagttaagttattgtctaaaacttagaaatgtctgggttaagataagtgggtgtggagaccaaggttttattatgcaggcgaagcctccaggtggcaggctttggagagaatagattgtaaatgtttcttgtcagacttagagggtctatcaataaatccaaaagggaggagggtagaatcaggtatgtccaaccccccacccttcccatcatggcctgaattagtttttcgggttagctttggcactgctgagattccaaattgctgtcaatagccttgctgagaggaggggttcattcagatggttggggggcttagaatttcaattttggtttatcatccccatttcacagatgagaaaaccaaggctcagttgttgaagtgtcttgctcaaggatgagcagctggggaaggggaggagtccgcctcacccttcccattgcagctggattttggaagccaattccagctggaggactaggagatttgtagtgggtga

SEQ ID NO: 200384 - DNA, 4250 bp, Homo sapiens
gctgaggccttcccagctatgtggaactatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagatcagctttggagggattccagcacctggaaaatcagtgtcattcccacatagaaattttcatggatgtttagaaaatctctattataatggagtggatatcattgatttggccaagcagcaaaaaccacagatcattgctatgggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggaccaatgacactggattgcttgcttataaagaacatcttccagtaactaagatcgtgattacagacacaggccgactgcattcagaagcagcttataaactggggcctctgctctgccggggagacagatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtggaacggccaccagacagagaggctttctgggctgcattcggtctctgcagttgaatgggatgaccctggatttggaagaaagagcccaggtgactccagaagtgcagccaggttgtaggggacattgcagcagctatgggaagttatgccgcaatggagggaaatgcagagaaagacccattgggttcttttgtgactgcactttctctgcatacacagggccattctgctcaaatgagatttctgcatattttggatctggctcatccgtgatatacaattttcaagaaaattatcttttaagtaaaaactccagctcccacgctgcttcatttcatggtgatatgaagctgagcagagaaatgatcaaatttagtttccgaacaacacgaacaccaagcttgctgctttttgtgagctccttttacaaagaatacctttctgtgatcattgccaaaaatggaagtttgcagatcaggtacaagttaaataaatatcaagagcctgatgttgttaactttgattttaaaaacatggctgatggacaacttcaccacataatgattaacagagaagaaggagtggtctttatagagattgacgataatagaaggagacaagttcacctgtcatcaggcacagaattcagtgcagtcaaatctctggtattgggcaggattttagaacacagtgatgtggaccaggagactgcactggcaggtgcgcagggcttcacaggctgcctctctgcagtgcagctcagccacgtggcccctctgaaggcagctctgcaccccagccacccagaccctgtcactgttacaggacacgtgaccgagtccagctgtatggcccagcctggcactgatgccacatcaagggaaaggacacactcgtttgcagatcattctggaacaatagatgacagagagccccttgctaatgcaatcaaaagtgactctgcagtaattggaggtctgatagctgttgtgatttttatcttgctttgcatcactgccatagctgttcgcatttatcagcagaaaaggttatataaaagaagtgaggcaaaaaggtcagagaatgtagacagtgctgaggctgttctgaaaagtgagcttaatatacaaaatgcagtcaatgaaaatcagaaagagtacttcttctgattggcagctatgatttaacataaaattatgatagtttgttttaatagccaggggttctcaatggaaaaacgaatgctcttacactgaatgtacaggcagtgggcttgcagcactgccatcttgccatgtacaggcttggggtggctccaggaagcctcgtccagtgatatatttctcatagcattcattctatggaacaagaaattagatattgctgttaattttcaactgttctggtatgatctaaaacaagtttaacctgcttaatggctacagtttttacatgtgaaaactgtagccttggtctcttaaccatgtaatacataagttttgttagaggtaaaaattaaatttggactataatgtccttgctttatttg

SEQ ID NO: 200385 - DNA, 546 bp, Homo sapiens
gctgaggccttcccagctatgtggaactatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagagcagtgatcctgtttgcagatctggagaagaaatgctatagaagtaaattacgtggctgggag

SEQ ID NO: 200386 - DNA, 2740 bp, Homo sapiens
gctgaggccttcccagctatgtggaactatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagatcagctttggagggattccagcacctggaaaatcagtgtcattcccacatagaaattttcatggatgtttagaaaatctctattataatggagtggatatcattgatttggccaagcagcaaaaaccacagatcattgctatgggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggaccaatgacactggattgcttgcttataaagaacatcttccagtaactaagatcgtgattacagacacaggccgactgcattcagaagcagcttataaactggggcctctgctctgccggggagacagatcattttggaattcagcttcctttgataccgaggcttcatatcttcattttcctaccttccacggagaacttagcgcggatgtatctttcttttttaagacaacagcttcatctggggtatttttagagaacttggggattgctgattttatacggatagagcttcgctctccgacagtagtgactttttcatttgatgtggggaatgggccttttgaaatctcagtgcagtcacccacccacttcaacgacaaccagtggcaccatgtgagggttgaaaggaacatgaaggaggcctcccttcaagtggatcagctgacaccaaagacacagcccgcccccgctgatgggcatgtcctgttacagctcaacagtcagctcttcgtgggtaagttctctttttaagcaatcattttattgtatgatatgt

SEQ ID NO: 200387 - DNA, 529 bp, Homo sapiens
gataatacgaaaccaatcattacatgaaaattagtcaataaaggggaaatatataaacatttattctgactttcctaaatgaactataccactaagtatctaaatagtagatgtgggaatatttctttataaaagtaatttcaactaataaatgaaaaatgaatgatagaatgttgccattttgcaatttccaatgaatgaatatgggcatttagcacaaacagctgctaagatcacataacacagatgaccggatattacgtgcctcctataatcctgccaaatgccactaatagtcatgacaaaagattaaacttgagtctgatgcttctctggatccagctgcaaattgcagaaggctattgagaggacaaaggaacatgctgaactgcactctcaaaaggatgtgttctgtaaaatccggattctggaaaactctataggtcaaattgtctgggttttccaaaagataaattgcaggaaagtggcagatgtggaggaggaccctgtagattaaaagtgacttaaa

SEQ ID NO: 200388 - DNA, 479 bp, Homo sapiens
gttgctgattcccattagttgcagatacgttagatacacccttgatttagtatatctcttcctggaatatcttgcttcagtcataaaattcatgtttttatgaaaaattgcagtggtcaccaaaaaagagaattttagaccaatatccttgatgaacattgatgcaaaaatcctcaataaaatactggcaaactgaatccagcagcacatcaaaaagcttatccaccatgatcaagtgggcttcattcctgggatgcaaggctggttcaatatacgcaaatcaataaatgtaatctagcatataaacagaaccaaagacaaaaaccacatgattatctcaacagatgcagaaaaggcctttgacaaaattcaacaaccttcatgctaaaaactctcaataaattaggtattgatgggacgtatctcaaaataataagagctatctatgacaaacccacagccaatatcatactgaatgg

SEQ ID NO: 200389 - DNA, 195 bp, Homo sapiens
agaacaatgtgagaagaatttggagctcctgtgagccatctggaagggactaaggaaaaccaaaaaccatggtaggaggctgcagtctgaggtatagaaatggccaagagactttttcagagaacaaggatagctgtacaatctctaaaatgaaataatttgacagaagcagaattcagagccagaggagaccct

SEQ ID NO: 200390 - DNA, 414 bp, Homo sapiens
ccattaggcactttgtagattcttggaaggaaaatgagaattagaaatcaggggccttcaccccagcaccaccaccacacctacttcgagctcagctatttcaggtagtttgagtcctgtctggtgctttattgctaaaaatggatggatgagtggatagatgggaggaagggagggagagtggaaagaaatgaaagaaggcagtgagagaagagaggaggtaagggaaggtgaacagatagacggaagtaaagaaggacagatggatgaaaggatggagaataggatgaataactgaattaaaaaaaggaaggaagaaaagaagcaaggaagaagggaagaaaggaaagaaggaaggaagaaggaaaggacaaatgaatggatacaaaggaagaaaagtataaataaatgatt

SEQ ID NO: 200391 - DNA, 429 bp, Homo sapiens
atggaagggcaagagggacaggagagcaagtgtgagagagctcgcttttagaacaaagccactcccaggataagagacccactctcatgataacagcattaatccattgatccctgctaaaatgcctgtgaatgagagagcccttcactgacctacagtaagaatcaacaccctccactcccagattcctcctcctgctaccacctcttcttgtcaatgacacttgctaccacctggaataggacaaatacgtttgaatagagccaatttttcatccattcaaacgacagtgccataaagttagaatctttcatcaattcatctcctgccatctcctcactgcctacagcagtgcctagtgcagtgcagccaatcaaaaactgtgtaggcaaatgaatgaataaaggaaaaaacttattgtcatacaaa

SEQ ID NO: 200392 - DNA, 474 bp, Homo sapiens
gctgaatgaatgtcgggctaacaagaattagtgtgtagactggcgcagtggctcatgcctggaattccagcactttgggaggccaatgcaggaggatcacctgaggtcaggagttcaagaccagcctggcactatctgataggccttggtgttctattgaacataaaccacgtcacagagcaccgatatcagacagggccactctgtgaccacaatgggtcaggacaagaacaaggccactcagtaatcacgtctgaactgggaccgaaacaggaacattgttgaagccacaaagatgaccaaacatcctcccatgccgctaacatgagggactcctgcttggccactcacagctctagcctctcttcattccttccaccttttagataagatccattaacagcatcaaatccagaacaaagccccacttccatgaacctctccccaacatgatctaacacaagcacaaatcct

SEQ ID NO: 200393 - DNA, 796 bp, Homo sapiens
ggatgagtttggttagagttgatgattctgaggatatgatgagatatcgaggttagaaacatgggcctaggccaggtgctgtggttcatgcctgtaatcccagcactttgggaggctgaggcaggaggattgcttgagtccaggagatgaagaccagtcagggtaacacagtaagatcctgcctctacaaaaattagccagacgttgtggcatgcgcctgtagtcccagctacttgggaagctgaggtggaaggatcacttgcactccggtgggcctagacttctggtgggactgggagtcgtcagagtgtagggtagagttgttagagtatggggtagaccaggacattttggaccaagcatcagaacacatggaaccaaatgtttgacattgagatcaacccatcctgttagatacctgtagtagtggttcatctagacgccttataggagaatcaaggatgccccaggaaagaagagagttagtgagagacagaggattctttcccccaaggatcaggtggaagaatacctccagcaaaggagaagtaaagggatcatggaccagagagaagaactagacttgtgctgtatggtagacctcattgatgagtccctaccacatgcaagactgtgaaagattatagagggcagggtggccatgggatagaggatcctgagggattttatagttcagaggggcaaacagccagttgtcaatggctaatgtaatactttgaagaataaaaaaatgctgaactggacttcagacaacacattgtggaaatgcagaagc

SEQ ID NO: 200394 - DNA, 787 bp, Homo sapiens
tgtcggatgtgtctgtgtgtaatctcctgattatacagtgctggaaactaatttttaaaactctgtagcaactggctcacacctgtaatcccagcactttgggaggctgaggcaggaggattgcttgagtccaggagatgaagaccagtcagggtaacacagtaagatcctgcctctacaaaaattagccagacgttgtggcatgcgcctgtagtcccagctacttgggaagctgaggtggaaggatcacttgcactccggtgggcctagacttctggtgggactgggagtcgtcagagtgtagggtagagttgttagagtatggggtagaccaggacattttggaccaagcatcagaacacatggaaccaaatgtttgacattgagatcaacccatcctgttagatacctgtagtagtggttcatctagacgccttataggagaatcaaggatgccccaggaaagaagagagttagtgagagacagaggattctttcccccaaggatcaggtggaagaatacctccagcaaaggagaagtaaagggatcatggaccagagagaagaactagacttgtgctgtatggtagacctcattgatgagtccctaccacatgcaagactgtgaaagattatagagggcagggtggccatgggatagaggatcctgagggattttatagttcagaggggcaaacagccagttgtcaatggctaatgtaatactttgaagaataaaaaaatgctgaactggacttcagacaacacattgtggaaatgcagaagc

SEQ ID NO: 200395 - DNA, 568 bp, Homo sapiens
aagtagtgtttcccacacttctctattaagaagcatgtgagatacttgttacaaacataacatcctggtcccaccccaaagccactcaatcaaatactccagggaagggatctaggaattcgtaggtttaacgagtgccccaaaatgattattacctgttggagaatctaggcaacaatgaattaaggaaagctctctaccatttggtactggtaccaggtttgaggatcacagggaagagggtaagcatatcagactagcagagctgccagaactcgggctttcaaaagagaggtgccaccctctcccatgtccatgtaagtagcaaacaacccattcagactacagcaggagaatcctgagtgtagaggttcatttatgctatacataaccaaattcatcataaaaagttttccaagggctgggcacggtggttcatgcctgtaattccagcactttgggaggctaaggcaggaggatcgtttgaggctagtagtttgagagcagctgggacaacatggtgaaaccccatctctaccaaaaaaaaaaaggggttaaatttccatct

SEQ ID NO: 200396 - DNA, 396 bp, Homo sapiens
gtaacattgtttttctttacagtttgtgatttcaatcctctgctttcccaatgccactttgaattggcttctttaaaactccaacataaaacctcaagtgaccaatatgtggtctcattatggtattttgggttaaaatgaaattaagatagctgggctcacccagccaaacacatttaccaaagggaaattttgaggcatcatagactgtgaagtggttagggaaaaagagagttaaatgttggctagtttagaatgccaagtgtccatcccaacttggttatactggccagagatggcaaagaatagagacaataaggttctgaaaagacagctggtgactggtatggccctgtatactcctgggataaatcatgaagtgagggtctcctgtac

SEQ ID NO: 200397 - DNA, 458 bp, Homo sapiens
atgaataattaaatgaatatcatctgttctgtacttcccagtggaagattttgttaattttgctggttattttgatagcatatagcaggtactcagtgcctgaatgagtgaaggatttttcaaacaatactcgccaatataatatgttctatacattgatcactcttaaatttatatctctagccaagacctctccccttaatttcaagctggtatgttcagtggtcttctccacatcatctcacatatataagatgcatttcaaacttagattcccaattgagcacctgcttctccatcagtcatctgtacctcagtaaactgcagtgccttttttccggtttcttaggccaacaacatggctgtcatctttgactcctcgcttgcttgtgtacccaatatccagagtgtcaacaaatcctccagactctgcccatctctcaccaactttacagctt

SEQ ID NO: 200398 - DNA, 770 bp, Homo sapiens
ctactctgtgaaataatattcaacgtgattgaagtgaaataatagattttatgtctgacgtgaaataaaatattcactagctttgtgagtttgggctttttggcatgttagagcttgtactcttgaaaaggatatggtaatagaaatttttaaaaacagtattatattaatattttaaagataagctagatttgaaggtgaagaatgaagggaactgctctataagttagctgttcttataatcagtacacaaatatacacccagtgcactggtatagagtttatcagttaacattgtatcattgaaaattagaataatatctaccagaaagttcacagagtaagaatttagacttttgagcttggtgtcgatcattaatgtatattaactgaaacggatcattcagtcattgaacagtttgtatattgggaacaccaaccatgttagttagaatggatgtgttacagtgtgtttacacattataaactacagagcatgagcttatgtccgttggttatctgttgagcagtaaatttaggttgaattatttcttctattctcctctatgtgataggcaagctgtgggggaagcacaggctttggagcaagcagatctgattgtgaccttacataagtctcaatttccctgtctgtaattagatcccactttattgggttgttgtaaggattaaatgaagtaatttctgtaaaacataatgactgatacaaagtagaaaataagtaaatttttaattttctttcacttttg

SEQ ID NO: 200399 - DNA, 278 bp, Homo sapiens
atcctcaggggtggcacacactctgcaagcatggtgctaggcacacggcacaactctgtgtatgtttgaactgatgctaggttcacaggctactgcctcagtacttgtatacttggaaggaaggatcaagatcgaggtaatgctgttgtatcttttcttaacagaacaggcaaagcccttgtctcttgtatggcctgcttccttaggcatgaggacagcttgcaccatgagtggttactcctgatcttcatagtaaggaaggccgttagtcacgtttc

SEQ ID NO: 200400 - DNA, 352 bp, Homo sapiens
cctattgtaccaataccccctagaaaacatatgtgccgtccatttaattacaataacgagattgcaaacaagttatcacagacaaaatttactaattgctgattgttattaggcattacttttttttttttttttttggagacagcgtctcactctgtcgcccagaatggagtagagtagcatgatctgtgctcactgcaacctctaccacgtgaattcaagagattctcctgcctcagcctccagagtagctgggattccaggtgcctgccatcacgcccagctaatttttgtatttttagtagaggcagggtttcaccatgttggccaggctggtcttgaactcctgacc

SEQ ID NO: 200401 - DNA, 630 bp, Homo sapiens
taatcccagcactttgggaagccgaggcgggtgggtcacgaggtcaggagttcaagaccagcctggccaagatggtgaaactccatctctactaaaaatacaaaaaattagtcatgtgtggtggtgggtgcctgtaatcccagctactcgggaggctgaggcaggagaatcgcttgaacccaggaggcggaggttgcagtgagctgagatcatgcgactgcactccagcctgggtgacagagtgagactctgtctcaaacaaacaaacaaacaaacaaaaaaattgagcaaggcaaactccattagatcgaaagctttaagaataatcctcttgcctgggcgcggtggctcacgcctgtaatcccagcactttgggaagccgagatgggtggatcacgaggtcaggagattgagaccatcctggctaacacggtgaaaccctgtctctactaaaaaaaatacaaaaaaatcagccaggcatggtggcgggcacctttagtcccagctactcgggaggctgaggcaggagaatggcatgaacccgggaggcggagcttgcaatgagccgagatcgtgccactgcactccagcctgggcgacagagtgagactctgtctcaaaaaaaataaa

SEQ ID NO: 200402 - DNA, 613 bp, Homo sapiens
actggaacagcaaagggattcgcaacagttcttgctgaagcagttacatccctggatctgcctgtggccattattaatctaaaagaatatgatccagatgatcatctgatagaagaggttggcaaaaatgttgacaagtggctctggatgcttggcgcgcatcgtgtgatgagtcgaggggagggcgactgcgacgtggttaaaagcaagcacggcagcattgaggccgacttcagagcatggaagaccaagttcatctcccagctgcaggcacttcagaaaggggagagaaagaagtcctgtggcggccactgcaagaaaggcaaatgtgaatctcaccaacatggctcagaggagagggaggaaggatctcatgagcaggatgaattgcatcatagagacaccgaggaggaagaaccctttgagagctccagtgaagaagagttggtggtgaggaccatcagagcctaaattccattgtgatgttgaagattgggcaaaattatggatcatgtgacgaaagaacagagagaaaaggaacagcaggaagagaagtctggtttgttcaggaacatggggaggaatgaagatggtgaaagaagagctatgataa

SEQ ID NO: 200403 - DNA, 287 bp, Homo sapiens
gcttcacaggtacaataagagaggttcagcaactgcaggtcttttggtctccctaggcccagtggagaccagctggagagtggaccctggtgtgaggtttcttagcccagtctacaggataccaaagcacctgatgagcagtccttgtcaggcttaggaaccctcccccttggtagggagcttcccagcttccccatgagaagccccatcaccagcaagttcctcttcaaagagtgagaggcacaggcagtagttatcacactaacagaagtgtctgaagccatgca

SEQ ID NO: 200404 - DNA, 311 bp, Homo sapiens
taatacaacgctttgagcatggacttaaaaatgcagagatgaaatataagagcttcttggaagcaaacattgttggacagacttataatgtgtcaggattttcaaactcattttctataactttccaaagatgctgtcaaatgaaggatgagtcaggttttccataaaaacatcattctaattttgtaaaacggtgtggctcaaaactataaattgggctgccaaactatttctctcaaatgtttgatggtttgggaacatgtagaatccattatattttcttcattaaaggactccatataataaagtga

SEQ ID NO: 200405 - DNA, 509 bp, Homo sapiens
gccgggctgacgctccagctgctgtggccggaggtgcagccccgtcaggacggctccactccctggcgcctcacagactctggggctgcggtgaggtcgccctgaagaccccctggtgaggacgcttgaacccgggctgtcacctgagcacaggctgccactctgagcttttggggcgccctgtgcctgtcgggctgatgctcctctggctcccggccacctggggctgacaccggttctgtgggtcctgatatgttcacctgtcgccactcctgtggccacagctacccatgaagcgctttgggagcctcaggagcaacaagaaacacaaggaccaaaatcgaagcacggagaggcgccagtcggagcctcatggccttttcggtaggactctgcccattcccgagcccctggtggtctgtccttgggagggaaccccacggcgtgtgtgcacaccctcctaagcagtagctgtttccagccactctcttccaactgggatataacat

SEQ ID NO: 200406 - DNA, 944 bp, Homo sapiens
cgggggttgttccggcagcctttcactgaggggacccgccagtttcaaattcagtggcgtttgccctgattcccggggcctggctttcagcgtagcaattctgccggcgaagaaggtgagcgcagtgctgtgtggcagcagaggtccttaggacgaggagcagcgggacgaggaagggcagactggtgaaatcgcaaactgggcgtctgttccggcgccggacccctgtttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcctggctccgtgactttgaacagaagaagcgtgaagaagaggtcaggttctggcccccgcttttctgtgggtaatacctcatactgcgaccaggcacagaggcggaggagaccccgggatgggagactcacccttcgtgcgctcacccaggctctcctgctttgctccctgctgcctgctgcgtgctgcccagtgtgactggcgatggtgggtgggtgagcgctgtcagtcgctgttcctgtgctggatgatggggcaggtaaatgccctctctgcagtgtcttacagcacacctgcatctccagttttcggcccctccctggctcttaccaggtcacgtgatccctccagacaacatcctgccccttgtcatctgcagcggggtctccaaccagccgctagaattcacgttccagaaaagagacctgcctcagatggtcagtcccagccagctcgctgcaccacagcctggcctccggcagccaacgggtcacctggggcacggggcgctctgggcccaacctg

SEQ ID NO: 200407 - DNA, 749 bp, Homo sapiens
cgggggttgttccggcagcctttcactgaggggacccgccagtttcaaattcagtggcgtttgccctgattcccggggcctggctttcagcgtagcaattctgccggcgaagaaggaagacttcatggcagagctgtaccgggttttggaggctggcaagattgggatatttgagagtccaactggcactgggaagtccttaagtcttatttgtggggccctctcctggctccgtgactttgaacagaagaagcgtgaagaagaggtcaggttctggcccccgcttttctgtgggtaatacctcatactgcgaccaggcacagaggcggaggagaccccgggatgggagactcacccttcgtgcgctcacccaggctctcctgctttgctccctgctgcctgctgcgtgctgcccagtgtgactggcgatggtgggtgggtgagcgctgtcagtcgctgttcctgtgctggatgatggggcaggtaaatgccctctctgcagtgtcttacagcacacctgcatctccagttttcggcccctccctggctcttaccaggtcacgtgatccctccagacaacatcctgccccttgtcatctgcagcggggtctccaaccagccgctagaattcacgttccagaaaagagacctgcctcagatggtcagtcccagccagctcgctgcaccacagcctggcctccggcagccaacgggtcacctggggcacggggcgctctgggcccaacctg

SEQ ID NO: 200408 - DNA, 556 bp, Homo sapiens
cagaatatgttacctataaaaatgacaaaatgaaattagctggtttctaatagacttaatgtttttgcaggaatatacaattatttcagaaccattagagaccaatgctcatcccaactctagaccacactcagggtctctgggaaacagagacaaagcataaaacagctgggacatttggaactcagatgaactgatggacaacacagaacatgtgtcaaaaaaataacaattcaaatttttacgtcattgccacataaccctggatatcagtttttataacttgaataatgtaatttgaaaatactgttcttcaatattcaaaactcctctttaggaacatgtagagactgagcatggtggttcatgcctggaatcccagcactttgggaggccaaagcaggagaattgtttaagccctgtagtttgagcccagcctgcacaatatagcaagactccatctctataaaaatgcttcttaaaaaaattagctgagaatggtgatgtgtgactgtagtcctagctacttgtaaggctgaggtgggagaatcacttg

SEQ ID NO: 200409 - DNA, 229 bp, Homo sapiens
agataattgcagattatgaagaatcacaaaggaaaaacactaaatgattaaaattagttttactgtatattactgactaaaaattaactacaatcacacttgattatctgaaatgtttccatttattcccatacagttaagtgaaaatatcatggtggctttgagattagacatttttaggtctgaataccagttctcctactcatttttaaaactatcaactacattg

SEQ ID NO: 200410 - DNA, 413 bp, Homo sapiens
tccacgttgggcttcattttatcaaaatacagcaaagagctcatcatttctcagctcctgtcggaagcaacagtggctgttcctggacacagagctgcagacaaggagtggtgaggattcaggcaagagaagatgggcagcttccccttcatgcttccctctcaggaagaagccagggtgcctgggatcaaagaggctaggaggctggtgaggcctcctgtccctgaaagcggtcagtgaacccaaaagttgaaaagcctctgctttgagagtggttctgctgccctactggtgctgacagttttagaaactgacatggcagagctgaccaggcagactatatttttaggactctgctggggcctattgaaacgtccacattactcagatcaccaatctggctggagctacca

SEQ ID NO: 200411 - DNA, 349 bp, Homo sapiens
agtctagccacacaggcctccttgctgttcctcacatacaacagactctgccaccagatgacagggctaactctttccaagtctttgctaaaatgtcattttctccaaagacctactatgactatcctatttaaaactgaaaccaaacctgtcctctttccctgctctttatttttccataccgactatcagcttctaacatataaatattttattatgttttaaataagtaaataaatcctaatttattatgttttagcatctatctcccctgattggagtaagcttcccaatggcagggactgttctgttttgatcattagtgtatctcaagctccaagaatagtgc

SEQ ID NO: 200412 - DNA, 383 bp, Homo sapiens
ttgtatatgtacttatgtatgaagtacagttttaaattttgacacatatttatgttgtataataatctaattagagtagttactgtatccatcacctcatgcatgtatcatttctttgtggtaaaaacatttaaaaacccctcttctaactattttgtaataaagaatattttactgttaaccatagttaccctactgtgcaaaagattatgagaaattattccttctatctaattgtaactctgtacccactgaccaacgtctccccatccttacgtctccactcccgtctccagtatctggtaatcactgttctactctctacttctatgatatatatttagatcccacgtgcgtgaaatcatgcaggatttgtctttctg

SEQ ID NO: 200413 - DNA, 854 bp, Homo sapiens
tctgcacactggtcactggggcccaagtttaggaggggcccaagtttaggaagggcccgtggaggcctccgtgggccagggttgctccctggctctgagcaggtgccgtgtcctccagacactccagaccccaggttcccaggacagtgagtgagtcccagctctgatcgcaggtccaggctccctctggtggttcccagccggcagccggcctgtttgatggtgttcttcccagcatggcaacagccaggaattagcactgaatgtagagttccagccacaccaagagctgccagatagacacagagcagctttttgaagcacctggcttaggactgtctacatgggaccatgggccacagcccccgacaaagcctgccagggaaattggtgctcacccagtgcccctacatattggatcctagcctagcctgcatcacagacttcaggggcccctcctgcactacagaaaaccagccatacctcccctgtaaacttgagtgagccattgaggggatatcagctctgtgttcctggcagggtttcatctcagaacagagcagccagggaacagcccttcggagctgctcacccagagcccactggtctggatccctcccgctgggctccctcctttttattagaacagtaaagtctgcaacagaacaccacctcacctttccccacactagctcaggaacagacagaatggactaaaaatagttgagctaggtttccaagtccaggatgcacaactcaggccgagcttgggccaaggagctggacgacaagttgcccgctgtcccccgaggcaggaggcatgagcccttctggagaaggaaggcagacgttgc

SEQ ID NO: 200414 - DNA, 653 bp, Homo sapiens
acgcctggccaagaatgttgaatttgatcagatgtttttaggtaaacattgagatctccataatgtaccattctgattcacttggtccagctcagctccctgcctaggtaatacttactatttcctttaagtcctcgcatctcgcctttataaaaagattcttccattcagtctcatttctctcgtctttgaattaaatttcatagacttcagtagcttttattttgctcctcagataggtttacaagatcctaggaggcaagggaccatatataacttaaccttcttttatattccttggtataaaactggaaataacaagcactcatcccttcttcctctttccttttttctttacatgttttatagtgaaattttgctttacattttaaaaatataaatgtttcaaactattcaatacatgacagttgtattgtgtatctttcctattgtacaacctgactttgccttatgagtttttgaaataatgcaaaatatttttataggaatatatcctgagtggatctcacagttgtaaattatgctgaacaactaaggcaaaatctcctcctctctggaaacgtagctgacctctggcctgtagcaggccatgcagtttttttctaagtgtcagtcaataatatagtaacttt

SEQ ID NO: 200415 - DNA, 297 bp, Homo sapiens
ttcgtatttttagtagaggcagggtttcaccatgttggccgggctggtctcgaactcccggcctcaagtgacctacctgccttggcctcccaaagtgctgggattagaggtgtgagccactgcacccggcctccagtcacacttctaagggtttgcttttagttctcctggtggttgcctccagaattttaaatacaacaattgtatgttgtttctcgatttattaactttgaaactaccaggttcctgttataacagacaaggaatgacttctttacactaagcactgcctctcct

SEQ ID NO: 200416 - DNA, 451 bp, Homo sapiens
tactacaagcagcatgtgagaaagtcattgcacaaagattctctatatctaaggaactcatacagagtctttgacatggaaagcacccagagccaaagctagtcaatcataaactatacacattatagtcacaacctcaaagctccatcaaaataaatttttaaataataagaagaaatatccccagatgagaaagaaccagaaaaatgattctggcaatataaaacaaacaaacaaacaaacagttttataacacccccaaaagatcaccctaactctccagcaaaggatccaaatcaaatgaaatctttggaataccagataaagaattcaaaaaattgattgcaaagtttctcagtgcaatccaagagaaagttggaaaccaacataaaaaatcaaaaaatacaattcaggatataaatgaaaaattatctaaaaacaaatatttctt

SEQ ID NO: 200417 - DNA, 444 bp, Homo sapiens
aacctacgtagtgaaaagtcatgacataatcgtaaacaaaaaacacagtatacagaacgtgtttgctgtacttttcctaatgtgtgtgtttctttccggtgttttacatacgtcatactgaaggaaatcagactaaaacactaatagccattttggaggcattaagtgatttacaaaaataccttcttctcatttttaaagctatgttttataaatttaaacattaaatatttttcctaataatttctgaaattaatactgtgatccaaactctattggtgccttcctttcaaatactttttagtcttaagttgccaggacttcaaaagtggcagacagggagtcactcctgctatttaacacatcagcagacactaggcatcgtttccaccttacatgaatgatgaaaagctcaaagtggctgttttcctcatttccctaaat

SEQ ID NO: 200418 - DNA, 293 bp, Homo sapiens
ggggagcgggcctcgcgcgcctggagggccctgtggaacgaagagaggcacacagcatggcagaaaaccgagagccccgcggtgctgtggaggctgaactggatccagtggaatacacccttaggaaaaggcttcccagccgcctgccccggagacccaatgacatttatgtcaacatgaagacggactaatcacatttcaagtacttaataacccatctggccaagtaatgtctcctgttctgaacagcacagctctagccacagcagctaagtgcctgaggtattgagtag

SEQ ID NO: 200419 - DNA, 321 bp, Homo sapiens
gagagaatgtgtttagaaagtgtgacatctcagtatggagtattaaatagtgtagtagggattggctttaatgtgtgtgttttggtgtgtgtgtgtgtgtgtgtgtgtatgtgtgagtgcatttgacttatgagccctgaatataatgtgccagaagttttatttgaaaaacataaccaatttgtaattgaaacaggattagtcaagaaccatcagcaccaacacaaatgtatctttgcagaccgaaggaatcagctaaacaatttacagtcatctcaatctctactaaaacaaaaatcacatccaacacaccacctgaca

SEQ ID NO: 200420 - DNA, 403 bp, Homo sapiens
aaatttccaaaggaacctacatatagagggaaaagattagacaactacttagtgaactaaaacaatatgtttttactaaatgttacatttagtattggaaaaagataatgccgcctaagagttaataatcatttttccttttgtaggcatcaacactaggagaaaatggcatgctatttacttgctactttcctttacagatgatttttggctcttctgggatttaaaaagaaagttcaccaatttgtgctctaagttgccttcattctgggtctcaggctgacaaagcagataccatcaggagtgtgggtgctaactttgggaaatgaaaaaagagtatggcaaatcacttaaggactcttaaaggactttcattggccaaagcaaatcacatagccacatt

SEQ ID NO: 200421 - DNA, 245 bp, Homo sapiens
cttgccatgcaccctgagccctgcaccctcgagctggatgggatgggctgcagaggcaggaagggggctgcagaggctggaagggggtacgcaggctggaagggggctgcagagactggaagggggcaacagaggcaggaagggggctgcaggctcaggagccaggcagagggagcaggtgggaacaagagcatgggcagggaggcttcctggagacaggggcaccctggcagcccaggtcagca

SEQ ID NO: 200422 - DNA, 457 bp, Homo sapiens
ccccctctctactgaaaatacaaattagctaggtgtggtggcaggtgcctgtaatcccaggtacttgggaggctgaagcaggagaatcactcgaacccaggaggcggaggttgcagtgagctgaggttgcgccattgcactccagacttagtgatagagcaagactccatctcaaaaaaacaaaacaaaacaaaacaaaaagacaaaattacaaacacaaaattcagtataaaaaagatttatttagaatgaaaaagaaatcccaataaattacaaatttttaaagagtcaacagatttatcagacataaaaaatccagaaatataagataatatttttattaattaactaccagacatgtcttgtatccttttttcctttatatttcttgactgcttactcttcagttatttcttcatttaacagcaattttgcagtattttcttatttatttgtt

SEQ ID NO: 200423 - DNA, 562 bp, Homo sapiens
tggttaagagagccagtgtatcgctaggcttggtgaccactagtatccaagcgtgacaagattgacgacgtatggaatttactgaaacatccacagtatcgactgtaccaattcccagtccagaacaaggagagcactgatgaggtgctgtggaagttcttgcagtcagaagttaccccaagtcactcatcagacatagcatctatggggaaggggttaagtccagtcttacttaaagctggcactgtgtgggcctacaaattctggtctcccaccccatccctgactcacccacagcatctggacaccacaggggctggtcagagctcagtcttggcccacagggtcaaagccttggtattaagaagtgggtctctggcctcaatccctcacccacccagcctgccctcaatcctagcacaggtggaaggttaaatagtgcccagagggggatgaaaactctcattcctcatcctcttacccccgtctgccctcagaagagccactttttccctaaaagactcagagaatcccattcctgatactctgaaaagctccccga

SEQ ID NO: 200424 - DNA, 464 bp, Homo sapiens
gttgtgtagttaatttctgatcccaaatgaaagatttcacatttatctgtatcatgtttcatactttgtcccatcactctagtctatagaaaaattttagaattgttattcttttattcaattacctactcctctcacttttgataaggttaccttctattcactcaaccaaatcattgataaagatgttgagctgaacagaggaaaaagaaaccaacaacatgtcagtttatcaatccaagagtttacctttgggatgattgttctaacaactgtgggtctcctctaccatactcttacccaatgtacactccgcatcctgtctgccttgatcaggtaccatgctgaagaccacactgcaccttggcattctgctaagccaatatttgatggtctcatccccaaaggatgtaagattaaagagccaaaactggtcctggaaatatctgttctttaaaatgctc

SEQ ID NO: 200425 - DNA, 235 bp, Homo sapiens
tagaggatctcctagtcttctcccatcagtatttctgctgttttcacctctttagctctgagtctaggctatatgacacaaaaggaaaacccaggaactcaccagtatgtcattcatcaggatctgaggtccctaaagagtctgctgccttctctctgcatttcagagtcgtcattgaaacttaaaaaatatatgtccagggttttaaaactgtacctgatgggacgaagacgcg

SEQ ID NO: 200426 - DNA, 479 bp, Homo sapiens
ccagctgtgcctcccttcccatgaatttcttatacaggtaaataatatatcttcattacttgataaagagacttccagtgtcagctctgacatgtgaagagcttaggagacagcattcccatcctcagaataagaaaaagatagaaaaacaaagtcagtttttttttttactttccttgaaattccagaggactacaattttgaggggccctcacttccatgagcattatctccaggaacaccaccaggttttcatgctgaagatcccagaaagatgctcttagagctcttgcaggagtaaggaaagagtagtcatagtaaaatttaaccagagctttctccataacaaagacctactacctatgggaaaagactttgccagagccttactcagtagatgaaagaacattcattcaattcatagcctcctccagctttcctgcctcacctaatagagagggaacaaaacaacaacaact

SEQ ID NO: 200427 - DNA, 1274 bp, Homo sapiens
agaatcctgaacataatcctgcatacttaatcgcagcttatcacaggttctaccaatagtcactctctctattgaacctaacacgagagagccccatgccctgagagcccctgccaagagtaacatttggaagctgagtcaggaagaagctgagatcaggtgaggttaagtatccaggatctctggtctccaggatctgccaaaaccaggatgtggagcatcagcaactgtcatagttgttgatgggagtgtaagtggtacaactagcaaaggtggggatgtcattcttgtcgacccaacagttgcactcctgggtagagaagctcttgaacatgagcatcagaagtgagactcatgaatattcaaatcagcacaattggtagtggcagagatctaaatgtctatcagcaggaaagggaatgaatggtgttttcatcatttcatcatttcatggcagtgaaaatgaatgaactacaattatcaatagggatgaatttacaaccttaacattgaaggggaaaaagcaaaatgcatgcacttaagtaaggtttacaaaaagatccaaaactgaatgatgtattaggaattcataaatacgtagtaacattatgaagagaaccaagagaataacaaacacaaaattgaggattgtatttacctttgtggagaggaaggggttgtgattggggagggacgcataagggcttcaaaagtatgtgccatatcctagttcttaaaatgagtggttggcagatgggtgttcactttacgattctttatacgtacattaaaaacgtatgcgtgtcctggttacttcctccagggacattccaccaggcagggcttagcacaactgggaattccctggtcaaagtcagggaatttcaagatttttcagccagtggttgggcaaggggtcatctctctcgtcccctccctcgaggttctgaggagcctcagaacagacgttcaacctctggaatcccccagaaaaaagactcatagggcagcttcccctttctcggacaggacagagtggagatccagggggatccccagccccaaccagctggctcgaggtcacatcctgatatttcagttctgttcccattcatgtgtctcagctgagcaactgccatgcttgtggcactcttaggggaagggaagaaatgaatgaggtgataagacccacgccctaaagaatccagggcagtaagctccctggctttcggtttttacaaactaataatattgtgtaatataaatactgacat

SEQ ID NO: 200428 - DNA, 765 bp, Homo sapiens
actgcgtggtatgctgattccttttagtcattaaatataatttatatgatgatgaatgccaattttatatctcaaaccaagacctctccccttagtacccaattcattttccacctgcttatttgacatctccactaggatgtctgtaggcatttcaaacttaataaatctaaaacctgatcttctcccttaaatttgcttaacctatattcttccccatctttccatgtgtccagtagccagaattcttggaggcatccttaaattctcagtttctctcatacccacatcagtgtgtgtgtgtcagtacatcctattaatatatctccaaaatatatcccaaactcagacctctgcagcatcactgtagtccagactttcctcataatttgtttgtatcattacagtggcctcctaactggtctcattctttcttcccttgctcttccacaggttcttctcaaaatagcagtttgctttagcagtccagttaaagtaaattagatcctgtagctcctctgcttggaatctttccatagcttctcatcttgtccaaagtaaatggccagttctataaaatgactctaaggccttatattataatctctcatgcttcctactgcctctgttacccatctgagtggcctcccaagttctaaccccctcctcatgccacttcaagtatactggactcctaattgtttcaaacaggccaggtatactcttgcctttccctttatgttttgtttccagtattctaaccca

SEQ ID NO: 200429 - DNA, 353 bp, Homo sapiens
cagaacctcaggaacatgttggactataacaaaagacctagcattcatgtcttcagagttccagaaggagagaagaaagagagagggctaaaaaatattcaaagaatggcagaaaatttaccaaatttggcaaaagatataaacctacaaatttaagaagccaaattgaggagcatggttaagggtgggagtactcccattgggaagaagggaattacatgaaaatttgctggtactgaatgttgggatcctctatcttctaccttccaactctgcttctagaacacaggcagctaaggcatatcactccaggaatgagatttgaaatatttttgtatgatcatatgctaaaa

SEQ ID NO: 200430 - DNA, 154 bp, Homo sapiens
acagaacatcagcccctgaatgcaaacattgtactgcgattcaattgcatcgaccagctttacatctaaggcctgtgagcttcacccaccttggggactgtcttaggagaaggaaagtcttgttacaaagtagcattaatcaagtgggcttaga

SEQ ID NO: 200431 - DNA, 732 bp, Homo sapiens
cagaaccagcccatctttcaccatgtcacaaatggagcacagttctcttgtatctgctggagtctgaacttccctgcctaactctcgagccttgctctgatgactcctgtggaccacttttaccaagaggaatattcagctcatgtctgacttatcacctgatttctcgcccatgtatcattcctttttatatccttcatgacgtttttacctctgagtgaaaggcccatttctcctttgctgtaaatcctccccatcacctgcacctcccctcctctggaaatccttcctgtattcatggaggcaatatgtaaatatcagggactatggtatcagggagaccaaggttctagtcctggctctgacacatttacttatttttgactctgtcatttaactcctctgggcctcaaatgcctctaagattcctgtcagttttaaattgatgttaaccaataaaaagtacctagtaggtactcattaaacatgaattattttgattactacagcctcactactcacttttgttagactttttggttccaaggaagaaagtgaatcaacgggctgatgcaaatgaggggttatttaaggataaacatgcacaggaagtgttgaacaaactggcatcaggaagaccaggaattatggtcaattttggtctcagaaagcataaaactttgtagcaaagctgagccttggggttttcaataaatattttgccctgtgact

SEQ ID NO: 200432 - DNA, 434 bp, Homo sapiens
aaaagccaggttggccacactggagagtccacatcctatctaacacaatgtccggctcttgcaaagacaagaaagggcgttccataaaagatgaatgagtccttctcaacatcaactttgtagctgagttttccacctggcccccaattatccagataacttattaaaagaaaacttgtcatccatgagtttctctacaccaagggaagatggttccgtttcccagtctccaccatcgtagggataatgagctccataagcctatccctgttgtatgaggagaaggagagggtactcgacccagagctcttccaggaatccttacactggctgcattctcagtctgggaaggccaattgtgttcaatccattgccctgactagtgcttcctcagccctgccaccacgattcaccaattccttctttgtccctgc

SEQ ID NO: 200433 - DNA, 513 bp, Homo sapiens
gtcaattaaatcttatttaataacagatctacaggttgctagtacatccctgacaacccgtatatgaaaagtcattagttgtgattttagagacaaaattagaagcaaaagataatttgtgaaggaactttaaaaattacctaaatgtataaacactagctgcttgttaaataattcaaaaatatcacactaccagaagctagtgtgacatgtatggtacatgcttgaataagaatacaagccaggggatttgtttttcctgatctacagcaagaggggttgtgattgttgtgtgacccaccataattgttgatctggagggtggcttatctaatctgcatttagatgaacaagttcatatgctggctacacaaaatcaaagcccacacaagacactttgtagtttcccaatttgctcacccatcatcattaaggtacacataggataaaatgatagccacaaatgtttctgcgtgattgtcacatcagtattccttcagatttaactttaag

SEQ ID NO: 200434 - DNA, 385 bp, Homo sapiens
gaaatttatagtaaacacacagggcagatatgctgaactattaaaatggaaaggcaaaagtcaattaatacacaggaaggggaaggggacttgatattcagaaagataagctgaacaaagggctagttcttgagcttcctagcaggagatggccacctggtggattgtacctctctcatcttttactcgatcgtatggagggaggcaaactttgccctgttcctaagtgcagaaagaaacttttcctgtgggaacccagaagtttaggaaaacacagaggcctttgtgagacaggttcttctactggctccctataaaacagacacagtgttaaatttagtcacataaagacaattataacatgaagggagaaggaatgaatggg

SEQ ID NO: 200435 - DNA, 220 bp, Homo sapiens
catcacatggtgggtttctggcagaagaccctaaatgatccatttaaaaggagacagagagatgggtggaggccagggaaagctggtaaggggagtccaaacaaagaagaaatcagaggcctggtggagccgctggagtacagactcaggagccaggagactggtcagctgatttttatctgggtggctttggaaagctgcttgacctatctgtgcctca

SEQ ID NO: 200436 - DNA, 473 bp, Homo sapiens
aattcactttacaacataggaaaaacgtttgtaaaaatggacagagaagaggattctgggtagatggcagagtaggaagcatcaggaatccatcttcccacctagacaacaattgcactggcagaatctgtctgatgtaactgttttgtaacactggagtctattgaaggcatgaaacttccaggggaagtcttggacagtaaattgtgcttaatttcagtcaattttagctgttaacatgaaagcagctactctgaccacagccccctgtcaggcggctgtatgggtgttcctgcagcaacctgcacacagcttgtgagagccagggtggacaaaaaggaccctatagtgaatacagagtatctgagctctgatcactgattattgcttctaatcaaagaaatacagacacaaaagcaggtggccattgttgttgcacctctcctgttgttgcaagactctccccctccagc

SEQ ID NO: 200437 - DNA, 370 bp, Homo sapiens
caccctgatagcactccgcagtcatttccacctgcccctcttcctgcctgcttccagaggggctgcctgatggctttgagttcctgctatgtcctcttaaacaaacatcaagagagccaggaacacacagctcagcccggggaacattcttccttaggacgtgcaagagaaggtacaggctccagcagctcttcctccaccctcacaaagagctcccagtaggggacgagagctctaaggttggttaagctgggaggatcaaggcaagaagccctgtgctcccaaccacccaacccattctactctgccctggctgggaggaaaaatgcctggagaaacgaagctggcccccgtgccatggtggctgtct

SEQ ID NO: 200438 - DNA, 240 bp, Homo sapiens
ttttgctaaaaaattagaacatgccctagagtaggaaaatacaataaagtaaaaatatcggttttccttaatcagtgtattcaatgaagtcccaattaaaatgcaaacagaattttttaaaattgaagtttgcctaaaaatatgaaaatactcaggaacattctggaaaagaagtgtgatagaggagtattagtcctgattctcatttgcagtcaaacaatccatgacattccaacacat

SEQ ID NO: 200439 - DNA, 520 bp, Homo sapiens
tggcataaatactttatgtggaaatattacatactccatcaattcaggaggcacaaaatgtcaggctgtttcactcttagtaatgccgtaaactcagctgggtgcggtggctcagagcaatgaagggttttaagctggagagagaaacggtcagattggtggtttagacagccactctggctggtaaagatctgtggggacaaaagagaggcagtggagactgagcagtaggtttttcagtgttcagatgaagagagctcaagccaggcagtgggagtggaccgagagagacagatccagaaatatcaagaccagcctggataatatggtgaaaccctgtctgtacaaaacagtgtaaaacttagctgggtgtggtgatgagcacttgtagttgcagctacctgggaggctgagatgggaggattgcttaagcctgcgagcagaaggtacagtgagctgagatcatgctgatgcaatccagaccgggtgacagagtaagaccctgtctcaaagaaaaaaa

SEQ ID NO: 200440 - DNA, 447 bp, Homo sapiens
tggcataaatactttatgtggaaatattacatactccatcaattcaggaggcacaaaatgtcaggctgtttcactcttagtaatgccgtaaactcagctgggtgcggtggctcagagcaatgaagggttttaagctggagagagaaacggtcagattggtggtttagacagccactctggctggtaaagatctgtggggacaaaagagaggcagtggagactgagcagtaggtttttcagtgttcagatgaagagactatgagcacgaggaatggaagagagaccaagaggaggagttggagtcaagaaaatgtaggctataaaactggtatgacttggtcatggaacaagaggtggggagtagaacctgtcctttttctcatctttcatttttggacgtgtcctttctaagagaaggctctctgccgcctgtcaggctagtcgggg

SEQ ID NO: 200441 - DNA, 324 bp, Homo sapiens
gtcatggaaaacaaaaatcaatgacacctgccagagaccccactgcctgctgtggggagacagacaaaccaatacaaaatcatgatgcaatggcccaatgcttcaccatggtgaaaggcacctagcccagttttgagggtcgggaaggttgcctagaggaggtgatatgtaagctgagatctaaagggtgaggaggaattcacttgttgaagataggaggagtacaattgaaaatgaggcccagaggttggggagatcctggctgttcagagagctaaagacacctcattggtggcaggagcagagggtgggggtggggtgggg

SEQ ID NO: 200442 - DNA, 857 bp, Homo sapiens
gagggagggagggggaaggagagaggggggaggggaggcggggaggggggtgaaggagggcagctgggctggtgttcttgcctgtagtcttatggaagaggtgaggtcctctggtgagatggcagtactgggatgggggatgaaaattccaagttttggcaagttgcagaataggaagtgagtgaagtactcaaaatttagggtgcaaaattttagggggtaccaaagacctcagtaatcgagacaaataattgtttaaaattcaaaattaggctgggcacagtgactcacgcctgtaatgccagcactttgggaggctggggcagatcacgaggtcaagagatcgagactatcctggccggcatggtgaagcctcgtctctactgaaaatgcggggattggctgggcgtggtggcgggcgcctgtggtcccggctactcgggaggctgaggcgggagagttgcttgagcccgggaggtggaggttgcagtgagctgaaattgcgccactgcactccgacctggcgacagagtgaaactgcgtctcgaaaagaaaaaaaaattcaaaattaatgcagaaaaattccatgatggacaaaatgtcaaaattttaacccaaaccaagattagtaacagtgctgtgctgagccatatcggagcctcatgtggggaaaaaaaataatgattccatcacctgagtcctgaccctcaggctcctgctgttgctcctgacaatctgcaggtggcgcctgattctggaaaataatctcccgctgggtccgttttccaggtctgtggaatttaagtagattctcttctggctggacagtcattctgtgatagacgatcattctgaaa

SEQ ID NO: 200443 - DNA, 205 bp, Homo sapiens
tctcctggtggtgcccctgagcagcaacctgatttctgtcctcagctatctggccaatgacatggaggaggacgacgaggcccccaaacaaaacatcttctacttcctgtacgaggagacccgctctcatatacccttgctcagtgagctttggttccagttatgccgttacatgaacccgagggtctatgaagaactgctctca

SEQ ID NO: 200444 - DNA, 266 bp, Homo sapiens
ggaggcagaggaaggaaacaagttttattttaaaagagggttatgatgcaaatcaaaaaactaagaaacagttttgtttgtttgtttgtttgtttttgagacggagtttcactgttgttgcccaggctggagtgcaatggtataatctcagctcactgcaacctccgtctcccaggctcaagcgattctcctgcctcagcctcccaggcagggattacaggtgcgcaccaccatgtccagctaatttttattttagtagagacggg

SEQ ID NO: 200445 - DNA, 444 bp, Homo sapiens
ctaatctgtgtttttctttggcctactgttaccagggaggttttttttgttgttgtttgtttgtttcttcttttcttgttttgtttttttccttcaggtgatttcttattgctcattaacatcttttttatttctgattgaagaactccctttagcattacctgtctggttttgatgaaatcactcaccttttgcttgtctgggaaggcctttatttctccttcatgcttaaaggatattttcactggatatactatcctagggtacaagttttttctttcagcactttaaatatgtcatgccattctctcctggcctgtaaagttcccactgaaaactgttgtcagatacattggagctttatgtcatttgggttttttgttttgtttcggtttggttttttccctctggctgcttttaggatcccttctttatccttgacct

SEQ ID NO: 200446 - DNA, 502 bp, Homo sapiens
aaaaaattgtagccctttacgtctgtttaatcatagttagtaaaattatatccactcgacatattattttgaatcattaatatgctcagcatctctagctaaggcaaatcagaagagaaaaagagaacgttgggtgagaatctggtttgtcattccccatgtatggtggttgaaagatagccacaagttctttgataactccccaattcaaagattgggtccaattccccttaccttgtatttggactagccttaaagacttatgtgaacaacaacaacaaaaatgcagccaaagtaacgttctggaacttccaagaatatttcacaataattattacagcttttgcccaggactcttagaatattttctttgggatccctgatccatcaggaaaaaaatctgactacctgagaccactgtgataaagtgtgcacatgaagtgctcttgttgacagtccctgctgtgcctaggctactagccatacccaccaaagtgacaga

SEQ ID NO: 200447 - DNA, 450 bp, Homo sapiens
cctcccaaagtgctgagattacaggcatgtgccactgtgcttgactttttttcatattattagcatagtacctggtgcttattaaatattgattgataatatcaaaggtgttaaattatgacatattaattgattttcatgacactcttaaaagttatattcctattttatagattgggaaacaggctaagagaataagagaaggtcagtaacttgcttaagtcacatgaaagtagagccaagagtaaaagctacgtcttcctagtcccaaatcctacagtttttgcaccagagcacactccatttcacatctgagttgtttgtcagaaggggaactatgtaacagtttgttgatagattgagtttgtttaggactggtgttgggtctgcagaaagtctatattggccagatcagatattctatactagtttctagcattctcactttca

SEQ ID NO: 200448 - DNA, 239 bp, Homo sapiens
gtttctttattcattttaatgctattttaaggtaattagtagaaaatgtttgagatgttgacctaaaaaatttggtataattatcctaatgtgttttaggtgggaataaagtttatattactcagttggcaaaatttttaaagtaccttcatttttgattattgaataactttcagttgtaactcttgttaaaacagtactaagataaaaatccttactaataaaatttccaaattaca

SEQ ID NO: 200449 - DNA, 637 bp, Homo sapiens
tgtttcatggttgtgatgttattgtaagtggtattttttatttctatttccaacttttcactactattacataggcacaaaaatgattttttcttttttcttattgacttcattttaagatatttaccttgttttccacaaaattgatttttgatattgcctttgtatcctgcaagcttgctatgcttgcttagtagttctagttatatattttgtaggttcctcaggattttctaaacaagcctagtcatcgtgtacgtgtctaaaaacagttttccttttcctttccattctctatgcctttcccctattattggctgggatcagtcctctggtacaatgctgaagagatgatgagatagatatccttgcctttttctcaggggaagcattcattcttttgccattaagtatgatggtagctgcaggcttttcagaggtgcccttccttgggttaaggaaattcccttctatccttagtttgctatgagtttgtttgtttgagatggaatttcactcttcttgcccaggctggagagcaatgttgtgatctcggctcactgcaacctccacctcccaggttcaagtgattctcctgcctcagcctctggagtagctggaattacaggcgctcacc

SEQ ID NO: 200450 - DNA, 707 bp, Homo sapiens
gaggacagcagcatagcacctgtctactgggcactgatgggtgccacaggagggctttgcacaccgattcatgtgtcctcacaggaaccctattgggtcatgtcattacttttctctttttattttattttatgtatatatgtatgtatgtgtatatatacgtttgagacagggtcttgctctgtcaccgaggctggaccccagtggcatgatcacagctcacttagcctcaacttcccaggctcaagtgatcctcctgtctcagcctcctgagtagctgggactacaggcatgcatcaccacacccagctaatttttgtactttttgtagagatagagtttcactatgttgcccaggctggttatcaaactcctaggctcctatatttttttctgaatttagaatcctaggttaacagtttttttctttcagcattttacaaatgtttcacttacagttttttctttttttgtaatttttaaggggccatgctaatattctctgtattgttctaattttagtatatgcgttgcagtgagccaacatcacgccactgcactccagcctgggtgacagagtgagaccctgtctcaaaaaaaaaaaaaaaaagtattagggttgaatgcagtggctcacgcctgtaatcccagcactttgggaggctgaggcaggaggcttctatcgcaacgactcagctctgatgtaa

SEQ ID NO: 200451 - DNA, 513 bp, Homo sapiens
agatggaatctgtggcatccccttgtaatatggaggtggatgaaaagtttccttcaaaaatgtcactttgcagagtgggctgtcttgaaatcagcccagaatttctctttaaggaaaactatgggggagatttgctgtctgtggtcagtggcatcacgggctattgataattaagaattaacttgagcaattgctgtggttaaacacaagaaacgtgcctgtctgccttccttcctttcccttcccttcccttccctttcttcccttcttctccttctttccttctcaaatatttaggttaaatatgatttaggagcataattctatatatttaaaaacatattaaattttccaaatattggtgtgactagaatattaatttctatcaaatgaggaaagtgctacagagaaaaattatatctctagtgtcattcaaaggagagtaatcttggaggcttaaatcttatttttaactggaatgcattcttattaaatagtagcaattataatata

SEQ ID NO: 200452 - DNA, 385 bp, Homo sapiens
aagcttccatccgcttaataccaaggtgatcaagtctgtgtgctaaatacaggaaaagccttaataggagaccctgctaccaatttgtaggaaataggacaaaaaaaaaacaaaccacaacactttgaacttccactgttgagtatgcaaacagcaaaatccagactatagggaagtcaacaagtcacaaggcccaagtttttcaacagataaagtagaagcaaaaaactgtaagaaaggaatgaagagagaacctacagattaagaaacttaaacgacttaccagtatagccacatgataaataccattaaaagaaaaaggaatgaactttcggctgggcgcggtggctcacgcctgtaatcccagcacttcgggaggctgagg

SEQ ID NO: 200453 - DNA, 624 bp, Homo sapiens
ttggccatccttggtgactctgaaatccgtctaggaagttattcaactgctagcatcattgttcttcccagtagctcctgagggccctgggatactgtgcttgcctataggcaaggcagctggtaggagaggcccttttgtggaatgcagttactctcttgttagttcccactttttctcttttcatctccttttcttcccatctgctcctcttgtgtgaacagatgtgagtttcctccttgactttccaggccatgagttggaacacgttgttcttaggtgatcattttagagatgaaagtgtagtgtacaggggtgatggagccaagctatgagttcttcatcactctcttacctgctcatcagcagctccatctccctgtctgcagcctcagctgaaacctccgcacctggatacccccaaacatctgcctggtacaggaatgaggatggaaaatgcttggggatatccagaatggggaggtcaactgagtctgaagacagagagctggacctgttgagatgcagataagagagtgaagaattgatcagggagtgtggagagaacctgtgatggtgtctgctccttattgggcgaaaggctgtgccagcgtgaagaatggg

SEQ ID NO: 200454 - DNA, 257 bp, Homo sapiens
aaataaaataaaataaaataaataaataaataaattgcagggtcaaggctggtaccagggaccagttaggaggctaagaataggtggttcccactgaaataagaaggagaggttgagacatcccaggcagagaaaatagcctctgcaaaggcacctttgtgctttgcaggtgcaccagggatgaagtggccaaaagacaagatcagaaggcaagccgagcccatggcaggtgctgagcagggagtggcatgatcaga

SEQ ID NO: 200455 - DNA, 817 bp, Homo sapiens
gttgcaagtgctcagccccccttggcctcccaagtgctgggattacagatgtgagccactgcgccaggtgagccttcagggattcttaaccgttttgtgccattgatcaacttggcagtcttgtgaagtctagggattccctttttagaataatactttttaatttatatataaaaaaatacataacattataaagaaaatgaattattatgaaatataattatctacaactcttcactcttacttctcatgaccgcccccaagaaagacctgacttgaccaaaattggcacctaccatgcttcccccaggacctggccccaggcatttggaaggtaatagattggtagtccaggattgtaatattgggctgtctctgtttaagctaaaaattaaggtaaactattaggtcccatctggacagccccattgttaagttttatataacctttcataatcggcctcaatgacagatatgtccagcaaatatccaaattggttttaaagtcagttgcaccatcatttactgatatttaaagtagatcattataatttagtaagtaccactggtggctagctctgggaggagggctgccatgtgacagagtaggtaagattttccaacccaggacacctggtaggtgctattagcagcgataccagtgtcttcctgagcatgccctaggggtggcagaagggattgcctgtgctcccctatgttttgccagagtttctattggcttttgtgggagatgaacacaatccatagagaaaataggccccagtgggacaggtggagcatcacatgagcacagggg

SEQ ID NO: 200456 - DNA, 614 bp, Homo sapiens
agctaatttttgcatttttagtagagatggggcttcgccatgttggccgggctggtctcgaattcctgacttcaggtgatctgcctgcttcggcctcccaaagtgttgggattacaggcgtgagccaccgtgcccggccatattatcttttatcctacttaatttctttgagcttatgtccagcctacatgtataaaatatacagtgtagaaaacactccagctcatcttatatttcattgaaagcaatgtcttaatgataaagtacttcacaatattatcttttagcctacataaaacctatcagggtttaactaaagtggaagagcaaatagatgactgttccttctataaagagacctaagaaataaattaattacatttgtttttctacagtggttctgaatcaacgcccctaacaattcaggatctaacactgaactcaatccatgcttgaacaaaataaaagtcaggcttgtaaaaaaaaacaaggtgaatgaagtaaagaactggctacaaatatgaaaagtacttcctctacactgttacccacatgtaaataaatataatgggctccccccagcgccattcaatgagtgaacagcaaggtatatt

SEQ ID NO: 200457 - DNA, 422 bp, Homo sapiens
tcagcctcccaagtagctggaactataggcgcctgccaccacacccagctaattttttatatttttagtagagatgaggtttcaccatgttagccaggatggtctcgatctcctgacctcgtgatccgcccacctcggcctcccaaagtactgggattacaagagtgagccaccatgcccggccgtaatttcatgtttttaagcctcaattttatcatctgtaaaatggggatcgtaataagatccaccccatgggattgtcgagggactgtagttcaaccaggtgatctcatgtcaagagctcagcccaatgcctgtcccaagttcggtgctccatggatgttctgtctggtgatgcggttgggaaacacggtggtggtaggaacctgggcaagcgggtgcatggagcttcccccagccag

SEQ ID NO: 200458 - DNA, 794 bp, Homo sapiens
ctccagcctgggtgacagagctagactctgtctcaaaaacataaaaagtaaataaatacaataaaaaatataaaagatgcttgtggaacaatctgactatagagtccttctggatattaatccatatttttctctaactctttaagtgctagctcagccacatgtaattgaatagtttttctcgtaattgcattatatcaaatctgtcaacctgagtgttacatagacaaatgtcgtgttatgcagtcatatttaatcacggatttatttaatatttaattaaattacttcgttaaaatagtaatttcaaccatcaggaattagagtgaaatggctaatttaaaaccatctggtcaaaaaatgggcaaaagatttgaatagacatttctcaaaagaagacatacagatagcaaacaggcatatgaaaaggtgctcaaaatcattgatcatcagagaaattcaaatcaaaactacaccgagatatcatctcaccccagttaaaatggcttatatccaaatgacagtcaataacaaatgctggaaaggaagtagagaaaaggggacccttgtacactgtttgtgggaatgtaaattagtacaaccaccatggagaactgtgtggaggttcctcaaaaaactaaaaattgcactaccatatgatccagcaatcccactattgggtatctattcaaaagaaaggaaatcagtgtatcaaagagatatctgcacacccatgtttgttgtagcactgtttacaatagctaagatttggtaaaaggtgaaagatttatgca

SEQ ID NO: 200459 - DNA, 313 bp, Homo sapiens
tgtacttatgccgtttatgtgtggtctcgtgttgccagaacaaactgcaaactctgaggacaaatactgttatatttttttccctagtaactcccccaagaacactgagcagataagccaagttgaaatacgctgggaaaatgaaaacacgttatgtattcgaactaatttaaattacaaagcaaaattacctatatagtcaattacattaaggcaaacaatcatctaatacattaataaatatctagtacacaaaaagcattctggaactggatccatgagttcaaactggctccaacactagtaactatgt

SEQ ID NO: 200460 - DNA, 240 bp, Homo sapiens
ctagcaagcagtgatctttttgtctttgccttttccagaatgccatataattggaatcgtacaatatgtagctttttcagattggcttctttcactgagtaatatattcttaacatccctccatgacttttcaaggcttatggcttaattcttctcagcactgaatgttccatcgtctgaatgtactatagttcatccattcatgcactaaaggacatcttgcttccgggtttcggcagt

SEQ ID NO: 200461 - DNA, 531 bp, Homo sapiens
tggatgcctagtgccagttacagaatgctcatgggaggtgtccctggcgtagttgagagcacccattatgggatggatgctgcaaaagacgggaaaatccttggggtggcaactggataaaggcagatatagtaagtgtagatgaggggaattggagcaacattcttacacatgggatgaattgcaatctggagatcttcagaggaggagccatttgaaaatgctgttgaggaagagtctggtcctgagaactgttgtggccttaatgtcgatgttgaagtttaggatatggatggtatcacactcatgtgaagagagaacagaagcagcagcaggagaaatccagggtttgggcagctctgctcctctgagacatcctcgctgataggtcctgacagattgggagccttacagggcagagctttgcagatggaccaagtgggtccatgggagagaagacttccagagaacatgtttgcagcattgaaagccctccctacatggagactacctttaacttgtgtgcaaaaa

SEQ ID NO: 200462 - DNA, 579 bp, Homo sapiens
gtggtgagacaaaaagagggatttatatgaaagggattgtataggaagaattaaaaagatctgctgactgagtcaatgtggagtagggaatcaaagacagaaacacatgacttacagaacccaaacatgtcaacctgcataacgacaagaccaaaaacccaaaaacatctgaagtcacaactggttcccaaattactgattcatcacagctttacatcatatgttcagagcatatttctcacacatacaaaatgtaagatttttgtagttaggtttgaatttactggaagccagtcatcaaaggtttattgaagagatgttcacaaaaattaaatcctccgaggacaagaagatattccaggccaatactaatcaaaagaaagctgggatagccatattactatcagacaaagtagatggtaaggcaaaaagcattattagtgatacattttaacctaccaagaagatataacaattataaactaataacaccaaataacatgcctcaaaatataaagtaaaaactgacaggtctacaggaagaaactgacaagactgacaacataggagattttcaca

SEQ ID NO: 200463 - DNA, 348 bp, Homo sapiens
aaagagtacttataatggctcttagtggctcatgaattgcaaacaacacaaagctatatcaggataatctgaagttaaacaatggggagcccactacagctgtcctgaggggaattccttgagttatgaaatcccagcaatgggccaggtacagtggctcacgcctgtaatcctgacactttgggaggccgaggtgggtggatcacttgaggccaggagttcaggaccagcctcgccaacatgatgaaaccacgtctctactaaaaatacagaaattagtcaggcatggtggtacatgcctgtaatcccagctacttgggaggttgaggcatgagaattgcttgaacc

SEQ ID NO: 200464 - DNA, 507 bp, Homo sapiens
ctgtctttgagaaatttaatgctggttatcacatttattttccagatgttttctgaaattaaactgtgttcagcccctgcactttttactccgatattctttgggaaaccataatgtgaagcagacatttctaaagagaagagcatttctccttgtggaattgtgttataattagtgatatcaaataacttatgaaaaacaatatgttataaaataaaaaataatgagaggtgatagacaatgaaatgtgataaacaactattatattctattatgtgacttagtgctttgtaaactccagagatcatttcaacagtaaaatatgtcctatatgctagggctcgaaggaaacaattatctgcaatattctgttgcagataatcaactgaacttacaggtcacttaacttaaaaaaatatgagtaacaagctaatttttatcttcttacctgtatgtccatatccctataattttatgtatatatatatatatgtacttaaaacagca

SEQ ID NO: 200465 - DNA, 273 bp, Homo sapiens
catatattaggagtatagcattctgttgagtgtgttgcagctgtaccaaacagtagaatgcatgtttattgcctttacagagcttacatgagtttcatgagatgcgacatcaatggcagatggggaccacaaagcagaatagctctggagtcagaccacctatgttaaaaatgttttttactgcttgcctgctgcataatctgttatataaccttgggaaagttacctaagctcacctagtctcagcacgggtgctggcgtaccgcagctcga

SEQ ID NO: 200466 - DNA, 2320 bp, Homo sapiens
gacttttttttaaaagagggtgggggtggggggtgattgctggtcgtttgttgtggctgttaaattttaaactgccatgcactcggcttccagtatgctgggagcggtgaagatggaagggcacgagccgtccgactggagcagctactatgcagagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggccggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccagccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacacccccaagacagcagtcttcttcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgtttaaaaacaggaaaaaaaataatgtaagggtctgttgtaaatgaccaagaaaaagaaaaaaaaagcattcccaatcttgacacggtgaaatccaggtctcgggtccgattaatttatggtttctgcgtgctttatttatggcttataaatgtgtattctggctgcaagggccagagttccacaaatctatattaaagtgttatacccggttttatcccttgaatcttttcttccagatttttcttttctttacttggcttacaaaatatacaggcttggaaattatttcaagaaggagggagggataccctgtctggttgcaggttgtattttattttggcccagggagtgttgctgttttcccaacattttattaataaaattttcagacataccaaaa

SEQ ID NO: 200467 - DNA, 2421 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (9)..(9): n is a, c, g, or t
  misc_feature (12)..(13): n is a, c, g, or t
ncngncggncgnngctagaggggctgcttgcgccaggcgccggccgccccactgcgggtccctggcggccggtgtctgaggagtcggagagccgaggcggccagaccgtgcgccccgcgcttctcccgaggccgttccgggtctgaactgtaacagggaggggcctcgcaggagcagcagcgggcgagttaaagtatgctgggagcggtgaagatggaagggcacgagccgtccgactggagcagctactatgcagagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggccggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccagccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacacccccaagacagcagtcttcttcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgtttaaaaacaggaaaaaaaataatgtaagggtctgttgtaaatgaccaagaaaaagaaaaaaaaagcattcccaatcttgacacggtgaaatccaggtctcgggtccgattaatttatggtttctgcgtgctttatttatggcttataaatgtgtattctggctgcaagggccagagttccacaaatctatattaaagtgttatacccggttttatcccttgaatcttttcttccagatttttcttttctttacttggcttacaaaatatacaggcttggaaattatttcaagaaggagggagggataccctgtctggttgcaggttgtattttattttggcccagggagtgttgctgttttcccaacattttattaataaaattttcagacataccaaaa

SEQ ID NO: 200468 - DNA, 1133 bp, Homo sapiens
  misc_feature (987)..(987): n is a, c, g, or t
  misc_feature (995)..(995): n is a, c, g, or t
  misc_feature (998)..(999): n is a, c, g, or t
  misc_feature (1002)..(1002): n is a, c, g, or t
  misc_feature (1005)..(1005): n is a, c, g, or t
  misc_feature (1017)..(1017): n is a, c, g, or t
  misc_feature (1030)..(1031): n is a, c, g, or t
  misc_feature (1036)..(1036): n is a, c, g, or t
  misc_feature (1038)..(1038): n is a, c, g, or t
  misc_feature (1052)..(1052): n is a, c, g, or t
gacttttttttaaaagagggtgggggtggggggtgattgctggtcgtttgttgtggctgttaaattttaaactgccatgcactcggcttccagtatgctgggagcggtgaagatggaagggcacgagccgtccgactggagcagctactatgcagagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggccggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagatcgnggacggtngcnnatnagngccccggcagancaggagggcggannaaggngnccgggggagcccangggccccggaaaagggggcacgaggcacacaggggcgaggaaggaaactcaccctaatttgggccccccgacatatctctg

SEQ ID NO: 200469 - DNA, 1023 bp, Homo sapiens
  misc_feature (877)..(877): n is a, c, g, or t
  misc_feature (885)..(885): n is a, c, g, or t
  misc_feature (888)..(889): n is a, c, g, or t
  misc_feature (892)..(892): n is a, c, g, or t
  misc_feature (895)..(895): n is a, c, g, or t
  misc_feature (907)..(907): n is a, c, g, or t
  misc_feature (920)..(921): n is a, c, g, or t
  misc_feature (926)..(926): n is a, c, g, or t
  misc_feature (928)..(928): n is a, c, g, or t
  misc_feature (942)..(942): n is a, c, g, or t
cccctggggtgtgaatcggcgagggactggagcagctactatgcgagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggccggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggagcccaggcctcacaggctcaactcggggaggccgccgggccggcctccgagatcgnggacggtngcnnatnagngccccggcagancaggagggcggannaaggngnccgggggagcccangggccccggaaaagggggcacgaggcacacaggggcgaggaaggaaactcaccctaatttgggccccccgacatatctctg

SEQ ID NO: 200470 - DNA, 277 bp, Homo sapiens
ctgggggcgtggtactggcctgtagtagtttgaagccagggttgccactgaacattctacagcacatgggacaatgaattgtccgtcgcaaatgtcattggtacctagggtgagaagctctcttgtcattaagtccagaacatgagcatttatttagcattagaagtaaatggcaccgcatttgcccagtatggattttgttccacttgggactttacttggatcctggcactgctctcgacctaacccgaccactgtgccagaaccacaaatatcg

SEQ ID NO: 200471 - DNA, 205 bp, Homo sapiens
agtaaaatcacaggacttgatgaaaaattgtgagtatgtactaaaaggaaggggaacattaagattgtgtctagatttcaggcataagtagataatgatatcaagcgatatagacagttttagagtagaagacagtttagttttagggatgttgggtacaagtctttggaccccaaaaaatgtacaccactgtccaagtgtcaat

SEQ ID NO: 200472 - DNA, 386 bp, Homo sapiens
aaagaatgaatgaatttaagagtgttgcgaaactccaccctttgacctttccctcctgtaggaaaaggaggaccctaaaccttcctgcaaggcagatgaagcttgtagcttcagtgcaagcgttcttcctggaaagcagagctgctgtgtgcatggaacacgggttctccttccatccttccctgcctcccagctttccttccagagcaagcatcagccagatatttaggaacttttaggttctactgtaaaacttttcttccttgaggcagtgaaaagccagcttaggattcagacattgctgtgtaaaccctggcgagctaagttaggagtttctgtggttttcaaatttagatccttgaagaaacagaagattttaaaatttt

SEQ ID NO: 200473 - DNA, 287 bp, Homo sapiens
ctttaacagattagtattgcctgtttttgaactttatataaatggaacctgtgtagtatatatacagttgccccttggtgtacctgggggattggttctaggatccaccctcccaacaggaaaatcatgtgtactcaagtcctgaagttggccctgcagaacccatgtataggaaaagttggccctctgtatatgtgggtttcacgtcctgcaaataccatatttttgatctgcatttggttgaaaaaaaaatatgcgtataagtggacctgcacagttcaaaccag

SEQ ID NO: 200474 - DNA, 525 bp, Homo sapiens
gttaccaaatatttgaaatcagataaacatattcctaaagtaaacaaaggctcaaagaagaaatcacaatgaaaattaaaaatcattctgaagtatatgaaaagagaagagcgtaccaaaaatagtaaaatgcagctaaagcaacaccttaagggcactatttcacaaacaaaacgaatttgagatcactgatctaagtttaagaagctagaaaaagggcaaattaaacaaagaaagcgctaatatcaatgcaacagaaaacagacacacaacactgaaaaagcagtgaaactaaactgtcttttgaacaaatcaataaaactgatacctctcactaaactgatcaagatttgtattgtgaattatgaaaaataaaaaaacatagccacagactccacattaattgaaagaatattaagctaataatttctttaagaaataaaactcctttgaaagacatgagttaccaaaaatgactcaagatttttttgatctatgttgttctgtatctatgaaagaaattta

SEQ ID NO: 200475 - DNA, 623 bp, Homo sapiens
gaatcaagactagctctgagaaaaaattattagaaataacagccacaggaaaatgatagagaagaaattgatgaaaatgacctaaacaagtaataaaaaaaatgagcttatttctgatttttgaacctgccccaataataaccttgtgtttctcgagggtcatttaatttgtaaatcacttccttttgctcatagtggcttatgaagtagacagagcatgtctcatttaacaggtaagaaaatggaaaaacagagatggtacggcttccccaggaccagggtcagcaaagtacaccaactgattaaatccactcatggactgtggattttttacatggcccatgagtcaaaaatagttcttactattctcaactgtattcttaacttactattcttattatacattctgtacgtagagtttataattgagccacacttattcgtttacttattagatattgcctatgtctgctttctgcactacaacagcagaactgggtagttccaacagagaccatatagcccacaaatattgactccctggccctttacagaaaagtttgcagactccagccctagacccacagtagaaccatgagcaaagcccagattttttagagcca

SEQ ID NO: 200476 - DNA, 453 bp, Homo sapiens
ctggcccactcaccagggtcccctgctcagcagagcctcagtgactggcctaaagaggctatgggtgaaggattgtagggagtcagaaagacaaggggagcattggacaacacaggaagtccctctggccaccttctgaaggtggggaccattcatgagaaatccggaggacgccctcagtccttgtgcagcaccaggaagaaaccgactggcccagggccacccctgagtccgcatcatcacgcagggtccttcagctgagcccctgttgtatccgcagatgaacatccgcagatccctgtcccctggtaactgacggacagcacagggtcctggtggcccatggacgccacctcatgcctcctttccgaggccacctagccggcgaggcccgccacggacacaccgtgagcacgcgcaacgagcaggggtcggtgatcgccatcccccgtg

SEQ ID NO: 200477 - DNA, 852 bp, Homo sapiens
tgtccacacaaaaacctgcacagggatgtttatagcagctttattaataattgctgttatgggctgtttgtgtcccctcaaaattcatatgttgaagtctaaacactcacctatgtgatggtatttggaggtgggcctttggaagggaattaggtcaaaagagtggagcactcaacaatgggattaatgtccttataagaagaggctagagagctagcttgtcttcttgcagccatgtgaggatacaagtcagctgtctgcagccagaaagatggcctttaccagaacttgactatactggcatcgtgatcttggtcttccagccttcaaaactgtgagaagtaaacgtttgttgtttaagccacccagtttatggtcatttgttatagcagtctgaactaagaccaatgtcaaaacttggaagcaaccaaagatgtccttcagtaggtgaataaactgtggcacatccagacaatggaatattattcagagttcaaaagaaataagctattaagccatgaaaagactcagaagaaacttaaatgcagcttgctaagtgaagaactcaatatgaaaagcctatatgctgtatgattcaagctatatgacattctggaaaaggcaaaactatgaagacagtaaaaagattagtggttgtccgggaatgtagtgggggagaatagagcatggaagtagaacagagttttggagcagtgaaattatttcacatgaaacggtaatgggagacacatgacattatatgccatagaactgtataacaccaagggtgaaccctaatgtaaactgtgggctttggatgataatgatgtgtcaatataggttcatccattg

SEQ ID NO: 200478 - DNA, 457 bp, Homo sapiens
tatgtaccttgtaattcataataatagataaggttagataagtctaaccttattttttattcttaatattcatagtataaaagtgatatgaaagatgcattcacaactttagtaacagtggaaaacagcctgtcatagtgtaaatctgttttatagtatgacataacttgtcatagtataaaaaggatggggtttatcttcataattcctaatctttattttagttgtattgccttgggcaatgcatatcttcttgagtttcaatatttttatctataaaatgggtagataatatcaccctcactggactaaaagagatgatgtaaataaagtacctagtaatacctaggtacatagtaaacatctaagtggaatttaatcataaccattgataatgatacattccctgccttttctcaaaatagcctacgtatgttgtaaccacactcaggcctaa

SEQ ID NO: 200479 - DNA, 402 bp, Homo sapiens
ctgcctataataatgcctttagtagatacatattcagttgtctcggtatctctgggagggattggttccaggatcccccgataaaacagataccgaaatctaggatgctcaagtcccttatataaaatggcatatctagtgtttacatatagcctatccatatcctctgatatactttaatctctagattgcttttgatattaatatgtaaatgatacgtagtttttatattgtattattttaaatttgtatttttttattgtactattactttttattttttttccccaatatttttgatccatggttagttgaatccgtagatgtggaccctgtggataaattgtatgtttatattatttccaggaaaaatgaaagtagccttactttgtgactgttaaa

SEQ ID NO: 200480 - DNA, 413 bp, Homo sapiens
cacgcactggcaggaataaccaaatttccttgtcaatcgcatctttaaccatgactgtccttaagtctacttgtacacagtaaatgcttaatctgatgcttttttggaaagctctttataagctattataatcctaaagagttgtgctttcaaggaggttcatggaagggactctgaaagtacaaatgtctgataactttaagattatactgttggactggataaaaaaaccccagaactctaatgaaaaaaaaatgggttcataatactgctaacccaagcagagaagaattaaattatgaggaaatacatgggccaagtgcacaatgatatatgcccatcgttatactattatacatagtattttcattgccccaaaaatcctctgtgctgtgcctattcatctcccagcc

SEQ ID NO: 200481 - DNA, 574 bp, Homo sapiens
taattacattacaaagatccactttaacaaataacatttaaagttagatggctaggtgcggtgcctcacgcctataatcccagcactttggccataatatgtcttttttaaaattacaattaatacttactgttatttaatttgatgccaagtttttgttttattttgttgtttttttgagacagggtctcactatgtcacccaggatggagtgcagtggccatgatcttggctcactggaacctctgcctccagtgttcaagtgattcttatgcctcagtcacctgagtagctgggattacaggcgtgtaccaccatgcccagctaatttttgtatttttagtagacacagggtttcgccatgttggccaggctggtctcgaactcctcacctcaagtgatccacctgcctcagcctcccaaagtgctaggattacagtggtgagccactgcacccagccaggaatgccggttattcttaatttccctatgcaaatgtagagttctgaggatgcatttcacagaggtgctctagaccctggggaaatgacgtggtcttgactccatgcctatg

SEQ ID NO: 200482 - DNA, 559 bp, Homo sapiens
agtatagttaactttatgtaatagcattagggtaggggataggttgtttccagttgtacaaaagatagttgtattatgttaggtataattatgaccttattagtgtctttatttgaagattatgtatgatctcaggagatgtgtatgggttcaagttgacaaggggtggacttgtgatggttaatactgagtgtcaacttgattggattaacaaatgcaaagtattaatcctgggtgtgtatgcgagggtacctacctgatgggacgcaatcttcgtcccatcagtaatatattgttaaaattagactttttcactgggtaattggtaggagcctataggttttcttgtgataagttcagtcctcagaaagcaccactcttgtggcatttcagggcttaaattcttaatactctttgcttggttttccaagtctaaaacactgttccacatatgattctgtacaatctcatatctagtcatattgcagtgctgagaattgtagttccagagaggcatgtgtggagatagggttttgagaatgttcgtgaaatgtttcac

SEQ ID NO: 200483 - DNA, 896 bp, Homo sapiens
tctaggtggaggctcgtgttaaatcggacgaggagacgcctggcgcacccgcgggagcggagccgtggcgcgctcgccccggacgccggccgcccctccgctcgccctactgagcgagcggcccggggcgccgaggggtccgcgccgcgcggggcgcaccgccctggccgccatgtgctcccagctctggttcctgacggaccggcgcatccgcgaggactacccgcaggtgcagatcctgcgcgccctccggcagcgctgctccgagcaggacgtgcgcttccgggcggtgcttatggaccagatcgccgtcaccatcgtcggcggccacctcggcttcagttggaatgagccaggcccaaagatttacctttggagaagagagatgaagtcctggcctccagctaaaccagaaggccctcaccactttcccggatgtggtgcttgtacgggtacccacaccctcagtgcagtcagacagtgacatcactgtcctgcgacacctggagaagctgggctgccggttggtcaatcgcccacagagcatcttaaattgcatcaacaaattctggacgttccaagaactggctggacatggggtccccatgccagacaccttctcctatggtgggcatgaagacttttcaaaaatgattgatgaagctgagcccctgggctacccagtcgtggtgaagagcacacgaggccaccggggaaaagctgtttttctggcaagagataaacatcacctctctgacatctgccatctgatccgccacgatgtgccctacctgttccagaagtacgtgaaggagtcccatggaaaggacatccgggtggtggtggtagggggccaggtcataggctctatgcttcgctgctccactgatggacgg

SEQ ID NO: 200484 - DNA, 446 bp, Homo sapiens
ctgattataaatcctaggtaatgcagttcaaaatgcagatgatggaagcagattacgtctgggagatgctgtccaactcggatcccagttttctctcctcagaactatatgtgaaatccacttacagtgagagtacacctgagctagagggcatttaccacttaagggggctaaacttattgtttttcaaacaagaactcgggtgtggaggagcttgtccaaggcaggaaggcaaaaccaggtccctgatgttgtctggggctaagcagaaacagcagccagcaaccaaatccatctccagatggatccatctccacaaccacaggcccctccctattccccatgcaagatgcagcaccagggcatgtccatgtgaaatctcagaacacacagaggcgtccatcagctttcccctctcttgtgtcctgtccacagagcttacccac

SEQ ID NO: 200485 - DNA, 337 bp, Homo sapiens
  misc_feature (32)..(32): n is a, c, g, or t
tacgactcgagttcgtacccaggcatgcagcncggggtatgaaaattccataaacccattagaaaatatcaatactaagcttggcatggtggttctcgcctgtagtcccagctacttgggattacaggtatgagccaccgcacccggcccacatccggctaatttttatatttttagtagagatgaggttttgccatgttggccaggctggtctcgaactcttaacctcaggtaatccactcgcttccaccttccaaagtgctgggattacaacaggcgtgaggcactgtaccctagttactcctaaggcttcctcttgggctttttcaaattagaa

SEQ ID NO: 200486 - DNA, 461 bp, Homo sapiens
aagaatggcaggggttgtcatgtcagtcctccatttgtgatacatttctggccggtcatgaagaaatggcatgggggaacaatacacatgacccccaaaccaagacgcagaggtctctccacatatctgggtaagcaggaatgaatgagaacatcctcacattcatggcctccttgggttttaaaagtacattgagaaacaggatggtacctaatggcccatgaaggtctctcctcggctggctggctttccccatgtgcaacaagagatttaggagattcgtttgtatatttccatcaagaattctgggaatcagacctgaaacttactatttccttatcacttgggtagactggggaaaataatggttatattcagaaagctcatggacccacacatactgatcagtcaatggttccttaacacttaactagtgttaaggaaacaagagaaagggagaa

SEQ ID NO: 200487 - DNA, 287 bp, Homo sapiens
  misc_feature (55)..(55): n is a, c, g, or t
  misc_feature (57)..(57): n is a, c, g, or t
  misc_feature (91)..(91): n is a, c, g, or t
cgtcggtacctccgttctgacatacggataactttattgacataccaaagagaancnatattcactgaaggctgccgaatccgtatttctnagagtaaaggtgtttaattgactctccacacttaaagcactttgtatgaaatatagctacaaatatacataaagaattcagatcacaaaactctctaggacattggctgggcgcggtggcccaagagtctcctacctaaagttttagagtccaccttggggcaaataataaaccagtggcagcggaagtatgtagt

SEQ ID NO: 200488 - DNA, 255 bp, Homo sapiens
atgcttcttgcctgagggaaatctaggaaggcttccaggaggaaggactattcagattgaggagggaaatgagggggctagtaaaaggtgcaaaaacagttgtctaggggtgaggcacactttcagatgtagttgggtcaacttgagcaaatgacttagctattccagacttgatttcatctataaagtggtcacagtatctgccttgcctgtttgttgccatgatcatgaaatcagtgggagcagacctggctt

SEQ ID NO: 200489 - DNA, 246 bp, Homo sapiens
atgcttcttgcctgagggaaatctaggaaggcttccaggaggaaggactattcagattgaggagggaaatgagggggctagtaaaaggtgcaaaaacagttgtctaggggtgaggcacactttcagatgtagttgggtcaacttgagcaaatgacttagctattccagacttgatttcatgagcatggcgaacaaacaggcgaaggcagatagtgtgtgggggttatggcgaggattgggataccg

SEQ ID NO: 200490 - DNA, 218 bp, Homo sapiens
cctattttagacatcagtctgtagagctttttcacagctctcctatgacaacctttcaatcacttatcctcaaagaagtagacatttacctagactctgtgtttgctaaaactacccttggtcctttttattttgatattagctgaagtccttctctaacgtagttagtttatttgacaaatatttgttgacacctactgtgtgcgatggtatttgcc

SEQ ID NO: 200491 - DNA, 618 bp, Homo sapiens
cacagctatacaggaacagtgtatacagagaacagcttaccagacacatctatctcgtgaaacaaatactgctaccataaaagtcacttaagcatccctgttagttctaagcccctgtcgattgcccatttattttaggcaatagtcattcaacaaaattggagcataataaaaagaaactggacctcagcgcaagttgagtgttacacaatttaacctgtaataacaggttctcacttgtatttctccagctctttgctgtaagaagaataaacgttatgtagatataataccagcgtgacagcttgtggttggtggtttctagaagaaataattcagaagcaaaagacacatgaagttatgtggcagttcctcactagggaatttggtctccagggccacttttgaccttaatccatgttggagccatcaatcaaagaattgcttgcatctaataatggtgtaatgccaatactaagccctggaacgaagataggattcatttctcatggattattgagcactctggggtaacctggccctgatctgatgacgctaagatttaaaaacccagatgcatgtgactagaactatcttttctcccatgatgcactgctt

SEQ ID NO: 200492 - DNA, 309 bp, Homo sapiens
ttaaaaaacttagatgctagtaggatagataaagcatgtatgcatttaattatgatatcaaatttaaagtgttaaatgccattaagaagtataggtaaggtacagtgggaattttgagagtaggatgattgctttcagcaccaagcaaaaagagattggcaaaaaatacaacatttcaatagaattataaaggctagtaggatttgacagaagtattaattaggatatgctaagttatgcagcaaaaaaaagaatcccaaatttttagttgattaatataagttgatttctcattcatgtaacgtatca

SEQ ID NO: 200493 - DNA, 338 bp, Homo sapiens
caggagtcatccctcccaagtggtagagggaaaccagaaggaccatgggacaagctctaaaagagtataaataaactctttaaaaaaaaaaaaatcccaattagtgggaaagtaaatggctgatactagtagcaaaaccttaagtctttgaaattgacatactggaaatgagccattattaagattttaaatgaaaataataggatttagacataaaataggaagcaaaatacagtaaacagaaatcgtgtagccaaatatgcatcaaatatgcattcccttcagctacacttttttcctctgaaatacaagttttagaaaatcttagaagaggggtg

SEQ ID NO: 200494 - DNA, 586 bp, Homo sapiens
gcctgaatctcagaggcagagaactgttctaaatgtgactgatgagtatgacttactggatgatggtggtgatgctgtcttcagtcagctgactgaaaaagatgtgaattgccttgaaccatggttaataaaggaaatggatgcttgcctttctgatatatggctacataaagatattgatgcctttgctcaggtctttcatctcattttaactgaaaatgttagtgttgattacagacatagtgaaaccagtgcaacagctctgatggttgctgcaggacgtggctttgcaagtcaagtagaacagttaatcagtatgggagccaatgtccatagtaaagcatcaaatggctggatggcattggattgggctaaacactttgggcagactgaaattgtggatcttctagaatcttacagtgctacactggaatttggaaatctagatgaaagttctctggttcaaacaaatggaagtgacctcagtgctgaagacagagagctcctgaaagcttatcatcatagtttcgatgatgaaaaagtagacttggatttgatcatgcatcttctatacaatatctgccat

SEQ ID NO: 200495 - DNA, 427 bp, Homo sapiens
ttggtgtgagtgtgtgcacgtgtgctcctataccaaatgctaccaaaaaataacttaggcaaaaacataggaaataaaccatctcaggatgatgaattttaagactaagggggtaaggagagagcaatttttcactgaatacctgaaaacaacaattacaattatgggctgccctaaataaaaaatgagcaaatttttcctgccttggctttgaacaaagttaatttaaaaaatacatgcacataaacatactagttttaacaaactcaaaaaatatagaaaagtacacagaaaaagcaagtcaccccttctactgatagtaaaagtggctcctactacacagccctctgtataggcacgtgtgcatcacagtagaaaagtcatgccacatgagccatgtggcatgttctttttttttttttttttt

SEQ ID NO: 200496 - DNA, 412 bp, Homo sapiens
atggtgtagaaggtaccactttttaaagtactacaggattcctgattcaaatatcttataaatcctttagtaaaatgatacacttcttacacaagagcatattctcatattggatttgttttaaacaaggcacacaaactatgacattgtatgtaaaactataagccccatcacatgtaatattttaaatgtcttcatttaaccttaaataagtaaaaaataataaaatgtagggcaattaccaagtgccttaataaaggtcaagctacctatgtaacatctccttcgcatattccttaagatattcttcatgtgctaaaaataccgatggcgggctgtacttcaagacttctttttgggtcgggcgtggtggctcacaaccgtaatcctagcactttgggaggccgaggca

SEQ ID NO: 200497 - DNA, 611 bp, Homo sapiens
tgtgttgtcttaaaaaactgcttacttccttcaaagcagacttgaacgtgttatgtatgttatcataactcctattccactaagagtgtcttccactccagaacatatgatcaaaagataaatccactttataggatgagagaaaattaagtcatagaaacagcaccactattctttgtttaattatatcaatatacattatatctagcatgataagaggtgcatgaatgatataaaatgaactaaatgggaatagtctgtggttcttttagccatcataaagagcttagcttgaagcaatgggtgaatccatcaataggtgcttcatcttggtgcaaaccttaatgcactccagatctacaaatatcaatattaccaacaatgagattggattcattattgtcaggaagacagactgttgatgtagcattggatcaccaaattctaaatccagattactatatggtgataatcacaagagaagatagcctagatgtctccaccatgtaaacaacactaaggttattgtatattacaggaaggagcaacaacagcagccaatgtgtattgcattaaaagaggctttttatatattcagtaatttaatcttt

SEQ ID NO: 200498 - DNA, 286 bp, Homo sapiens
tattgcttcccagacttgccttttcccgtcctgacaataaggaggttgcatcagtttctgatgtcactccagctctaagtatccttttgattctatcttgcttttgttccagttatgtaataactcacgaatgacctgttaaataaccccaaagcaggaaacaagatgggactgaatgatacttggaagcttagggtggcatgaccagcactaactctaaactcaacctcaactcaacttaattttagtgcttattttttatgagaccaagatccatatgtagcct

SEQ ID NO: 200499 - DNA, 561 bp, Homo sapiens
gtcaatgttgctgcagtgggcatgattataccactgcactacagactgggcatcagagcaagacctccagctaaaaaaaaaaaaaaaaaaaaaaaaaagtcaccactccatcttagcaggtaaaaagctagagtaaactgaaaaatcaaaagctcttcttagatccataagagatgggaggtcatagagaaacccccaaattgtggacaccccaggttaatgcagattaatcacaactttatttacgggtagcagaattcttaagtgggaatcagggctggagtgggaaacacctgaccgtgtaatttaccaaatttgctggcaggcttgggtgtgcgacacagtctgtgagataaaaactttatggggaggctcccacacttttggtagttatacctccgggggctctactaggttctcacagtgaatttttgcaacccatcctctcatgcttccaaaaaggggagaggaaaaggaaccatcttgaaatgccctagagcattctgttcttaagaacaaggtcttccctcgggagaaattccttcactggagcctaacctg

SEQ ID NO: 200500 - DNA, 1116 bp, Homo sapiens
ttcaaccttcgccactgtctttgcactgccccataaggcctgaataaggctgatgggtcatgtatggcagggccaccccaacagtctagtaataggtcttgcattgttggacacacttcttgatttagaactatggctttcagtcatggttaggtgtgccccagttggcaaggtaaggagacatttccagttgttacagtgagtttgaagggtgttaatgcatttagttcatggagaccagggttgctgttcaatatcctacaatgcacaggacacttgcccatagcaatgatctgattccaaatgtcaacggtgctgacatcagtaaaccctgctctaagtcaatgctttttttgtatgcatattttaaaagtctcctccagctaaaccattagcttttaatggggtatacatttttctttccaagggatgtttggttatgcctggagacactttcagtttttgcagccagagtttggtgatgtttctggtatctaattgatactaatcctagatgctgctcaacatactactatgcagagtatggctcaccagaacaaagaattatcccattcataatgcctctagaattaagattgagaaaccttggtttagaatacagggagagctagtggtatcctctaagatgctgtctggaagcagctttgaagacaagcagagaccagagactttgaagccatactcacagggtttgatatagtttggatattggtcttctccaaatcttgtgttgaaatttgatccccactcttagaggtgggacttggtgggaggcatttctgtcttgggccagatctctctcatgaatgacttgatgcagtcctccagatgatgcatgagttcttgctctgttatttcccgggagatctggttgttataaataacctggcaccttcctctcctctctctcttgtttcctctctcgccatgtgatctgtgcacacagcagctctccttccccttccaccatgaatggaagttcccttagtccctcatcagaagcagatgctagtaccatgcttcttgtacaccctgcagaactgtgagccaaataaacttcttttcttttctttttattcttctaattagagacag

SEQ ID NO: 200501 - DNA, 424 bp, Homo sapiens
gaacaaggcatcaaaaatgcattttttaacaaatagaaacataatttcattgaatgagcaaaatttggtgcaataaggaagtttataagactttgggtcttctcatatttatatccagtattataagcacatacctcaatttactgcacttcgcttaattgtgccttgtagatattgctttttttttttttttttccaaattgaaggtttgtggcagtcctgtgaccagcaagtttatcagcaccatttttccaacagcaggtgctcacttcatgtctttgtgttaccttttggtaattgttacattttcattatttttatatatctattatggtaatctgtgatcagtgatctttgaagttaatactttaattgtttggggacaccatgaactgcacccgcatagcacacgtgaacttaattg

SEQ ID NO: 200502 - DNA, 734 bp, Homo sapiens
tcatctttgcacactcctggaaatattttatagcacaaattcctagaagtaaatttgatgggtcaaagagtacctacattttttgtttaatagatttttccaaaatacagtcccatgttacttatcatccacagattaggaaaatggcctattggcccctcctggcatttctgtttcttcctggcctgggatggggttttaagcctcccccggaagcagccaaagtggtacagaaggggaagtttctgagcaaataacattgtgccaccgagttcttcctccccaccgtccactcatcctcagcctcaccacaggctgcagcccagagcactaagggaaagtcttccctctcctctctactatttttttttctcctctctactattttttttctcctctctacttaatttaacctctagtcaaaaagtactgggttgggaatgaaagacttaaatgaccaccgtgcccaacctaaatttttttttaattgatataagtgcttctagacactctgaatttttgtgtttatcttgttgcaaactcataacagaatccccagcctggcagttgtccatgggctactctctgagaaatacagatacctcggtgcccactggagccaagcctagcatggagtcacagggtggctgcctgtgctccgagggagctggggacatggcagctatgtaggctgctggcaccctgctggcaccccagccagttgaatgactcat

SEQ ID NO: 200503 - DNA, 450 bp, Homo sapiens
tgcccctgactacggctcccagcctcagcccctgcgcggtgcacacccatgtgctctcacggacacgcatgcgcgccttggagtagggactgcagagtcagtggttcttgaaggggttctgagaccacagaaggagcaatggccttgtgcacaggaaacgactcatgaattatcctgaactgcagatccaaaaaatcacatccagttgtccctccttgatgcttgaggctttgcagggaggagcggcagtcttcagcacatttttacggagcgcttcgttgatgccttgtactcttctctgaaccaatgagcaaagatgtttgcccccagtgccctgtgtctccccttcccataggggcgtcagatcccccactgaaatggtggctttcttttggggatcctctctcccagaagggcatgggccagcattaaaaacggtcaaaaattagg

SEQ ID NO: 200504 - DNA, 425 bp, Homo sapiens
gttattagatataaaacaggaaggagggtgaaatatgactaaggaataagaacaataagagatctgaaaattttagtcaaatatgaaaaagtcattggggttttattttccaactatcttccctgacttttctctggcctgaatgccacttcaggttgataatttactaccaactacagacagccctacctaacttggtttctaaacaagtcgatcttttcttctgtgacatgaggacatttacctgcttagttctttttttttttttttttgagacggagtttcgcctttgctgcccaagctggagtgcaatggcgcgatctcagctcactgcaacccccgcctcccaggttcgagcaattatcctgcctcggcctcccgagtagctgggattacaggcgtgtgccaccacgaccggctaattt

SEQ ID NO: 200505 - DNA, 488 bp, Homo sapiens
gaaaaacacacaggcattaatcgttattaactgccacagacactctttcctggatccaggttcctatttgagtcttgccttggtccacagcctctcacctcatctctgccctctttgtgacccttgacataattagggatttagttggatcagcaatctagtcaaggaagaataaactgtacagcttcagggtttcccctgagctacttatcaattttcccaacctatttatcattacccctggatcatgaacactgcttaagtctattcgttctctaaaccattgcaggacagagtatatattaaaataaatttttcctatctaatacaggttgttcctgaaaacgaaattgctggaataatacttttaatagaattatagtaatagaacaatacttttaaatgtctggggatttaattatttaaagaaatttggttgtaaacatttttaaaaacaatgcttttatcataaaattggaattttataa

SEQ ID NO: 200506 - DNA, 616 bp, Homo sapiens
tcttaaccaggccagtcggttctaccatctccaattgctcccatccagccacaactgcaagactcctaagcctgagctgaacatgctcctatgttctctgcaccctcctatattccagcccaattccaccagcatctcagaagaacagcaaactcttatagtcacagcaatatcttactggccccagcacaattttcaaattggaaactttccaccagtttatctacatcacatcaaaacatgtgggaacgttaaaacacaggcaagttttcaaagtgacaagtgtaggcttccaagagacccaaacaggaatctattcaggacttttttttttctcagtgataaaataaaacaacttatcgatcattgaaaaaagttttttagatctcccagtccctagaaagaacttggtataaactcttcttagccataggccatatacagcctaagtattatccgacagctatggatcaaacttatcagtgatcacttaactgcactctattaaaaacattgatatctgctgagtaatcgagaaggctgatttacatgggctgaaggcctatgacatggacagattttggcagaatatcctggtatcttagtctatttgact

SEQ ID NO: 200507 - DNA, 385 bp, Homo sapiens
tgccagtcaaggacacagtctcccaaacctgcttttctcactctccccaactgttgtccttgaagagaccggggggctacatcatggaagggccctggcccgggagtctggagaccttggttctagtcttgggtctgccaccagctcttggtatgaacatctgtgtgttcatgtctctctgtgcacaggggacgagagtcactgatgtctgtagctgagacggtctctcaagtgagggcctactatgtgccgctcagtaactgggactttaattgctgctcctcattcctcctccctgcccccactcaccgaggtagataggggaagtgaaagtggaattaattgttcatttggagtttcactccaccagctttccatgcatttc

SEQ ID NO: 200508 - DNA, 460 bp, Homo sapiens
attcagcccttttggaaaacaattggatgggacatcccaggactgtagaagtgtttgtatgttcttttctcccgtaactccactcctgggaatgtatctcaaggtggtggtacactacggccgggtgcggtggctcacgcctgtaagcccagcactttgggaggccgaggcaggcagatcacctgaggtcaggagtttgagaccagcctggccaacatggtgaaaccccatttctactaaaactacaaaaattagctgggcgtggtggcggatgcctgtaatcccagctactcgggaggctgcagcggagaatcgcttgaacctgggaagcggaggttgcagtgagctgagatcacgccactgcactccagcctgggtgatagagcgggactccatctcaaaaaaaaataaagatggtatactagataagagggtaaaaaaaccttataagtggtcctta

SEQ ID NO: 200509 - DNA, 229 bp, Homo sapiens
cgggaggcagaggttgcagtgagtcgagatcgcgccactgcactccagcctgggtgacagagcgagactccgtctcaaaagaaaaaaaagaagtgagacgaaacttgctatgaagcagggtgatgagagaagggtgggggaagggcagtgggagcacttggggcttgggctggggtggggacctaagtcctcaaaggtgaatgggagtcagacaggtggagtgggggtg

SEQ ID NO: 200510 - DNA, 187 bp, Homo sapiens
taaactctatccagactcaacagcaaaaaaaaattgcacgaagatgtttatacttttaaaatcgtcttaatagctgccctgctttatttttgcttttatagttaaagagaaaaaaaaaagcttttatttccttaatctctctagagcatgaaacaaagaggaaacattaatgcattctcagctggtg

SEQ ID NO: 200511 - DNA, 4016 bp, Homo sapiens
  misc_feature (1217)..(1217): n is a, c, g, or t
  misc_feature (1369)..(1369): n is a, c, g, or t
  misc_feature (3278)..(3278): n is a, c, g, or t
tgatctctttgttattttgatgtgatgacatcatcctacacaaaacacaacttcaaatcatatgcagcttatccatgcacagttgtaattaccaatacaaaccaaaagagagagcaagaaagagagcgagctagagggtgtctatgacctataataattagcattttcagtaacaacatctgttgctgacaatattggcagtagcacaggaaaaagcaatcattaaaattagctaatgctcagtttaagtgctacacaatgtactgacattttcaatattttcattagttttgcattttctcattccagtaagtatctgttttcaagtttgcatgaatgccttgtattatattaaaaatgtttctcagaccttctctcaaattgatctgggtcttaaagcagtatttccagtgggtcaaagtagcactgatgcaaactcttagaaatatagtatccaacactctcgaattggattctataaatttgatcttacataatttagatactgaattagaaattctccataacctgcaacacacattttcttaaaatctcattgtcttagctttcttgagtttttatcctggaatttctgtttgaggtgtaagtgccaatattaactttaaaaatttagtgaagtgtaagtcaattagaataattttacaggtgacctgtaattccagcattttgggaggccgagatgggtagatcacttgaggtcaagagtttgagaccaacctggccaacatggtgaaaccccatctctactgaaaatacaaaaatagctgggcttggtggtggacacctgtaatcccagctactggagaggctgaggcaggagaatcagcttgaactcaggaggcagaggttgcagtgaggtgagattgcaccactgcattccagcctgggctacagcaagactccatctcaaaaaaaaaaaaaaaaaaaaaaaaaaaagaaaagaaaaaaaggaagtggtcaattctagatctattagaatttagactagactacgtgacagaatggatattgggaatgaaagggggaaagggggaggtatcaaggacaactccctgatcttgaagggtctatttactgagatggggaagaaaaaaaataaattggaggtagaggagggaattagttcagttttaaacatgtggtacctgtaatgccttccacgtaaatagcaatagtcagtcacctataagagggcngggctagagatacaaattagatagcgaccaacacacagatggtatttaaagccatgagaatggctgaggtgtctgtggagagaggggagagagaagagcaaagagacctccaggaccatcactccaaggaactccaacattgagggatcagntagaagacaatgagccagagagccgggaggaaaaacaggagagtgtagtattatggaagccaagaaactcttttcaagaaaggggcaatttactggaacaagtctgtgctgatcgggtcctataagatgtctactaaaaatcattggatttgaccacttagaggcctctgattttagcaagagcagttctatccaacagttgaatgaaagccactttggcatggatagaaaagaatggatggaaggtaaggaagtggaggcagaaattgaaagggtatttgctagagctgtgcttccaacaacatggtagccactagccacttatgactgtttaaatgtattaaaatttagtaaaatttaacatgcatttcctttgtttgcactagtcatatttcaggtgcttacttgccaccggtggtgtgaccaccatgttgggacagcgtagatttagtacatttccatcactgaagaaagcactgttggatagcactgttctagagaatgccagaatgtggtgagaaccatctcaggagagaaaatcccactagcaggcaagggtgggggaaggtaagaattggatccatgcatagggattgcctttctttggatgagagagacactcttcctccaaagtatcaatagaaaagaagatgggtgcagatccagatcttatgttgggaagatgagggagttatcttttggtttattttttttttctcaatgaaacaacaggccagcacattagccaagggtggaaagggaaaagaaccaggcgagatttttgaggaggctgcagatggcatgaataatcctagtaatagggggagagtgagtttaccaaagaagtgccataacattgtggcaggatttagtgcctgtgaatttatagtgattctagtttccctagttttgtgatttttctccagacatactcaactggagagtagtattaaggggctgtcataaggcagccattcttaggttgggttgtgtgtaatggcatatattaatactgctgaattggaacccttagggagatgtaaaactaatggagctcagcatggtgaatccaatccagacatgaattgagaaatgcattatttggtcctacagtaatatatcattatccctttacgtagaaatcattgagattccacctctgaaatactcgtgtatgagactcatcataatcatttggagaatctgtgtggtagattgttgttttctatacttcgtagttggtcttgttcattttagtctcagcagcagactagaatgttaagccaatttgctaaatcttgcctgtcctctgtaaaatgcttaaatccgtttatataatacaaagggatatgttggaatttaatgccttcttatggcatcagtactgaatatttaatcagaacaaaaagagaaacatgttagaattttcaaattacagagttaccgtgtggatgcttcacagaggtacgtgcagttcagtgtgcttatacacccgtatgaacttctcacatttattagctataaaatacttcgaaggtgtattttcttctagtttttatatttaatttatggaatattaagtaggaaaatattagcaactacttggatgcatgctgcacttattttctaagaattagtaaataatgttatcatgtgtgattagttgtgtttaatgctagagatgagatattacgaattagcaactcaccttctaagttcttttccttaccagttaccttaaacatatccatttcccaaatagagaccattttctcatttccagggactttcaggagattaaaaggttaacatttacaatgctctgatttcaagactgcaaggcactatgtacaaaattcgtatgttgtttgagcactttttttaaagcctctatgttcaaaccttttgnaatgaatttagttcctatggaaacttatcgctgctgtagatagtgcccttatccaagagaagaaaataaaatcaattcagagaatgattttataattgtataacatagcttgggaatggacattaggaatatgtgcagttgcgctcttcggctgttatactggttcatattagattgtgtttgaaaacaaccttgcaaatgtcaccatctgtccttcactttgaggccagaataggtaatagtggtttaacagaaatttcagtgggtactctttcttgcaacatcacaagtaataccttgtgaggaggcaggggatatgataaatattttggaagtaaaattagctttggtaggtggaggagagggagaaggaagaatgctgttgactcctgggaaagattggcattttgcaggctattcattcactagaattcgtgtagatgaacacaaaaaggaggcagctgaggcagatagactatttgaaagttaagtaatagtagtgtatgcttgaagtgataacttagcctatggtaaggatatgggaaactgaggaatgttaaaagtgaaaggtattttaaaacaggaactaacaatctcagtgacttcttgaaaataaagaattagccggtgctgtggcttatgccatatcctagtactttgggaggccaagaagggcagatcacttgagcccagaagtttgagaccagcctgggcaacatggtgaaaccccatctcagc

SEQ ID NO: 200512 - DNA, 650 bp, Homo sapiens
tagaaaatagtgtttgtgtgtgtgttaggaatttaaaacacaaatagttatacactatctgcaggatctttgccttaaaattggacagtaatccatatcggtcatgtagacttagttcatttgttttaactgcagcatggcataaatatactttatttagctatccttaaacattattcggtatttagattattgtcaatattttactagaacacagatgctgaaataaactttcctgtatatacctacttacacagtgtatgagtggatgcctttattggtatactgtgagaagtataccgcagtatgggtatactgagaaactactgatacacagggtctctatcttttacattttagtgcatattgactgtcaaactgcttttcagagtgtacatatcacatcacacccaccagcaatgtatgagagctcctggttctttctagtctcacagcaatatcaccaagctgattagtaaaaaaccttttctcctgtgctcctcattaatttgcatgcctctgactgctaggaagattaagaatctttttaacccagtgtttatttgctatctgtatttcctcttttgtgaattcttttcccattttttttaactgagttatcttttttcatatctatttgttggagcttt

SEQ ID NO: 200513 - DNA, 184 bp, Homo sapiens
aaacagagtgaaaaacacaatataaaatttctcaaaaaactgtttaagatgaataaccagccgggtgtggtggctcacgcctgtaatctcagcactttgggaggccgaggcgggcagatcacgaggtcaggagatcgagaccatcctggctaacatggtgaaaccccgtctctactaaaaatac

SEQ ID NO: 200514 - DNA, 340 bp, Homo sapiens
aaaggttaccagagttggtaagagtatttggaaatgagcattctcctgcaatgcattagaagtcagtctagcactgtctaaatgctccatgttaaacctcttgacctggcagttctactagcaggaacctgccccttgcaaatactcccaggtgtgcagagatgaacacagagatgttcatcacagtgctgtctgtaggtgagaaaaactgcagttaacttaaatgttcattatttgggggtggtttcattaattaagatatagcaaaacatggcacattttatagctattaaaaagtgaggtgggtctacttgtgcagatatggaaagatctccaggtg

SEQ ID NO: 200515 - DNA, 109 bp, Homo sapiens
acccagctgctaggactccatggcgcagcatacggcgctgagcttggcctgcagagccctggcctgtcctaagagttggagaccacgggacaagcacagccctgcagca

SEQ ID NO: 200516 - DNA, 714 bp, Homo sapiens
tacaaaaattagccgggcgtggtggtgcgcacttgtagtcccagctactccttctgaggcaggagaatcgcttgaacccaggaggcagaggttgcagtgagctgagatcacgccactgcactccagcctgggcaacagagggaaactccatctcaaaataaataaataaaataataataatgcaggacaattatgtatagcaaacactttcaaaatttaaactccttcaacatttaattcttcagcattatgtatacttttaattgcacatcatgcgccccgaccctgacaccaactagaatgtaagttccattttgtctatttaatttgctgatgtgttcccaagactagaacagagcctggggcatagcaggatcatgagggtcaaacaagataatgcctgtatgtagcctgtggtgggcagcacctggtacagagctcatgatgaaccattatcctcttcctcttacatgtccaccaacaggagaatagaaattatgatatataatattgtaagttggccaggtgcaatggctcatgcctgtaatcccaacactttgagaagctgaggcaggaggattgcttgagcacaggagtttgagaccagcctgggcaacatggtgaaaccccctatctctacaaaaaataaaaaaaattagccaggtctggtggcgcgcgccagcctgaagtgggaggatcaactgaacccgggaa

SEQ ID NO: 200517 - DNA, 500 bp, Homo sapiens
tacaaaaattagccgggcgtggtggtgcgcacttgtagtcccagctactccttctgaggcaggagaatcgcttgaacccaggaggcagaggttgcagtgagctgagatcacgccactgcactccagcctgggcaacagagggaaactccatctcaaaataaataaataaaataataataatgcaggacaattatgtatagcaaacactttcaaaatttaaactccttcaacatttaattcttcagcattatgtatacttttaattgcacatcatgcgccccgaccctgacaccaactagaatgtaagttccattttgtctatttaatttgctgatgtgttcccaagactagaacagagcctggggcatagcaggatcatgagggtcaaacaagataatgcctgtatgtagcctgtggtgggcagcacctggtacagagctcatgatgaaccattatcctctttgggtgaatctgtcattttgtccctttcgtgaaccacc

SEQ ID NO: 200518 - DNA, 608 bp, Homo sapiens
attttcattctttgttcaaggataaaggcgtgggaagggctccgggctgcccttcgtcaaaaacagctgtgcttttcatctctcatatgttatgtattgaagttctacaagatagtttgcttgaagaaaaccaaacttctaaattcagacttctaaacttccacttttaaaattgttcaaaaaccactaaattgctcatttctaagtttaagcccccttttagctctcaggtgatctaaggcaagcactgaaggatgggtaaaatttggtaggctgaaatgggagagaaaatgcattatatttggaaataataaagattagagatgaattgtgttcaagattagagaagagaaaactagaaatttaggaggccatgataatagcctacataatagataatgatgacccaaaccagggttgttaccatttataaagaagataaattcaaataacgatgggatgctaggcaatgaaaacagaatatatgaaataaaggagatggactagacaaaggtaactccatgactttgagctgggtgactggaggtaccattactacaagtagagaagtcaagaatggaatatgatttggctgaaaagatttgaag

SEQ ID NO: 200519 - DNA, 417 bp, Homo sapiens
ttctagattactggattgcctactttttgatgactttgtatccttgttcgcttaaaagatgatgaaaagtcacaattattatttttggattaattagtcacagcttatagaccaagtccatgtccaatggtacagagcagcctgctacctatttttgcacataaagttgtttttttgttttaggaacttggctgtaaagtgcatataaaggtgcgttggaacacagtcacagttacaagttgactggctgctctggcacatagctgagtagttgagacagacagagcacaaagactaaaatctgtgctatctggcccattctagaaagtatgctgatccctagtttagagccacaatgaattacccagattttgtgcttagttcatcagatatgattaaattctcagtaaatgaatt

SEQ ID NO: 200520 - DNA, 758 bp, Homo sapiens
aatgaatttggcttttaggtggaatagatccccttggggctagaatggatgccaagagctcacttaggaggctgttgccacgatccaggtgtcagccgctgggagcttgggttacgaaggaacaatagagacggagctaattgcatgttcggacgtctgtttaggaggagaggatttggtgacagattggctgtaaggatgtgagaagggaggtgaccaagttaagtagaaatggagctggtttgaagtggccgatgatgggttcactttgaaatggcccagtgctgtggctcacatctgtaatcccagcactttggaagctgaggcagtccaggagtttgagatcagcctgggcagcatagtgagaccccatctctacaaaagataaacatttgctgtgtgtggtggcatgcccctgtggtccctgctatttgggaggctgaggcagaaggatcatttgagccagggaggttgaggctgaagtgagcagtgactgtgccactgctttcctgcctgggtgacagagcgagaacctgtctttaaaaaaacgaaagagagaaaacgttgcattggcgatggctgaggccttggaatgggactgtgaagcgggcaggtgcctgagggcccagaacagatcgctgggaggtctagttggagacacactgttgtacatctgcatgtggctgttatttcaagctgtgggaatggatgacatcatcagtaaggagatgacagaggactctgccttatggaactcc

SEQ ID NO: 200521 - DNA, 510 bp, Homo sapiens
tctcattgttcaattcccacctatgagtgagaacatgtggtgtttgagatagttattcttatttgatgggagaaagctgactacacagggattcttcactaggaaattggcccccactgtcactttggggaagctgagacttcagtgaccaaatctgaacagtcacaatgaaacgggtgctcacttttcctggaagaataatcccagaatctccaagcccagaattttaaacccacacacacaacccgtgcatggacgtgtgagcacacacacccatcccccacttaaaatcccttttacttgatgtggtgttgctgatagaagagcttctttcttcttttttttctaaccttaagcaacttgtacttttataaagtcatgcagattcaaacaaataaaaatcaataggcagacagaagcgaaccataaaagagagaaccggttttcatatatgacagcattagaccacaaatgagattagcaatctttttcacttgtactattcaatgc

SEQ ID NO: 200522 - DNA, 182 bp, Homo sapiens
tgaggcagccgggaaacaccattggccaatgccacgccttgacttgcagtgattctccaaccagacagatcgtcagagtccccatgaagatttgcagccctgctccaactcccgcatcagcaccgctcaggacaagcctgctggtggggctgttttacaagctccccagccaactcatactg

SEQ ID NO: 200523 - DNA, 270 bp, Homo sapiens
aaactgtcgtgttcctataaccatagcttattgggtcagaggtgggcagctaatccaacctggggcaatcaaaatctcattttctagaaatttgcaattagacaagagataccagcttttctctaagtgtaaagcttggaagctgtcaaccaattttcccaccagagggacagaagtgaaagatgctggtctgcagaaagagagaaaaaatgcagactttcagagaagaacaaaggtgagaaatagagtcttcattgtgttcaattccca

SEQ ID NO: 200524 - DNA, 434 bp, Homo sapiens
tacatttagcttaatcacgcattatggaattctatagatttttatgacacctttaccaattaactggcaattttaaataatggaaatataaagtggaaggataataatgagtaagagtgaattcaggccaggtgtggtggctcacacctgtaatcccagcactttgggaagcagaggtgggtggatcacctgaggtcaggagtttgagagcaggctggccaacatagtgaaaccctgtctctattaaaaacacaaaaaaattagccaggtatggtggctcacgcctgtagtcccaggtactcgggagggtgaggcaggagaaccacttgaaccaggaggcagaggttgcagtgagccaagattgcgccactgcacgccagcctggatgacagagcaagactccatctcgataaataaataaataaagtgaattc

SEQ ID NO: 200525 - DNA, 379 bp, Homo sapiens
ccagcctgggtgacagagtgagatcttgcctctaaataataataataattataataattagtgctccattaagataacatttcccaggtttacttgattattttgcttaataaacttttttataccaataggtaaaaccattaaaatatctgaaaaataaaaccatttccatgccctcttcattcactcaaacaattcttggcacgaccatgcactggtgtataagcctcaccaccaagcagttcttaagtgccaactctgtgttcagaggtaaaatgagtaccacaggtaggatacagatgtagtctagacaggacaccaggtttctattccagcaactaagaattcactttttttccatccccatcttcacctccac

SEQ ID NO: 200526 - DNA, 601 bp, Homo sapiens
tgtgttagtagagatggggtttcatcatgttccccaggctggtcttgaattctgtgactccggtaatccacctgcctcaacttcccaaagtactgggattacaggtgtgagccactgcacccggccaaatccagtgtgtatttttcacacatcttaattcagtagctaaatcctaaaccattaaaactaaatggagtcctactagaacactcaagttgtgtttaatgggaaaacattttacactgtttccatttaaaagtaaaattgaaattgattaaataaaattaaaagttaaacttctcagtcatactagccacatttcaagtgctcaatagttaccaatggctggtggctactgtattggatagcagagacatagaatcatccccatcatcagtgaaagctttattggacaataaatctttaaacctttcattgcagaagattggacatattttgttatttttaaaatttaggatctgcataacaacattttagtcagcaatggaccacatataatgacagtagtcctttaagattatgccaaaattttgctgtacctttgcatgtttaggtatacttagatatacaaatactgacc

SEQ ID NO: 200527 - DNA, 430 bp, Homo sapiens
  misc_feature (337)..(337): n is a, c, g, or t
  misc_feature (340)..(340): n is a, c, g, or t
ccaaggacagaaagaaaataaaaatcaaccatgcattctatattcagtgaaactctcctttaaaaatgaagaggaaataaagatattgtcagatgaaggaaaaaaaaagaagattgttgctatccttcaagggaggaaattccatgttttggctggaatcagagtttaaggagtgggaggaactggcagggaaggaaaggagactgaagtgcactggagcctcctcccttcttgtctctagggtgtggtagaagacacttggcagtgggatggcattcacagtaagaccgaggctcagggtcacatagtagaggctgcacggccgggggaaggtgtngtngggaaaaggagatccgaatgtgtttatgcccagaagaaaactgtggagagagattgttgaagatgcaagagagacatgagatgttggaag

SEQ ID NO: 200528 - DNA, 562 bp, Homo sapiens
aaatgaggaaaccgaggctaagaatgagtaagtcattggccctcacccttgaataccatacactgagtaagtggcaggcaggggcctggatggtgatgaaattattccccttcatccctgaagatcacgcactgagtaggtgcaggccggggcctggatggtgatgaaattattccccttcatccctgaagatcacacactgagtaggtgcaggcaggggcctggatggtgatgaaataattattccccttcatccctgaagatcacgcactgagtaggtgccggccggggcctggatggtgatgaaattattccccttcatccctgaagatcacgcactgagtaggtgccggccggggcctggatggtgatgaaattattccccttcatccctgaagatcacgcactgagtaggtgcaggccggggcctggatggaagcctttcaggctttacagttagtcctttttcttcctctgcgccctgctccctccctggacagtacagcgtgtctgtgatcccagttgttcacgctggaatcctcagagccagttttggtgttat

SEQ ID NO: 200529 - DNA, 353 bp, Homo sapiens
  misc_feature (12)..(12): n is a, c, g, or t
aaaaaagaaaanaacgtaaaaccaaaaattagccaggtgtggtggtttgcgcctgtaatcccagccactcgggcggccggggcctggatggtgatgaaattattccccttcatccctgaagatcacgcactgagtaggtgccggccggggcctggatggtgatgaaattattccccttcatccctgaagatcacgcactgagtaggtgcaggccggggcctggatggaagcctttcaggctttacagttagtcctttttcttcctctgcgccctgctccctccctggacagtacagcgtgtctgtgatcccagttgttcacgctggaatcctcagagccagttttggtgttat

SEQ ID NO: 200530 - DNA, 200 bp, Homo sapiens
aaacaacaatagctatgacgacatgcggctcatacaactcaccttggaaagactgaagtgctgtatgtacaaaacacaagagtcagagttggctgaatcacctgttcccaaggtttaagaggtcagactttcaaagcctaatttccttctcccagagcctaaacattaccccaagttacatttgatgttcctctaagtgg

SEQ ID NO: 200531 - DNA, 342 bp, Homo sapiens
ctcatctgttttttgttaattcttttctgttttcttttgggctaatgaatgttttttagcattgcattttaattcctctattgaggattttcaaaaaatatatcaccttttgcaacagcatggttccattcacttgctttcatcctttgtgctgttgctttcatgtatattacattatgagcctgcgaatacactgtgttaggccattcttgcatcgctatgcaggaataactgagactgggtaatttataagaaaagaggtttaattgaatcatggttctgcagactacacaggaaacatagtgccagcatctgcttctgaggaggtctcaggaagctttt

SEQ ID NO: 200532 - DNA, 470 bp, Homo sapiens
gtgaactgagatcgtgccattgcactccagcctgggtgacagatcaaggatctgtctcaaaaaaaaaaaaaaaaaaaaagattatatttgtcgttgggggaaaaagggaagcaaatgtagagcaggggaaaggaggtcaggagttttgaaaactaagatgtcgtgttaacttctagggtgagagaaagccttgttaaagcctgaattccaattctgtctctgcagcttccaagttgtttgaatctggtcatgtgaaaacctatttaagccttggtttccacatctgaagaatggaggcagtagtatgaaattcatagctatcaattattgagtgcttcatatgtgatagtgctgagcactttgtatacatgatctcattcttaataagaacccagtgcatacttcttgttcaccaggtctgaagaaaaatataaaaaacagtgaagtgggtactgttactacccccattt

SEQ ID NO: 200533 - DNA, 125 bp, Homo sapiens
ccttggctctgcctcttcgtcgtgtcctccccactgacccccggctaccactggtcttttcactgtctccgtaagtttttcctttttcagaacgccatatagttggaatcataaagtatatatag

SEQ ID NO: 200534 - DNA, 251 bp, Homo sapiens
gcagtatgtggtcaggtagaactgcatgatttttcttgagcatgcatttgacaaagcctgttcctgtcccttctagttctagtgcagtgtggttttacatcctgtaagaattattttgtatgcttcctaatttaacttcatccttttaatatcttcttttgtcaggccagacttactgttttgatgtttaattctatttctcaagtagccatccatccaatccaatttgatgcctacagcaggtttaaaga

SEQ ID NO: 200535 - DNA, 612 bp, Homo sapiens
ttaccacctatatgttgcttactccaagtctggatcttcaataactcaactccatccattttatggcacctctagctgaatgttccacagttcctttgaacccagcgtgtccaacctaaactcattgtctgcccctatgatctgggatacttctcatttgtcccattgcagatggccaggccaccattcaagccctagtcacccagaatggagacccgggctccccccttcttctcatcccccatttctaactactttagctggttttattttcccccatattcccaccactaatgttctgattcagaccaaactcctaacaggtctcatctgtctcattttctggttctcaaatatgccctttcagggtctctagagtggtcagtgtcaaataggaccctgaccctgtcactgtcttcaacctcacattcgttgggggcttttcctcacctacggcatagggctcttgcccttcagtaaggcatgtgcagctctcactgctcctgcctcatattttccaatacagaaaacctcgggtgtttatagttctctgcacctattctacatgtgagcctctacccactttttactcccaataccccaattttggct

SEQ ID NO: 200536 - DNA, 1086 bp, Homo sapiens
tgaagaggaagaaaggtcagagataaggctcctgccataatccaggtgagggttaatggatcagataagtggtaaatcacatgggtctggattcaggattcactttttgtaaagagacagctagggtttctttttttttttttaacgtggaatttcagtcttgttgcccaggctggagtgcgagggcgcgatcttgactcagtgcaagctccgcctcctgggttcacgccattcttctgcctcagcctcccgagtagctgggattacaggtgccagccactatgcccagctaatttttttgtgtttttagtagagacggggtttcaccatgttggtcaggctggtcttgaattgctgacctcgtgatctgtctaccttggcctcccaaagtgctaggattaccggcatgagccaccgtgcccggcctatatttttaataatgaaatcagaactaggtttgtaaacagggaaagaacaaataatcataaaagttttatattctggatttggaagttggttgatttaagagtaatgagaataaataatatcccctccccctttagttctcaaggttttccacttagtttaagtagttttattagctatagtagagtaactcagcattttgaaatatttgtataatttgaaaagtctctgaaagaacactgtgattcgggtatagcattgcaagtttgaggggtttcaacagatttcttcatgtgtgtttaattccatgatgatttaaaaaaaaacccaagaaataaaacctctggtcacttaaccagcattttattttatttatttttattttattttattttttttgagacggagtcttgctctgtcacccaggctggagtgcagtggcgtgatctcagctcactgcaagctccgcctcctgggttcaagcgattctcctgcctcagcctcccaagaagctgggactacaggcgcccgccaccacacctggctaattttttttttttttttttgtatttttagcagacatggggtttcactgtgtggtagccaggatggtctcgatctcctgacctcctgatgcacctgcctcggcctcccaaaatg

SEQ ID NO: 200537 - DNA, 469 bp, Homo sapiens
aggtcagttagaggacaagtaaaatcaaaatgtgcatgttctctacaggggaatttccctactgaagagagctttgcttgaatggctgaaatacagtgtaaatgctggggcttatcgtgttgacaatatgcagtcagcatgcaattgctgtggttgctgcatcccgaggacatcgtcactttcttgactacctagcctgcctcaatagtacttgtcttgatttattctaaattatcaaccctgagactcagatttagctgttatgtcaacaatgtcaacagtggaaaagtcaaaatttttaaatcaaacatatttgagcttgttgggtcactagctgtgtatccaagagaaattatttgacatccctggagcttcaatcttcattattaatataaaacactatttcccctaaggctactttaattcatgaatgatagctataatacttgtctaagtattaaatattaaa

SEQ ID NO: 200538 - DNA, 522 bp, Homo sapiens
actctcctacgaacagactaattatgagtaatgagatggaatttgcaaaaaaaagtctcccatcaaaagcaaaaacaaaaaaagggcccagctaagacctcagaagcaccatcaaaaacaaaaaatagacaaatggctgggtgtggtggtcctgtgtgattagtctagggagactgggcagggagaacagtaagtttttcaccatgggtgatccaaaacttttggttgtaaaatcccatagatacttactgctgctcttatcttcactgattatctggacagctttaagaacaagtagtctagtgaagcagggcagataccacccattcccagcaatctcttttgtttgcaatttcaattcattttccaaattgtggatagttttatgaatttctttgagaaaaagttgaaattatttcataatgaagacgagtcagagagaaaaggattagcctagcatttgtcctctttatataaaggacttcttatagcctgattcctaatgcagagttcaggtaggag

SEQ ID NO: 200539 - DNA, 621 bp, Homo sapiens
ttagtgtactaaattgatgtacttaatgtcctaagctatacattttaaatagttaagatggtaattttttgttgtgtatgtgtgtgagtgggcccagaaagtgttaagccaaccatttgacaccgtcttggaattagcccgcttccttgtaaaaagtcactatataggcaccaagtcaatggcagctctaactgtaatggcagcagcaccagcaggaatgaaaggaattacccagccttctgcttttatacctacagctgaaagtaattcctttcagcctcaggtgaagactttgccatctccaattgatgctaaacagcagttgcaacggaaaatccagaagaagcagcaagaacagaaactacaatcccctttgccaggagaatctgcagcaaaaaagtcagaaagtgctacaagcaatggagtgactaatcttcctaatggaaatccttcaatcctttctcctcaacctattggtatcgttgtggcagctgtccctagtcccattccggtccagcggactaggcaattggtaacttcaccgagtccaatgagttcttctgacggcaaagttcttcccctcaatgtacaggtggtcactcagcacatgcagtctgtgaa

SEQ ID NO: 200540 - DNA, 614 bp, Homo sapiens
ttggaaggagctgaaccttctgggcagcttcaaaatattgatgaagaagttatctcttctgcttgccgtcttgtgtgtgagtgggcccagaaagtgttaagccaaccatttgacaccgtcttggaattagcccgcttccttgtaaaaagtcactatataggcaccaagtcaatggcagctctaactgtaatggcagcagcaccagcaggaatgaaaggaattacccagccttctgcttttatacctacagctgaaagtaattcctttcagcctcaggtgaagactttgccatctccaattgatgctaaacagcagttgcaacggaaaatccagaagaagcagcaagaacagaaactacaatcccctttgccaggagaatctgcagcaaaaaagtcagaaagtgctacaagcaatggagtgactaatcttcctaatggaaatccttcaatcctttctcctcaacctattggtatcgttgtggcagctgtccctagtcccattccggtccagcggactaggcaattggtaacttcaccgagtccaatgagttcttctgacggcaaagttcttcccctcaatgtacaggtggtcactcagcacatgcagtctgtgaa

SEQ ID NO: 200541 - DNA, 470 bp, Homo sapiens
tggaaaaagcaccatttgattggttaaaagccatcatagaagtattcactctgatcatagattctatactgaactggcagctcagtatagaatttgtctcccactgttatcagcaggtttcctagaacctgaaattagggtgctgagagtcaagtcagttgggtttagctcctgtcagaatcacagttccttgttctattgtagaccagaagtaattcgtacatcgggctggactgtgtctaaaccagcacagatatgaggaattttttctgttttaactatccccagaggaggaactgtaactaaccctttcaggagatcttttctctcaagtctaaatcctttttgctattaaggaaaaatattttcagaccagactttgaggctcatgcctataatcccagcactttgaaacttgaggccaggagtttgagactagactgggtaacatgatgagacactgtctctac

SEQ ID NO: 200542 - DNA, 689 bp, Homo sapiens
aataactcagtcttacattccctgctgtgctgttgtcttcttaggaatatgacactcaataacttagtgcatggaatctagcacttataaaatatttttgcaaaataacctcttatttataaaaacaattgatgtcaattaagttggtagacctcaaagatttttttttctttagccttacatctaggctataaacgtaagaaatgagggacaactttgtttttggtggcttacctgctaattccctttccttttatttccttcaattctaattaaatggtttataaacagtagtgtgctggtaagttaactcttgaaaacaaaaattagaaaacagcctggatttgtagctttctcacatttctgaggtgtaaatagtcccacaatggctgacttcaagccattactgatggcttcataatgtggtattactgaaaagggagttgggaagagaaatgtacaatctgctctcccgagaaaggttttcatttttatactgtcctccctttcacacgctcagtcatcaatgcttgtcttttattcttgtaaataaattttacagttattccttttattccaagcttatcattactgccctagtttaaactttgaccatcttttgctgttattattttaataacatttcaaatactgagtataaattcggttcagtgtttgggtgatgggcg

SEQ ID NO: 200543 - DNA, 496 bp, Homo sapiens
ctgtttttaccttcattgaagccgtcacctcatcatcttaaaataagctgacatatagatttatcatgtgctggaggagattccagggaatcaggaaaatcttcggtaattggtccattctgattctccatgttatacccctcttgccccttcctattccttgaaagctggctattccattcagatgggacactcatcccctaaggaaagctgcataaaaggaatttaattacccttttgggaaacataatacatataactagtaatacataaagctaataagaaagtgaaataataaaaaggaaatacaatagaagaagtccacctccctctgggccctcatttcctttctcataggtaaccactattaccagtttctagactacccttccaaagataatttctgcatatacaagcttatgcatgtgggcatatgtgtattttttaaacctaagtgtcagcatgctgtatactaacttcatacattgctctttac

SEQ ID NO: 200544 - DNA, 360 bp, Homo sapiens
tatcatgttacggtttgtggtgaataggtcactacgcagtggaacgtatggtttattagtaaacactgacaatgagatgaggctgttcctgggggtgtcacagtagattgaaggctggaaaagataggaaaataaggtgggtattcagagagagaagataatgaatagggagtgtcagaatgccagcatcatttgcctcaaatgccacttgttacgtgcttccactcttttattctctctgaggacatggtcaaagtgtcagtgtgaataaggtagttaacttaaaaggtgtattagggctgggcatggtggctcaagcctgtaatcccagcactttgggaggctcaggtaggcagatca

SEQ ID NO: 200545 - DNA, 452 bp, Homo sapiens
tgatggcaaaggaggaacaagatgagaagcagatcatgggaatgagagtgctaaagatacttgtttatttgtatagaggaacaggagctagaagttgttatgatagaggagaaaaaactttgagctcgggatcagacagatctgaatccactctgggttgaaattcttcaacccagaaattctctcatctcttaattaggaatcaggaacacccacttcagtgctgtgaagacttaactaaaccaagcctgtgtttaactctggcccatagtaaatgatcaaaaacttttattcttttccttctaacttcagcatagagactttaacaaagttgtgggtagaggaggaggtgataaagaaacatacatagaaaactattaagagaaagcaagtaacaaatttcatttgagaaaaccattccagtactagggcaaaaaatagagaagtctgca

SEQ ID NO: 200546 - DNA, 153 bp, Homo sapiens
gctcttcacacgtcctcccctcccaagctctcaaatccacctgaccaggctttctccctgctctaccaaacctgacctgaagatcgacctcagggtcacccacacgttcccacttttttttgttttgttttgttttttttttgagacagaatc

SEQ ID NO: 200547 - DNA, 771 bp, Homo sapiens
agacaacatctctaaataaataaataaatataatgtaaggcaaggccttttcccttatatctattttagggtttacccttgtgtatacagaaaaattgttccctgtccagcttattatgggctggatagcaggcagaactcctcagtttgggttagcattgcattaacagaactgccacatctttctggataatcttcctttgtgcataagctccaggctcaccttctctgcctcacagctgtgcgctggtttcccttagctttcttgggttctggatggatactggccttctgggtgagaagggggttctttggcaaaaggtgtttttgacataatttaggaccttcttaagttctacagcagacctaaatttcttcccccaagttctttgtctatatagagtactcagcactcattacccattctcagttctgaaggaaatcttatggagcagttgtagtatttatagggtaagcagagtgcccagtttccatgccccaccccaaaccatttagatttcagtcatgtatgtcaagggaggagtgagtacatttttgtggtcagctgcctcttcttttccctaacattctcactttttcatctttcctgctttcttgaggtcatttatctattgaataggatgtctattgaaaggaaaaacctcccctaatcgcctttaaactaatatttcttactgggcatggtggatcacctgaggttgacagtttgagaccagcctggccaacatggagaagccccatctctactaa

SEQ ID NO: 200548 - DNA, 174 bp, Homo sapiens
caaaccaggctgtccccgaggctctgattcacagctatttaccaacaccctgaatgtgttatctgaaacagcaatcaggagagaaggctacacgaaaatctagacaggtcgcaccttcttcaacgttttgaattgcaaagtaagaggtgacaccagcccagggaggtgttgtga

SEQ ID NO: 200549 - DNA, 398 bp, Homo sapiens
ttccttcaacttcagattgctatctaatgaacacaatagatttccataacatattttaatatcagtaagttactactctaacttccctattcctatgaacaatgaaggtttctagtttgcacaactggatttgataaagccattctctccacatttatcttcagattcaattggtccccaagtcctcacttctaaatcatcagaacacctagcacctacctttttctctacctacaccttagcttttatcttccttatacttgatccactgcttttgacaggtcttcccatcctcagcctttccctcaaaagtgtcaccatttgtcttttaaaggtacacttctgaatattactttaaaatgtgaagcaataaagctatcttacttttgggggaaaaa

SEQ ID NO: 200550 - DNA, 277 bp, Homo sapiens
gctaaacatactaacctttggggaaaggtatgtccttcttgagggagttttcgtataaacaaaacttttttaaaaagtgaaaacagcataggggatggagtaatcagaggaaaaggaacattatgaaattaggcagaggttggtgaccgacttcatgaggtttttgtttgctggatagagctgggctaaatgtttgtctcacagccttttaggcattgaaaataggtggcctgactgatttaaacattcttttttatctaggagaaacagttatatt

SEQ ID NO: 200551 - DNA, 662 bp, Homo sapiens
aaaagtggtaaagcagtgctttaatggtcaaaagaataaaagaatttgcaattaagattttcgcctacttcaggaatatgcctcagaaacacacacaggcactgactctccgctgtcatgttttttacccagtccgcatgaacattttcaaaggtctggaaggggaaaagtatttcttctctaaccttcattgcctcaacagctgaaactcatcagcaggtggggtagataggtgtttaaactctgtctgagctgagcagaataaataggcagcctggctttaaaaatacaaacagttaaatttatatcaattacgttagagtctgtaatttactgcagatccaaggaggagaatgaaatcaagactggattgaggagggatgtcaacagttgaatcagagtccatccacagaaatgttctcttataagaaaatatgtttcttgctgcccacggatctcccaccacctccagcaccctgccaaaaacaaaagtccctgcatagacatggctgagtcagacacacagccatcctcttccagccatcaaacactgatctgctcaccttttctccaacacacaaatgctaatcatcaactcggtcatgttctttccttttcttttttaaattcttgccaaggccgggcgcagtgactcatgcctg

SEQ ID NO: 200552 - DNA, 428 bp, Homo sapiens
ttaagtggggtggtggtggggggaggggagaagtttgaggaaataaacctttctagtttgaatgaacaaatgaacgaatgtgtgtataatcaactctcgataaaatctggttggtaaatgagcaaatctggaggttgtcagagtatatatctttttttccctgatactgcttttactcactcttccttttactgtcaactgatttttccattactgtccattgatttttgatgataaaattttgtctttcaactcaacactctaatgagagaaaggtaaacctgggtaggggctggtaggagtggtgaggcttggtcaaattgtggctttcttttgacatttgattgagagttgattgtaaggtgtgcattttaatggacttctttattttccaaataccgtttctgtaaacctctctgaccttgatg

SEQ ID NO: 200553 - DNA, 379 bp, Homo sapiens
tcttttttgtttgtacaatgagaatttattcatgtgtttcgtgtgttattttttaaaaagtgtgttgtccttgcctttctgggggttattttagtgaaggatttatttagctgcagggttggtgccaaaatgggtgataaagactagccagccagaaaaggtgggcattatactgctgagaaaggaactaggagcttcagtcaggtctttgggtctgagaggtgacttgctgaaattaatattaaatttaaattaatattaaatattaaatttaagaagagtaacccaaaggcagtatgtgagtataacttggagatcccagaaagaaggaaataggttggaggatctagtgctccaagaggggcttcctgggtcgagt

SEQ ID NO: 200554 - DNA, 705 bp, Homo sapiens
caggatcttgccatgttgcccaggctggcctggaactcctgggctcaagtgtttgttctgcttcagccgccagagtagctgggattataggcatgcgctgctgcacccagctaagagtacagattttggaaccagacttaaatttatttcttctctgtgacttactagctttttaacctcagttttatctgtaaaaaggtgatatgaagactgaaggagttaatacatataaagtatatagaatagtgtcttgtcatagaaaagtagcgtttgctcaaccattattgcactcatcaaacctaagaaggccaggcacagtggctcacacctgtaatcccagcactttgggaggccaaagtgggtggatcacctgaggtcaggagttcaagaccagcctgaccaacatggtgaaaccccatccctactaaaaattagccaggtgtggtggcacgcacctgtagtcccagctacttgggaggctgagacaggagaatcacttgaatctgagaggttggggttgcagtgagccaagattgcatcattgcactccagcctggatggcagagtgagactctgtctcaaaacaacaacagcaacaacaaaaaaccctaagatgccaccagttataagactcctgatttcagagatgctaaaaggtgaaaaaaaagaattgatgaggctgggtgcggtggctcacgcctgtaa

SEQ ID NO: 200555 - DNA, 195 bp, Homo sapiens
actttttgcctttgctgtgaactagtgttacacaaatgaggccccatgctttatgttaccctgcaacacagttactgttgaaataaggaaggtgtgtggaaatgtgaagcaagtgtgctgtgacaaacatgtcgcatgtgtgatataagagactgggtgccgttgagtcacaaattatggttggtgagaggcagt

SEQ ID NO: 200556 - DNA, 316 bp, Homo sapiens
cagctttcaggcagcatttggtgttcttttgaagtgttttggtcacttccttggcttcttagttttccttctgcctttctgactctttcagcctcgcatcctttgcagtcgcctccttctctaacctgaacatcctcaaggctttatttggacttttctccttccttgttcctcttttttctctccttatgctacatcatctgtagtccaatgactcccgaaatttcgtcttctacccacactcctctgagttctgggtatccaatgcttgcttgacatttttgttttatgtctcaaagataacccaagcttgcaa

SEQ ID NO: 200557 - DNA, 375 bp, Homo sapiens
ctagcataaattctgtaaaccaacctgatcggaaaaatgttttctctttgctttgaggaagttgcaccttttctgctttttaaagtcagttgtgaactttggaggtaaggtttatcttatcctatatgcttgcctgtgtcctgaggagcataacctcttatctgaactctccaggatagctattgatttcatacacccacatactctccctttccccttttgcccactttttctcttttcttcttcaattgccctttcctttttaaactttttttcttacacctaattgtcagtttaaggatctctatttggccttgcagttaacagtccagcatttcttttccaagtgtgaccccactttctgccccctgatta

SEQ ID NO: 200558 - DNA, 514 bp, Homo sapiens
aaggaattaactgtgttgcaaatggccagtaacagacaagaagttggttgagggggtttagcaactgtgcaaaaaaaacagctggtttggacagattctacccctcccctgcaaactcaaacacactgcacctaagtgaataggagcttaaggatgaggcaagaataactgcttgtcatataagcacaaattttgagagtgactaccaaaatactgaatacgagatagaaatataacaatctatcattcacagtccacttggcaagaaagtacaaggacgaggaaaaccaaatcactcagccaaatgaggaagggaggctaggaggtgacaatcagctagtctgactgtgaagcaaaagggaaaggcacaaccacagaatgaaggtcaaacagggaaagactgtgaatacaaggctaaggagtcagactgctagaagtagttctatgtgccgtgtagagttctatctaagccgaaagacatgttcgaagaggtatttcaagaagacaaaaattc

SEQ ID NO: 200559 - DNA, 286 bp, Homo sapiens
atttgcaagccacatgggaaatataattctcataactctcttgaagaaagcattactgatttagttagtggtagagagttgctgattccttgatttattatactaatttacagtatttttgtttttcagtagtacatgttatttccagactgctttgtagaatcttgtttctatattctgcagcacgcatcacctgatgtgagttcaaaggtttgactatgtagccctaagatatattacaatcaagtaagtggtatcttaattctataaagcacgtttatcccaa

SEQ ID NO: 200560 - DNA, 499 bp, Homo sapiens
cacagccatcgtgtgaggtatatatgatcattggccttaatttaccaatgaaaaaatagaggccgcagctctgctttaagccagctagtggcagagctcagataagaacctaggcagcctgctccgtggctcgtgcttttagccactaggctttgctgtgtaaatatgacacaaactgataaacaagagggcaaaaagaaagcgttgcaggctgggcgtggtggctcatgcctgtaatcccagcactttgggaggccaaggtgggcggagaatcacttgagctcaggagttctagaccagcctggccaacatggtgaaaccccgtctctactaaaaaaatacaaaaaattatccaggtgtggtggctcatgcctgaagtcccagcttcttgggaggctgaggcagcataattgcttgaacctgggaggtggggggttgcagtgagcctagatagtgccactacactccagcctgggtgacagagtgagactctatctca

SEQ ID NO: 200561 - DNA, 493 bp, Homo sapiens
ccaggatatatgaagtcattatgactaaaaaccacgtattatgtgcatcatattcttaattttattttaataattaattagtcttcctcatcatcccacaagtatatcacagaaataaatacagtctcctctcagctctcattatttttaataatgatctccttggtactaaagaagttgaagattacaactcagaaatgcaaaatgttgggccaggcgcagtggcttacctctgtaatcccaggactttgagaggccgtggcagaataatcacttgagcccaggagtttgagaccagcctgggcaacatggcaaaacaccatctctacaaaaaatacaaaaagtagccaggcatggtggtgggcgcctgtagtcccagctactcaggagcctgaggtgggagaatcacctgagactgcaaggtcgaggctgctgtgagctgtgattgtgccactgcactccagcctgggtgacagagtgagacccatctcaa

SEQ ID NO: 200562 - DNA, 1025 bp, Homo sapiens
ggtgctgcccaggatcaggaggctgagacgtgatctggaagtgagtgcccatccatacaccttccccagctttggggccacagagggacagaaaccgcaggcaggctggcctgggaatgaacctacaccagcctgaagtcagaagagcctctaggagcctccagcctggactctttttacagatggggaaactgagtcccagagagggagcaatgaaggatgtctaaggtcatcagcaacgtaaagccaacagcatcatcctgagtcatgtttgaacctgagggaaagaaacatatgttcgaagaggttctgaggctgctgcacccgatatcgtacctggttggccctgggaaagggcccacctccaatacataaacacaaccagctttgacagtgagccctgaagcatggcattgagaagctgcctaagaaggaggcagatccatcagcctgggtgcccgactgattaccctgagcagagctccccagcccacctgtgatggacgcatggagcttgagcaaggaataaatattcgttgctggactctgattacactggacctatccaagatctgagatcatcaactcatctcaaaatccttaagctgaccacagcagcatcgtcccttttgcagtgtaagggagcccagctgggacaatgtgtgaatcaacgcatgaaggagtgagtgagcagctaaccaaatgaaagaatactcagatatctggggtacagttcccttccaggtttgcacagcatctgctgaagtctccactagaaactcaatggaaggtccccaccggaaactgaaagtctcctagagtggctttgagttgcggtttcaccctccctgcagatccacaggggaggctggggcagatggaaaataccaacttgatggtctgtggccacaccatgctgctccccaaggcccctcagaatttcacttgcccaatatggtagcgcccagcctgaaacgtggccagtgtgaattgagatgggctggaaatgcaccagacttccaaga

SEQ ID NO: 200563 - DNA, 933 bp, Homo sapiens
ggtgctgcccaggatcaggaggctgagacgtgatctggaagtgagtgcccatccatacaccttccccagctttggggccacagagggacagaaaccgcaggcaggctggcctgggaatgaacctacaccagcctgaagtcagaagagcctctaggagcctccagcctggactctttttacagatggggaaactgagtcccagagagggagcaatgaaggatgtctaaggtcatcagcaacgtaaagccaacagcatcatcctgagtcatgtttgaacctgagggaaagaaacatatgttcgaagaggttctgaggctgctgcacccgatatcgtacctggttggccctgggaaagggcccacctccaatacataaacacaaccagctttgacagtgagccctgaagcatggcattgagaagctgcctaagaaggaggcagatccatcagcctgggtgcccgactgattaccctgagcagagctccccagcccacctgtgatggacgcatggagcttgagcaaggaataaatattcgttgctggactctgattacactggacctatccaagatctgagatcatcaactcatctcaaaatccttaagctgaccacagcagcatcgtcccttttgcagtgtaagttcccttccaggtttgcacagcatctgctgaagtctccactagaaactcaatggaaggtccccaccggaaactgaaagtctcctagagtggctttgagttgcggtttcaccctccctgcagatccacaggggaggctggggcagatggaaaataccaacttgatggtctgtggccacaccatgctgctccccaaggcccctcagaatttcacttgcccaatatggtagcgcccagcctgaaacgtggccagtgtgaattgagatgggctggaaatgcaccagacttccaaga

SEQ ID NO: 200564 - DNA, 128 bp, Homo sapiens
tttggagacagagtctaactcttgcccaggctggagtgcagtgacatgatcttggctcactgcagcctctgccctctggattcacaagattctcatgccttagcctccacagtgaaaaccccatctga

SEQ ID NO: 200565 - DNA, 255 bp, Homo sapiens
tgctgggattacaggcgtgagaccccgcacccagccttaattttttttttcttttggtaaagatgatgtcttgctatgttgcttcggctggtcttgaactcctcagctcaagtgatcttcttgtctcagctcccaaagtgctgggattacaggcatgagccaccgcgcccagccggctattacagttttaactttcagagacaagcagcttgtattctagatcattctacaatcaagaactctttctactttacc

SEQ ID NO: 200566 - DNA, 349 bp, Homo sapiens
gtgtgtgtgtgtgtgtgtgtgttgtgttgacaggtgatacaaaaagtcattttgcattcttaagatcaaaacacgttctctgactccccaaagtaccttcgcccatccttgatcactcactgccatcttgttctgtctgagctcttaccgccacctgaaattatcttgtgcatcatttgtttacttggccactgccagatctctgtgagatctggaatcttctccctccatccctgctgtatctgactgcccctggccctagaaaagggctcaggactacttgtaaaagaaagcaaggaaggaaagaagagaggagggtgtttgttgagcacctactatatgctctgtg

SEQ ID NO: 200567 - DNA, 658 bp, Homo sapiens
gaagagagccagaggaagatgtgactacagaagaaggcacggatgcagcattgctggctttgcagatgagggaaggaggccttcagccaaggactgtgggtggctctagaatctttttttacatctcagtatgtatgccacagttaaggtttttgtttttttatttttgagatggagtttcgctctgtcatccatgctggagtgcaatggtgagatctcgactcactgcaacttccgccgccggggttcaagcaattctcctgtctcagcctgagtaactgagattacaggtgcgtgccatcatgcccggctaatttttgtatttttagtagagacgaggtttcaccatattgatcaggctggtctcgaactcctgacctcaggtgatccgcccacctcggcctcccaaggtgctgggattacaggtgtgagccactgtgcccagcctcacagttaaggtttttaaacaatctgatttaactgaataaaaaatgctcgcttgtgtggcgacatggtttttaaaaatgtaaacagagctgggcatggtggctcacatctgtaatctcagcactttgggaggccaaggcaagagaactgttgaaggtcaggagttggagaccaaccagcccagggaatatatggggagaccctatctctt

SEQ ID NO: 200568 - DNA, 777 bp, Homo sapiens
tcaccacacagggctcctgagtctgacccctgcgctgtacacggcactgttcatcacacacgcggctccagagcccgacccccgcatgcacacagcgctgttcaccaccgcatgtggctcctgagcctgaggaggagcgtggtggcaaggacagctaccatgagtctgcaagcagccaggtacccttctcctgggctggagccagtgtagaggacggggactctcagctctgccgtgacccccgtggtctcccaaggacaagcgccattcttgagggacgatcacagcttctcgccagactccctgatgaggtcagtcacgcgctgagaccagagcaggggcatcatcctcgtttcttgcacagtaaacgcagctgtaacatctggaccagtggagccagttgtgggaatccataggaatttgagtttcagcgattgttccaggcagcgttttcccaggaagtgtttaccagttgtccacgttggggtatgaatgagtgaagcttcatgaatgtaactttgaacacttgatcagaaagagaaaacggatgacatgtttctgataaatcatgactaagatgattttttaaaatatcatttaaacaagataagtatcgaggaagcttccatttcaaaccaactccgcaggaaagttttagggtgaatcaaacatctttttctgtagttgagttagtaactctaaatatatccatttggtctttgagaatgctttcatatcttttttttaaaagtttttaattttcaaactttttaaaaa

SEQ ID NO: 200569 - DNA, 636 bp, Homo sapiens
cagctgctcttctgatataaaccactctgagcaaatcccttacttcctgtccgtgttactgcatctgaaacatggggattctactggtgatctcaaaggggagacttcaatgagaatgacaaacatacggtgctaggtacctacaggcactcagcaagcaacgatcgtcccccggccaacctactttacagtcactcaaaaagtggctgagacaggaaaggagtggtacaatcttttggccatggtgaactgtaaaggtaactgtgtttgttttgttttgttttgttttttgagacggactgtccctctatcgcccaggctggagtgcagtggcgcaatctcagctcactgcaacccccgcctcctgggttcatgcaattctcctgcctcagcctcccaagtagctggaactacaggcacaaaccaccacacccagctaatttttgtatttttagtagagatggggtttcaccatgttggccaggctggtctcaaactcgtgacctcagaagggtaattgttagaacctatccactaattctttccctaacccctaaatcaggtagagattctatttcaaacgagggtactttgactttgcagtgttgctatgttccctgatgcttggtaattacc

SEQ ID NO: 200570 - DNA, 280 bp, Homo sapiens
attaactagacatcgaaatagagatatcagatagacagctggatatgagagtctggtgcccaggagagaagactggacatcaaattcataaattttaggaataaatatatttattttaggaataaattaatagtgattattcaggaatctctaatatagagatggaatttaagctatgagattggataagatcacaagacagtgagtatacatagagaagagcagaccaggtactaggtcatgagttttctcttggagaacacaagaaaccattgaagaa

SEQ ID NO: 200571 - DNA, 562 bp, Homo sapiens
acaccaggaggctcagagcaaaggctactcaccaactgatgggacttttcaatatttcaaccattggtgtggttgttgtcagtccatactgggtgaatctcagtcctgattttatctgaaataaatccacgtggttagtttggttagttctcattatagaagcccctccccatccccaaaacttctaattatggaaacttaaatacataaaagttgagaaatagtacaatgaagccaagcatggtggtgcgcacctgtggtcccagctactcagaaggctgaggtgggaggaatgcttgagcctgggaggtccagggtgcagtgagctatgattgcaccattgcactccagcctgggtgatagggcaaggccctgtctcaaaaaaaaaaaaaaaagaaaaaagaacaccctcattttacaattaacattgtcatatttgccttctctgtgtgtgcctcttaagtgtgtgcgtccgagcatgcactttatgagccatttgaaagtacgctgcaggcatgtttcacccctaaatactttagtctgcatctcctgaaccacaatg

SEQ ID NO: 200572 - DNA, 555 bp, Homo sapiens
gagtaaaggcagggttgtggatagacatagttgatttgtagggcccttgtttgccaagaatagtcctgctttacccctgttgtcctgatgtaattattaataatactgcctcattcagtcttaaataagtcttggatttggactagaaattatatggctacctctttatgtgggaactaaaagtaattcattgagacaggaacatagaggtgaggtgccaaaagaaaaagctagaaaggtaagttttgatcatgttatcaagggcattgtaggcaggctaaggagtgtggagatagtgggaaagccgtggatggtttttaatgaggggaatgataaaaatagagatatattttaaaaataatctaggaaaagagtggagaatgaattggagtggagtgatcagagatggggacaatagggaaatcagagaaggccaatgaaataattaattggtgagatagtaaatttttgttttttaaaaatatgtttcataaaatataaatacaaaataagacactgggcccagcgctgtggctcatgcctgtaatcccagca

SEQ ID NO: 200573 - DNA, 458 bp, Homo sapiens
acagaataaaagctacaggttgaaaccaattccctttaaaatgtggacagttgaccatctccatgataggtagttaggcactgaattaatgctttttaatggaagagccaccctaagattcctggagtgtggtataatggagtactaaatcagcataggactaataactgcctcccgtgtaaactggtctatccggagagtggtatagcctctcatacagtgttcaaaggcagatttaactcactgcaggtccacagcaaccgataagataaactcgttggttatggtctcccactttgcaaaggagagcacagaggaagaggaaactgagataacttggtttaggaccccacagctggctggagctgggctgaacattagttcattgtttcttcgattaatctatgctgctttttctctacttggctccttttctaaattaaacaaaacaaaacaaa

SEQ ID NO: 200574 - DNA, 573 bp, Homo sapiens
ttttccttgtctgatgtgtgctcatctcctcttcctctaaggacaccagtcatatcagattatgacccactctaatgacctcattttaacttaattacatctttaaagaccctatctccaaatacagtcccattctgaggtactaggagttaggaccttaacctgtaaattttaggggacacagttcagtgcataatgcacacatatgctcttttcactggacagcccaaagggaatagtgccacttggttgggaggaagcagtgtgtgaaatgccgtgattcatattctagggagttaaatgttggcacagttccacttgcctccatcaaatgggaatatgtgggaaatgctacaatttgccactgtttctcatttagaaagacagtatcttgaaatttctcatttttcattttaaaggaaaaaaatctttcaggactaacctcccttctatgaaaaagaaagatggcaaagaccatgctggatcagaatggtgcccatgcagtgtagctttctatcttggagagagtattggggattaatctatggaaaaaacagttattcttatgacagt

SEQ ID NO: 200575 - DNA, 800 bp, Homo sapiens
aagcgatccacccactgtggcctcctacagtgctgggactacaggtgtgaagctctgccctacagcccttttttaaaccccaggatctaatcagggagccacactgtgcattcaggctatgcactttttttggcaggataatatactacatagagcatgttttatcttgttagaaggctgtcaacctgaaataaccaaacaggtcagaatttagcttaaagagagtttatttaagtgtataaagtttgaggacaggctgcctgggaagcacagattttaaagaatggaaatcagtattttgaactgtagatgtttgggatcatttatgtagacaaattttagggaagtttaacagaattttaacatctttttatgcataaagttataatctgaccagctgaggtggtcttttttaggtggaaggtatatttaacattttacactgaagatgtaggagtctggtctaagtacgggataataagagacaatctataataaagatcagtaattaaaaggggagcaggcctggtctgtggtctctcctagtcatttataaaacatgaatgataaagaaaaacagcctataatctaaaagacaaaattacaaacatgctatgtgacccagtttctaggacttaacttccctcttgacataataaatttatttatttttatttatttatttaaagacaggatcttgctctgttgcccaagttgacctaataaatttcaagagtcctaaaattttcttttttaagacaacatatcactgtgctccatgattgatagtggggctccgt

SEQ ID NO: 200576 - DNA, 309 bp, Homo sapiens
aaccacaattcaagactctgtgatagagtagcaggcactagcgcatctaacgcatccctgccagggatataatcaatgtggtggatttctacatcaggatactatcattaaacatggatttaatttgctttttataatacagtcagctttactgaaatagaaattcttttatccaggaagttgatggggacacagctcatgcaggatcagtttctagtgtaatgggttggtcaaaatcaacggtaagtgcgtctaggcaagcagctgaaactttgcattttcaagatcgtgctgctagatgatgctggg

SEQ ID NO: 200577 - DNA, 483 bp, Homo sapiens
gcgttgtctcggaggctgtggtttgtttaaaccgggcactggagggaaagcaggcagtgtctggtgtgcacaagcacccactgaaatacaaaccttagtgaacacaggtaacaccccttgatgtgtgctgtatccagttgttctgtgggattgacatgtgttcactcatttaagcctcacactaaatctaagatgttatccccattttccttacaagaaaaccgaggcatagggtccaactgggctggtgcacgagggaggactggaaacaggattctgagctcctgaccaggggctgaacttgtggctatttgtttatctgattagccaacaaatacctactttgtgaaattcttttttttttttgagacgaagtctcgctctgttgcccaaactggagtgcaatggcgtgatcttggcccactgcagcctctgcctcctgggttcaagcgattctcctgcctcagcctcctgagtagctga

SEQ ID NO: 200578 - DNA, 450 bp, Homo sapiens
tagctggagatttgtaaaatggaccaatcagcaccctgtaaaatggaccaatcagtgctctgtaaaatgggccaatcagcaggacatgggtggagacaaataaaggaataaaagctgcctccccgaccagcccatccccaccccaacaagccagcagcagaaacccgcttaggttccgttccacgctgtgggagctttgttcttttgctctccacaataaatcttgctgttgctcactctttgggtctgcaccacctttaatagctgtaacactcaccacagaggtttacggcttcattcttgaagtcagcgggaccacgaacccactagaaggaaccaactgcggacacagtgggatctcggctcactgcaacctctgcctcctgggttcaagcaattctcctgcctcagcctcccaagaagctggaattacaggcgagcaccactaca

SEQ ID NO: 200579 - DNA, 442 bp, Homo sapiens
tacctggcccggcttatgtgaagttacgaacatttaaatttaagttcttaataacacagaactttagatttttaatactgagcaatgagatattgtaacacagaatatgtgacacagaaagcactgatttaatatttttcattgtattgctatgcaggaagagaaaaagactgtattcaagtagatcttaggctagtgagaaaagttaagtagaatgtaacaatgacatttagcaggactagaacaagacacaagtattattcatcagtattttacagaaaataaaatgtattttttttgacacagggtcttgctctgtcacccaggctggagtgcagtggcacgatctcagctcagtgcaacctccgactactgggctcaagcaactctcctgcctcggcctcagcctcactacaggcatgtgccaccacgcctggctagt

SEQ ID NO: 200580 - DNA, 165 bp, Homo sapiens
gtagacctttgggttgtcccaccttttggctatagtgaataatgttcatatgaacgccagtgcccaaaatatctgtttaaatccctgttttcaattctttaggtgttatacctagtagtagatcatatggtaattctatgtttaactttttgagaagacaccaca

SEQ ID NO: 200581 - DNA, 1012 bp, Homo sapiens
ctccccccacttctatacttagagaggtggagaaaacaggagaagggataactacgacttttgtcctcaaataccaggaaaactagtaaaacacacagtatctcattttatgcattcatttgctgaaaatatttccaaagtttagaaaaatgatttttggatgtactatataataaataaaaatgcactcagaatgctagagtgtctaccaacttaaaagaacaatattatttgtttgactgtgattatccttaggaaaaaataagccctgatttaacttatcaatttctgaaaaaaatagtgtatggacgacctgtgtcagaattaacctaatttttgttaaaaacatattcccagaccccatccaagatacacagaattggaatctctatgaaaaccacctgaaaatttcctttttaataatctcttggggtacttctcgtgtgtgtgtgaattttttaagtcctggttgattataaatgataatacaacctgctcttttcattctgtcactgtgttgaaaagttaacaactctcagctcagagaattgtcagtgggtattggtaccaaagtcctctgtgggattttgaccagcactgaagcagaaacttggcgtccgaagtctgccaagtgcaagaactagagctgaaatgatgaagtgagggatggggacagcactgggcactgcccaaactttttgaaagctttcagaatgaaatggggaaatggaaactttcctctgtttgaaatataaaagacaaatgtgtactgaaggcaattttggcaactcaacttcacattgaacaagtgaagacaatatgagtttctccaataaaaactaaaaagctgttttcaaattgacctaagatgattgaaaatggaaaatatttgctatttggttattagtttgagagcaagtgccccaggaaatattttgcaatttaacttaaatggttataatgtatattttcttgaacttcattaaaggatttgtctctttttgcctttcta

SEQ ID NO: 200582 - DNA, 739 bp, Homo sapiens
caaaatcagcagcattgtaggcgtttgagcaggagagttgacaggatgaaatatggcttagttttagcaaactaactggttgcttacgttgataattggccaggagtgctgggagcagaattgacacatagaccaagctggaagttattgcatcaatccaggtgagagatgaaggttgctcgtaccagatactagtagaggacagaagtgattaggactgtaaatatattagattgatagatctaacagactttgctaatagattaatgtggaaagtaagaagagagaaaaggaggattaaagagaggagattaggaggactctaaagtttttggtttaagcaactgaaagtttagagttgccattaaccaagaaggaggagactgggtggcacaggtttggagacaataaagaattcagttttgactaccttccacgtagtaggtactctctgtgagcataatattgctgaatattaagttccaagggtatgagaaagctgtcatgagatggcctttcattgtcagactcatattgttcattaatcatgatttctcatttcgtcaacttgatgtttttgtattgtgttttgttttgtttttccttctctcttctcccctcccctcccctcttccgacagtgtctggctctgttgcaagctgtagtgcagcgatgcagtcacagctcactgcagcagtgacctcccaggctcaagcgatcttcccattcacttcagcct

SEQ ID NO: 200583 - DNA, 326 bp, Homo sapiens
attgagacacttgtcctcatcaagtttaagacacaacatagaagacagacatagctgggtgcagtggcttacgcctgtaatcacagcactttaggaggccgaggatggtggatcaagtgaggccaggagttcaagaccagcctggccaacatggtaaaaccccatctctattaaaaatacaaaaattagctggatgtgatggtgcatgtctgtaatccccgctactcaggaggctggagaatcccagctactcaggaggcaaggagaatcgcttgaacctgggaggcagagattgcaatgagccaggattacgtcactgcactgta

SEQ ID NO: 200584 - DNA, 137 bp, Homo sapiens
catattttcaccccccaaaaaatcagttaaatattgggacactaaccatccaggtctagaaaagtcacatgccatagccatggtattgcacatcattcatcttgcattctttgagaataggaagatcagtaaatagt

SEQ ID NO: 200585 - DNA, 212 bp, Homo sapiens
accagagtgtcaggaaagcaacagaaggagctttttcgttgtgtttggagcaagaacagggaaggccagcctacttcttggaacagatggcacactcctgacagatgacaggaagaaggcgaaggcagcagagcaagcagattctattctatccaccaagtatcactactaggaaactgcagcctctcagattttagttcatctataaaacg

SEQ ID NO: 200586 - DNA, 594 bp, Homo sapiens
cagcccacgtatccatcagcagtaaaatggatgaataaattgagttatgtttgctgtattgcagtgggttactgtgcaactaagaataagtagttgtgtgcaataacatggatagatctaccaaatataaagaagccagacacaaaataatatatacactatgatgatagcagttacattttataaaatacacatgcaaaaacaggcaaaactaatttatggtgttagagtatgagatagtaggtacttctgggaagaaaaaaaggagttgggagaatatataaaaatatgactaggtaaggccaggcacggtggctcacacctgtaataccagcactttgggaagctgagatgggtggatcacctgaggtcaggagttcgagactagcctgcccaacatggtgaaaccccatgtctgctaaaaatacaaaaattagctgggtgtagtggcacatgcctgtaatcccagctatttgggagggtgaggcaggagaatcgcttgaacgcgggaggcagaagttgcagtgagccgagattgcaccattgcactccagcctgggcaacaagagcaaaactctgtctcaaaaaaaaaaa

SEQ ID NO: 200587 - DNA, 278 bp, Homo sapiens
taatatttagaaatactaatagtagcaatatttaggatatggttttatagatgtaacacattttaatttgttattttgactttttatacattcacagggagttttaaagacagcctagagaggctgcttgtacccttcacccagttttttccattggttacacttgatgtaagtatggtaaaatatcattgcagaaaattgacattggtacaaagtgtgtgtatagtgtgatgccattttattgcatgtttagattctggttaccaacaccaaatgaa

SEQ ID NO: 200588 - DNA, 286 bp, Homo sapiens
atgccgtgaggcgctctagagatcccctgaagaggcggcatctcccttctggtgaggaggactctggaaagcagcagagctgcctaggcatcagcttatccaccaaacctttatgcagcgcctagtcattgccaggctatgacgaaatagagctaccaaaaggatgataattataagatcaattcaatactgttttcctttctgactatcaaggcatcagcattctgaaaatccagccagtgggactcaaacccacaaattttgtaattctccaaacgagagttta

SEQ ID NO: 200589 - DNA, 599 bp, Homo sapiens
catccatcactgtcaatcacgcagactgtttcacctgcaccaaaaattccgtggactccacctattcttccctctctctcaccctccctcagccccatcaagacctggcagtcaccgatctttttactgtctctatagttttgccttttccagaatgtcctagttggaatcatacagtgtgtattttttcaactggttcttttacatagcagtatgaatctgaggttcctgcttgtcttttcacggcttgagagctcacttccttttagcatattccattgtttgggtttatcacagtttgtttattcattcatctgctgaatgacatcttggttgcctccaagtcttgacaattgtgaataaagccgctataaacgtgtgtgttaagtttttgtgcgagcataaatcttcctgttatttaaataccgaggagtgcaattgttggatagtatggactacgtttagctttataagaaactgccaatgtgccttccacagtggctgtaccactggcattcctaccagcaacggagacttcctgttgctccacatccttaccagcacttgatgtagtattttgcactttagacattcaaata

SEQ ID NO: 200590 - DNA, 719 bp, Homo sapiens
tctgcctgggtcgtgtggccggttggcagtcgtcgtcccggcggttccagtttgggggtctgtgaaggcctgggcaacgtgggcatcggcgtcggacccgcaggggttttcatcccctccccatccggagcagcctctttgctaggctggatccagacgagcgctccccaaccaaggacaacggcctcccaggcgctcatcgtccacccgcaggagggtgcccgcagagcttcaagaaggtggttgtcacgcctgtcgccctctgccctcatcgagaaatgtagccacagctcgacgcagggacggagaaggaagccggcaaggggatggggcaagcatgtctgtctctcaaaggctggccttcctggccgagtcacccgtttgacactcctccccggatgccggtggtggtggcatggcccccccgtatcctgcctgggctctggcctctgctctgacctccctcttgctgtgtctgccccgtctctgagaagcctggcggcttcttagtgtggctcagtgtcttccacaaagaagacttccccgtccatcagggagaaacctcgtggcggtccgcgtcatgattgtttccctctccacacctctttctggatgattgggcagctgtggtgatcctggagctctgggcttccatacctgtgtgggacagggaagctctctcggtctccatggcccaagtgatggctgcacgctcggtc

SEQ ID NO: 200591 - DNA, 934 bp, Homo sapiens
ctgctttacaaaatgcaaactctgatcaccccagcctcaaaccttcattggctctctatggagggctttttaagctggagtccaagatgggcttcaaagggtcaaagaattctcatattgcacaaaaagtttggtggagagagggcttgtcattttcaatagatttgtaaaggcctttgtgactaaagagaggtctagagctactactgtgagccttttaggccaaaattccaactgcctggtctggcacacaaagctcttcacaatctggctcccacgagctgctctcactgccttcacttcctcatacgcaccctttaacccggcgttactaaaaggcgggtgctccctgctctctctgcccactctctttgcctgaatgctcttcccgacttctcatagtgaaactagctgatttctaatttaaccttaaaaccccaactccgtccaggcacggtggctcatgcctgtaatccctgcatttttgggaggctgagacgggtgggtcacctgaggtcaggagtttgagaccagcctgaccaacatggtgaaaccctgtctctactaaaaatacaaaaattagccagatgtggtggcgggcgcctgtaagcccagctactcgggaggctgaggaaagagaattgctagaacccgggaggcggaggttgcagtgagccgagatcgcgccattgcactccatcctgatcgaacagtggacgggatcctctagaacaaacaaacaaacaaacaaacaaacaaaacccaactccagcatcacttgcttggttcccaggccaggaagggtgccattcctctggctcctgctgccccgctgctctgcagaagcagtcatgctgctctctagtatttctactttattgactgtttctgctttccccctcttaactgccagttcctggagggttggactagg

SEQ ID NO: 200592 - DNA, 563 bp, Homo sapiens
gatgcgtctccgactgctcatagtaacactaactagactatcgtatagtttaaggcttcatcatacacacctccgtccaggcacggtggctcatgcctgtaatccctgcatttttgggaggctgagacgggtgggtcacctgaggtcaggagtttgagaccagcctgaccaacatggtgaaaccctgtctctactaaaaatacaaaaattagccagatgtggtggcgggcgcctgtaagcccagctactcgggaggctgaggaaagagaattgctagaacccgggaggcggaggttgcagtgagccgagatcgcgccattgcactccatcctgatcgaacagtggacgggatcctctagaacaaacaaacaaacaaacaaacaaacaaaacccaactccagcatcacttgcttggttcccaggccaggaagggtgccattcctctggctcctgctgccccgctgctctgcagaagcagtcatgctgctctctagtatttctactttattgactgtttctgctttccccctcttaactgccagttcctggagggttggactagg

SEQ ID NO: 200593 - DNA, 617 bp, Homo sapiens
cctggtgactcagcagctgtggacagtggctggtggagatgatgcattttggcagcttctctcctaggcctggctcagtgccctgggaagatcgcacacttcctgatccaggcttgttcctcctgctttccctccaacttttgctacttaagggccctgacccctttggtcaccccatcctgtgagggccacatgccactgagtcttcctgacatttaggaagtcaacttccatctggctggaaatgtccaacgcatgtttggtatgatgcttgctttctgaagccgtgtgtgaactcagccatttctcctaagggaaggcccaatttttctaagaaaaactgcaccataactacccttgtcaaagtcaacgttgacttccctgttgctagatccaagggatacttctctggcctcatcttcctcagtttcttagcagcattcaagacacttgactattctgtttgacgctaaatcttcccatgacctaatatagggtgttttcctttttattctactctaattgatgttcatttttagtctcttctgcttgctcctcctcttctacttaatttcaaatattagaattgagggtgtcaggcaaagccctcttgcctg

SEQ ID NO: 200594 - DNA, 605 bp, Homo sapiens
ccatgttggctaggctgatctcgaactcctgacctcaagtgatctgcctgcctcggcctcccaaagtgctgggattacaggcgtgagccactgcgcccggctgggattcagcattcttgactttatgatagatgctctccctttctctggtatatcttctacggctctagtcactgctcagtttctggtgtcctgttgctctcctgtttagccatgaagtattgacttagtcaaacttgggcgctgggcattcttatcctgtattctctccagttggaaatttgtccttcctcactgacagctgcaggtactgcgtgctgctctctgaggtttgaagtttactgcttgagtaagcttgagacccacctgatgtctccacctgggtgctccaaaagtgccctactcttaagtccaaagggaacccatgtcctctgtcccttgcccaccactgcccacacacacacactcatgatcctctttccatccatcatcatcacaagtcttgtctgtttaaaacatgctctgttgcttgcactgatctccctgtatcatagtctagtcttcttgaagccatgctgtgaccttcaactagaatgatcttatca

SEQ ID NO: 200595 - DNA, 430 bp, Homo sapiens
gagacgaggtctcactatgcccaggttggtctcaaactcctgtgctcaagcaatcctcccatcttggcctccctaagtgctgggattataggcatgagccaccgtgcccggcctcatgtctgcatgttaaaagttctgagaattcctatggaaaataaatttgactttgcttaatgcagttcctctaaacttacttaattcctttttctttttttctttactatttattaatttttctcttttctcagaccttgcagggatgaaaggtccccttttctcaaaaccctcttatgatcctctacactctgcaagggcttctgaggacagcaggctgagaaaggccgatcctagcacttacctctttgaagacacttttaaaactgttaacagtatttatagctttaaaagtatccatgttcttaggccagtt

SEQ ID NO: 200596 - DNA, 635 bp, Homo sapiens
gacagatcccctgaggtcaggagtttgagactagcctggccaacatgatgaaaccccatctctgctaaaaatacaaaaattagctgggcatggtggcaggcatctgtaatcccagctacttgggaggctgaggcaggagaatcacttcaacctaggaggcggaggttgcagtaagcagaaatcacaccactgcactccagcctgggcgacagagtgagactctgcctcaaaagtaagaaagaaagaaaaagaacctgcactatgaatgtgatgatgggaatcaaaaaaatttttcaaggttagcattattgggactttactggttctaagggattgaaggggagaaatgagccaaagctgactcttaagatagcagctgacagaagcaacaagggcaaataaaggttctttttttacttgtgcatgtttgaaggtagtctagaaggaacaatgtaaatggtagagcttcaaaataaaagaggccattttgctatgccttcaccttttggtagagaataaatgagattgtctgcagaaagggtgaatatgagtttgaagagaggtttgaaatggccttgtggatgaataactcagtgacccacagacttgtcaattagtgtccaaggctaatggaa

SEQ ID NO: 200597 - DNA, 594 bp, Homo sapiens
gtgactggagctgtatgtggttacatgtggtcacaagtgcacattcaagttcacatacacagagatatcattttagggcttgaacctggaagtttgcctccagggtcatctgaacctggattcaggttcagatccagggccatctgaacctggatcgtgtgtgtgggaaagacccaggacccacacacaatgtcatcagctgtgtgtaattgtgtgctctgtgtgtggctgtgaatctgtgtgtgtgatttgcctgttgattgtctttggcatggctgtgggtccacgggcggtgaggttcaggagtctcgagtgtctggaaatcggcacaagcctatccctgtgttagtctgtgctctctgtgagcggctctgagcctgtcggtattgatagctgtaagactatcgtcactctgtgtggccacgtgtgtgactgtcccatgagccattgctcttaacgtgcagtggtgagtctgtgtgtgttcatgtctgtcagtctttattctcttgtgtggctgtgagtctttgtgcacctctgtgagtgatggcgagttggcccccgtatctgagccccttgatggggctgtgatgggtc

SEQ ID NO: 200598 - DNA, 609 bp, Homo sapiens
aatgcatctgggcattattcaaagtcttccctccacctccagagaggggaccctcctcccctgaatacgacagctgcatccacaagaaatttggttacgtctatcatttttacactgtgcctccctgctagtttctttgctagctcttcagcagacccaagcagtggccagttaaactgaatccaaatcatcattctggccctctaacttagactgggactttgttgattagccaagatcagttgtgtttttctcgcacattattgcaaaaggtttctaatctgtcttcttgccttctgttatacctgtctctatactaaagccagggtgaagttcaaaagacagatttgatcttatcgcttttctgcttaaaaccattccttggctgcattccaagttcttcagcaacttctgagcccttcacgcctctctctaggttcattttcagccaccacttgccatgcctggagctctatactccagtcagactaaccattggcacagtgggctcttttgcttccaggcagtggaacatgccattctctctggctggcctttgactttcctccttgtcatgaactcataattttacattgctgcagcatctac

SEQ ID NO: 200599 - DNA, 158 bp, Homo sapiens
cagtgttccttatttgttgtatggcaagttgatgaataactcttgattaatatctttaatgttctgtttcacacagttctctcaattacatgtgaaaaatctgttatataagtaatgctatttaatgattaaaatggatatatgttttaaggtagtgc

SEQ ID NO: 200600 - DNA, 306 bp, Homo sapiens
aactaacactactgtaccaaaatctattcagagcaatactgaaggtcaaatatgatctcaaaagagcatagaaattagaataaataaaaacattgcttatccactttttatcctaatatgaaaaaaaaggtcaaatggtcaaagaaatttgttctaagtgcttgagctacacatacctaaattagaacaatgcaaattaatttaatcaaatatttgatggacattaaaacatttctgattattttgacttactacagacaaacattcactattttaaacttcttaggggatcagcatttttcttaa

SEQ ID NO: 200601 - DNA, 328 bp, Homo sapiens
ctcgtgttcagtctgaaaacagctgcttcctgtacttcgttcagttctctaattgctcacaataaaaagctaagtcctttcttacttcatcatggctagaagcagttcccatgcgaatgtcttggttaaaggagaaaaatgtataaggtaactataaactaagactttcacatcaattcagttggttcttttgttaagaattacagggttgggcacgatggctcacacctgtaatcccagaactttgggaggctgaggcgggaggatcccttgaggccaagattttaagatcagcctgggaaacatagtgagaccccgtttctacaga

SEQ ID NO: 200602 - DNA, 372 bp, Homo sapiens
atttctctctctctcaatggcttccacagatttctttgtccaccccaccagtctattctcaccaagcattttttgatgcttgttctgtaatgattccagaatccaggcctcagagcttcgccaggaggtagggccctccttgtcctgaaggcataaatacaagagcagttaaatagcaatactaaaaaacaacaccaacatgaacagggctcagctttaatattgaagagagggcaccaacccccaagctgttgctccatctgcctgtgctcactcatgttccccttggcatggcgttccctgtgatgttccctgcggcatcgcagacatgtccaagttgagaaagtgggttttaaatgctttgaatacttc

SEQ ID NO: 200603 - DNA, 368 bp, Homo sapiens
gcttgcagtgagctgagattgcaccactgtactccagcctgggcgacagagtgagactccatcttaaaaaaataaaaataaataaaataaaataaaatatgttactgctattagatgacttcatttattgcaagtcttacagcacaggctcttaacttcctttgtttaataagatttgtcagccttcggtgatgttgatgataagatgctctttttcctgtttctgtcatttcactgtcctgttagaaatagcttagactgatgctgggcacggtggctcacgcctgtaatcccagcactttgggaggccaaggtgggaggatcacgaggtcaggagatcgagaccatcctggctgacatggtgaaac

SEQ ID NO: 200604 - DNA, 423 bp, Homo sapiens
aaagtatggaaattcgattttaacttaggagatgctagaatctagccacttggccgtcagccaccacatattccatctcagtggcatgtggttggtgaaaatgtgtactatgccttgagaaagggagaaagtataataaatgaaagaaatctttcagctattcagtaaaaatttatttacaggagaacagaactttgggttggtttcagatgtttcctctgcaacagttagatgccaaacgactccactgtttttgaggagggaaaagttatgagctaagaatgttataaccagcaatttgtctttcactaggacaggcgagcattctcaaaaatgcaagggctcagaaaatattccacttgttgaaaaactattcaaagatacattccagtggttcatagggtttggaattatatagacaag

SEQ ID NO: 200605 - DNA, 454 bp, Homo sapiens
agatgctcttcctgcctctagctcttaccgcactccctgcacttccccgaggtcactgcactcacagagcttcctatgtgatcagttccaccaggcatagcaggaattcttctcatttgtccaaacgaacagagccccaggaggccccacctggtgcccgtgaccgaccccctcagtgaacctgcaaaggttcccatgcacaaggcgacgcttcagacatttcaccatctcactctccaggtcggacttgaaaacgctctgatcaatgatcaaatctgcttccacccaattcaaatgcaagcagttctgaggcacgattatacacaatacatgctatttattaaccgtcaccactcagctaggttctttgccaagaatttcccaaaagaagtcttcattctacatagcaacttgttcttatccatgggaaagatagtgtcttattttaaatgca

SEQ ID NO: 200606 - DNA, 632 bp, Homo sapiens
  misc_feature (599)..(599): n is a, c, g, or t
cctgtgttttttcataatcacataaccgtacttgagcactgccagaagaatttaatctcaggaagcagagaagcatgaggaaagaaggctggtgtgggagtcagaaggcctaggttttggtccttggctcagccaccgactttccctgtaaccctgatctggtcaccccaaatccccagccccagatatcattttcttcatctaacccaaggactggcatagagctggcatttaaaaatgtttgaagccaagtgcagtggctcaggcctgtaatcccaagctttggggaggctgaggcaggaggatctttggaggtcaggagtttgggaccagcctgggcaatatagtgagaccccatcaaaaattgctctaattagccaggtgtagtggcatgcacctgtaatcccagctactcaggaggctgaggtgggaggactacttgagcccaggagttggtggctgcagtgagctacgatcgtgctactgcactccagcctgggccacaagaaaaaaactctgtttcaaaaacaaaacaaaacaaaacaaacaaaaacaaacaaaaagggcaggttgaagaacaatataactctatttgcatnttttttaattgtagagaaagctggatgtggtgg

SEQ ID NO: 200607 - DNA, 596 bp, Homo sapiens
gagacaaatacttttgtatttttaatacagaaaagtatgcctcggcctcccaaagtgctggaattacagacatgagccactgtgcctggcctgctcactttctgatgctgcttttttgttgtttgtttgtttatttgtttgttttgagacggagtctcgctctgtcaccaggctggagtgcagtggcgcaatctcggctcattgcaacctccgcctcccaggttcaagcgattctcctgcctcagcctgcggagtagctgggactataggtgcgtgccaccacgtccagccactgatgctgttttgccactgatgctgttttgaaattgatattttgtctcataaaaactaggccaggcatggtggctcattcctgtaatcccagcactttgggaggccaaggtgggtggatcacctgaggtcaggagttggagatgagcctggacaacatggcaaaaccccacctctactaaaaatacaaaaaaaattagctgggtatggtgtcacgtgcctgtaatcccagccactggggaggctgggattgcaggtacacaccaccatgctcaactaatttttcttttttagcggtgagggcg

SEQ ID NO: 200608 - DNA, 240 bp, Homo sapiens
tcatccttggacaatgtccctaaccttcctaagccagcctaaatgaagaatcctacgaagtgatttcccacctttgatatctcatcaaggtcttcatcctctacccttaatgtctaagtccttggcctgcctttagcaagaatcttgttagtccagttcagcaactccctatccttgatgtctcctcttaaaaatcttccatccactgaccccctcactctgctccttgactataaatcc

SEQ ID NO: 200609 - DNA, 540 bp, Homo sapiens
ctgagaaccaggggaaccaatggcataaattccaatccgagtataggagaagatgagagatgttccagctcaagcagtaaagcagaaaaaggggtgaatcctctttcctctgccttttgttctattcaggccatcagtggattggagggtggccactcacattaggggaagacaatctactttatttagtccattgagtcaaatgctcatctcactggaaataccttcacagacacacctagaagtagtgtttaatcagttatctgggcagcctgtgatccagttaagttgacacataaaattaactatcacagtgaccatgggcacattgaaggaggggccgtagcacttgatgtgtagcttctaatgaaatcttagcctcatgttagggatctggggccaagccaggggttggtgaggcagatgaggttgggagctctgtggtactcaacccatcttcacttccagggctgagactcatagagtcactacctacctgtgactcatagagtactcagagctcaaggtcattgtccctcc

SEQ ID NO: 200610 - DNA, 436 bp, Homo sapiens
catgttggtaccatcctagatgctggggactcagagaagaacggaacccataaggtccttgagtccccagggctcccatgtttgggatagcaggaggactgcagagaaacaagcagccagctccaaaaaacatgaactaaatcagggtgatatcacagagtgagcagccatggccacgggcagccttccccgggcaggtaacgtctggacataagagatgagacagtggaaggatcttgccttcagagcagcttgggggcaaccactgcaagcaaagcaggcatgcacagcagaccctgaggcaggaacacactgagtaccttcgaggaaccaaaggaacatctatgtgacctgagaggggcaggggggtccaggtcatgtaaggttctcatagaccacgagaaggaagcttgtgttctaagctagtggacagccg

SEQ ID NO: 200611 - DNA, 446 bp, Homo sapiens
ctgtaagtcccaactacttgagaggatgagatggaaggatcacttgagcccaggagtctgaggctgcaaagagtccccagggctcccatgtttgggatagcaggaggactgcagagaaacaagcagccagctccaaaaaacatgaactaaatcagggtgatatcacagagtgagcagccatggccacgggcagccttccccgggcaggtaacgtctggacataagagatgagacagtggaaggatcttgccttcagagcagcttgggggcaaccactgcaagcaaagcaggcatgcacagcagaccctgaggcaggaacacactgagtaccttcgaggaaccaaaggaacatctatgtgacctgagaggggcaggggggtccaggtcatgtaaggttctcatagaccacgagaaggaagcttgtgttctaagctagtggacagccg

SEQ ID NO: 200612 - DNA, 522 bp, Homo sapiens
  misc_feature (465)..(465): n is a, c, g, or t
tcggtctcggtacccgtcagacgctgaactatgtgaggcatgatgctccagtctgcgcaacagagtgagaccttatctctaaaaataaaaactaaataaaacatcaatattattgtgagaaaatcatgtagtgtttgtaacttttttcttcaggtattttctgggtttttgttttttgttttttttttgagacgaagttgtctaggctggagtgtagtggagtgatcttggctcactgtaacctttgcctcccgggttcaagtgattctcctgcctcagcctccctagtagctgggattacagccatatgtcaccacgcccagctaattttttatttttagtggggacggggtttctccatgttggtcaggctggtcttgaactcctgatctcaggtggtccgcctgcctcggcctcccaaagttctgggattacaggtgtgagccattgcacccagccttcctngtttcttacttgactttgtttattgagatttttcccagcacacatagttcagcgtct

SEQ ID NO: 200613 - DNA, 430 bp, Homo sapiens
aacccagaaactagtaccagctcttccctaaagtagctctatggattgggacatgtcacagaacctctttggacctcagcctttttatctaaaaagtgaggttttacaccagccaacagtgactcacccagccctatgggaggccaaggtgggaggatcgcttgagctccagagttcaagaccagcctaggcaacatagtgaaatgctgtttttattttaaaaaatttttttaaattagccagctgggtgtggtggtgcatgtctgtattcccagaactattttttttttccttgatatttttgttttcctactctggaagctgaggtggaaggattgcttgagcccaggagtttgaggctgcagtgagctatgatcacaacactgcactcaagcctgggcaacagagcaagaccctgactgtaaaaaaa

SEQ ID NO: 200614 - DNA, 407 bp, Homo sapiens
caggccgcctggctgagctcctgctgtaaccagtcggcgtcgccgccggagccccccgaggggccgcgcgcggtgcaggcggtggtgctcggcgtgctgtccctgctggtgctttgcggggtcctgttcctgggcggcggcctcctcctccgcgcccagggcctgacagcgctgctgacccgcgagcagcgcgcgtcccgcgagcccgagccgggcagtgccagcggagaggacggcgacgacgactcctaggcgcccggctgcgctcggtggtcgcggcctccaggcagcccctgactccgagcggtccggagcatgcccgacggctgctgcggtcccgaccccttacccgaagcggcgcgccccacacaggtgagagggagggtagcaggagtgtgggcgcgggg

SEQ ID NO: 200615 - DNA, 644 bp, Homo sapiens
gggattatctgctcttacccatatatgccttatcttctctgttgtcaatagcctttgcattccctagacctcatttatgccatggatactagcatgacctttatccatgaaatgaggcttggcttaatccgcagaaattagtcatgcttacctgtgctgtaccttttcacttctgttgtcgtctgcctctggatccctcagatccagttttctttcctagggcttcgatccaaagcttggaattgagtttgggtcaaaataactgcctcaggatgttgcatggactccttaccaagctgaatgctaaggtcaagctgtggaattgagtccttctccaacaagggagagaaaaggggtgtcttctgagttgggatcctggctgagtaaaacatcttctaaaaggaaaaaagcctgtagcgtagagaagccccctctacttgcagggccatgttattgggttggtgcaaaaacagtcacagtcctcgccgttctaagtaatagcaaaaactgcaactacttttgcaccaacctattcctggcctggtggagaaaaggaaaagaaaaacagcgtaaatgcagggctttgttaactgctgacaggatggagaaaagaaaaagatgcccggagaacaaaccttttattc

SEQ ID NO: 200616 - DNA, 261 bp, Homo sapiens
tataaatattaatgtcctatattaaaaatactgtactatcaataatttcttatttgtggctcctactcacagttccccaagaggatggggcatcccacaccgggccacagaagaaaacactgaagttgcatgcaggcaaagagagaaaaggaactagggggctggagtctttaagaggtgaggcaaggtaagcaggtttaggactggctagtttgagtaattgtagagggctctggggggacaaggggttgtccctagttg

SEQ ID NO: 200617 - DNA, 373 bp, Homo sapiens
ataataataataaaaatttcttcttatatcaagatgtccatcatagcatttatcatagtaaataattttgaatagacctttagaaatggaaaaaagcaaagcactatattgtatctctactcaaactaagatttgacactgtactcggctctttttataatttttcccttaatcctcacagtaaaatcaaatgtttgacacaatgattgtctctttatgagtttttagctaacaaaatgtttatggtaaacatggaataaaatgaaaaatactcatgacagatgctaaacatgaaagcaagtgatttatgtatctagtatgattataaccaggtatatcgaaatctctctgtgaataaaaaaaattgaagtcc

SEQ ID NO: 200618 - DNA, 1270 bp, Homo sapiens
gaagactacgaaggggctccatggaattgtgatagctgcacctttcttaaccacccagcactaaatcgctgtgagcagtgcgagatgccacggtacacctgaattcagaaaagtctgcgccaggttgaaagtgaaactttgagcactaccagaagaaaaggaaacctcgggactctattcatccacccagccttttcattttcgattgcacagcggggaggaggaatggctttgtggtcgtcgttgtgctcacgaaaggaaaaatggggaggtcttttttttctcctttcttaactcactacagagtgagagatagaaagggatacttgaaactgggaaaggattcactctgtgaaagaatgtacacacagaagtcaagagctcttctgtggtggaatcccaattgttaaagttactgctgagtggcccttattttttaaagtagtactttgaatcatagtatgaaatgctacagtttatgcaaactgtgaattcccagagcagacttacctggtcaccgctctctggaaaaccaaggctccccgtgcttcttcccattgcttcctactaaagaggacaacaggaaaaagcacctagaatatttggggggggggggcaaattaattaagggtatttgtaattgctgcttttttcaggggtaatttccaacacacatacatgcacacaaacaaaatgttttaaaatgtgatttgtagcagtcaggaactaggcatatcatgcctttgtttaaaagtacaatcagaggtggtaagatgcctttggcttgtacagtgtgattcatcgagctctatcaacactggtaactaagacctacttatgccacataagagatgcatttttttaagttactgcatgtttttattaaggccattggttttcaaaataacaagtccttacaaagtatgattttataaatgatattctcgtaaaactgcgctttgccagtagcacagtgaatgtatgccaaatgcaagtccattccaaaatccatttggaaatcttgagctcagctgtggttcttaaacttttgcagtccatagggcctttttttttttccttccaattttgtgataaattcatgatgtttacagcacagataaaactttgtgccataatcctaatttagctgaaatcaatattaactgttcaataaaaacttacttgcatatgttaacaaaccagtgtgaggggaattacagttggccaacgacaaagttgcacactgcattatttaggaaaggagggattg

SEQ ID NO: 200619 - DNA, 194 bp, Homo sapiens
cccactacattatgctgccaagtgacaagctaataaacatgaggtgtttttcctctttggtaacaggacccaagacatgaaatatgagcttggcagagagtttcacattgcattaaaaggacaaatagatttatataggggtagtaagtgctcactctgagccgaagtgtgaatgattggattccagcctgact

SEQ ID NO: 200620 - DNA, 549 bp, Homo sapiens
tcccaccttccatcatgtgaggacacagcaacagggcgccatcttgaaagccgagagcaatcctcaccaaacaccgaatctactgctgccttcagcctggatgtcccagaactgtgagaaataaattccttttatttacaaataacccagcataaggtattctgttatagccacgtgaatggactacaattgtcatcttggagaagtcctttaatttctctaagcatcagtttctactcacttgcgactacattatcttatttcaatcttaaatgatattgtgaaaattgcttagaagcttacatttaaatatattctaagtctctctccaagtatgctaacttgttaacactaacagaagtctttcataattttttaaaagtcattaacacattttactgatgaaattaaaatggcaaatttaagagaaataatattttgatagatattaattaatgttcccccttgattagatttaacactaaataacaatatgtaaaaccaagaaacaaacaacagaacattgtgaagaaccaacatattgtccta

SEQ ID NO: 200621 - DNA, 734 bp, Homo sapiens
  misc_feature (19)..(19): n is a, c, g, or t
gcggcgcaccccgtgttgngtcctggtgatgcgttcgctcgcggttcaattgctacttccgcgtaggtgcctttggagcctccgctgcctctgtaaccccgtgcaagtgatttccacgcctttatgtggtccccgggtttgcccgcccggcgtgtaaacccgcgccgtgatacccgctcccattgggccgattgggtacgggccccccctgcacgtgtgttgagttttgctggagcccgagtctcactctgtcgcccaggctggagcacaatggcgtgatctcagctatctgcaacctctgctcccgggttcaagcgactctgctgccacaccacacgcccaactaattttttgtatttttagtagagatggggtttcaccatgttggccaggctggtcttgaactcctgacctcaagtgatctgtccacctcggcctctcaaagtgctgggattacaggtgtgagccaccgcgcccagcccagggtagttctataaactcaccacaaacactgactaattgaacgctgaaacatggctcctaggggaagcacagagctgggttcctgtgaacctctggtcttgagatggatctcgctctgttgcccaggctggagtgcagtggcacaatctcgggtcactgcagcctctgcctcctgggttcaagcgattctcatgcctcagcctcccaagtagctgggattacaagcgtgagccaccacatctggctaattg

SEQ ID NO: 200622 - DNA, 706 bp, Homo sapiens
  misc_feature (19)..(19): n is a, c, g, or t
  misc_feature (700)..(700): n is a, c, g, or t
gcggcgcaccccgtgttgngtcctggtgatgcgttcgctcgcggttcaattgctacttccgcgtaggtgcctttggagcctccgctgcctctgtaaccccgtgcaagtgatttccacgcctttatgtggtccccgggtttgcccgcccggcgtgtaaacccgcgccgtgatacccgctcccattgggccgattgggtacgggccccccctgcacgtgtgttgagttttgctggagcccgagtctcactctgtcgcccaggctggagcacaatggcgtgatctcagctatctgcaacctctgctcccgggttcaagcgactctgctgccacaccacacgcccaactaattttttgtatttttagtagagatggggtttcaccatgttggccaggctggtcttgaactcctgacctcaagtgatctgtccacctcggcctctcaaagtgctgggattacaggtgtgagccaccgcgcccagcccagggtagttctataaactcaccacaaacactgactaattgaacgctgaaacatggctcctaggggaagcacagagctgggttcctgtgaacctctggtcctagcattttcaccagccaatcaatacagaaccttgtatgtgtgtttcttcctttttttttgagatggatctcgctctgttgcccaggctggagtgagatcctgtctcaaaaaacaaancaagca

SEQ ID NO: 200623 - DNA, 442 bp, Homo sapiens
gtgcttaggaaggacattttaaacgggtattaaaagcagaaaacagtatcctgcataaatgtaaagccatggttcacttacacctggaatattgtgagccattttttcagcaaaccttaagcagctataatagggtaggagaaagtcctgaggatgtcaactgaaatgatttatggaaaagaggagctgctttatgaaaacaaacttgcaaagattaggattaatcagcctggggagatgaaggttttataaaatcatagggatatggtgcatggggacattcaccttggctaacatttaccctcctcatcatcaacagacatgggtcagagggtggctgtcaaaggaatagggcgtagtgtgagtttaaaatctacatcagtttaggccaaaaggcccgtaagttaaccaacaaataggcaaataaaaagtcaaggtagat

SEQ ID NO: 200624 - DNA, 611 bp, Homo sapiens
tggagaaaaaataaaaatctccttgtgaaaattagtaacgaaagacatactttaggaatagttggcaagtctgctatagcaaaggatagctccctgaaatttaaagtcatctttggctgtaagggatgctgtgtgagtacatgggggtggagaggagtcttgacaaacacctcactgtgctgtcctatcatggtcagtgggtggcatcatttttgataatgaagcttgttactataagcaaatgagaacgattataagaaaaaattcaacaaggaatatcagaacatggtgaaatctgaattttaaaaagaatgtagatgagtgtgattatgattgaatgttgaaattaaagcacttaagccttagctttggctgagtccttaacaggtatgtgcaaactactccatgcttcaaaatgagatgtgcaattactagatgaggcttgcaaagaacatggtcaaaagctagttttctgtaggaattcacccacactgaagttacaaaagggcagaaatggagattaaaagaggttttatggcaagaactatcagagaattgtgagtcctctacctcccacccccttattctacccagtaaaataggcatcagaa

SEQ ID NO: 200625 - DNA, 277 bp, Homo sapiens
tatattttgttcatccttgtatttccaggatctgaaacatcataggcaatctataaatatttgtggattaaataatttaatcttacaaagattcagcaagcagtttgggtagagggtaggatgtctaataggagggcagaggtgtcagggtgagaagggcagtcattagggacaacctcaccgatataaattagagtcaatatgaatggaggtttcttcttggcccttctcatgttcagtgatagaatggaaaataaatgttcttactctcctactt

SEQ ID NO: 200626 - DNA, 447 bp, Homo sapiens
gactctgttgcccaaattaagttatgtgcaccgaatgctttgtcaaactgtaactattttaatgttcattctaagccacaaatctttgccaaagaagatactgaattactctcttttgtttaggagtagaatacacaataacctaatatttaaaagtattattcagaagaagaaaaacttaggattgaatttttctttatcataaattttagatcattctctttgctcgattccatagaagacactaagaattagactgaactgctttctcattgtattgttttctacttgacctaaaaatccaggggtgggttatatagagagtttatttaggagactttggtaagggagagagaaaaataatgtacaagctggaaacgcatgaaaaatgtaaacaatgaaagttagaagaatggaagcgacagtgtgctcaggaaatgatgtgtc

SEQ ID NO: 200627 - DNA, 357 bp, Homo sapiens
actcagatcctctccatctccctgccttgctgtccttggaatgtcagcttggtcccaagacaactgctacaattctgggcgtcatactcacataaaccaacaatgtcaagcgaaaggacattctgattttttttttttaaataaaggaaacttttccatcagatatccctagaaaatttcttttgatgtcccctttgccacagtctaagtcagatgcccacttcattttatttttttcaagacggagtctcgctctgtcgccaggctggagtgcagtggcataatctcggaccactgcaatctccacttcacagcagatgcccacttctaaaccatccattggcaaggagaatggga

SEQ ID NO: 200628 - DNA, 156 bp, Homo sapiens
ggagtggatttcttctttctggctcttacaccatgtgggggcacagagtttaaagtgccatcgtggaagcagaaacaagggcccacaccagacatgaaacctgctggcactttgatcttggactttccattctccagacctgggaggaaagacatt

SEQ ID NO: 200629 - DNA, 284 bp, Homo sapiens
gggtccaaatgtgaaaggaaagagcaaacacaggggaaacataggggtgttcagaaatagttcccaggttactgcctgtttcaatatgtacagtcctcggccccacccacaagattctgacttggcaggtcagagttggagacgggggagctacctggttacgagggatcccagttcattttgaggcagctggttgttagactgcattgtaaaaattaccccccaaagatgtgaagggataatttatgtatttttaatagagataggttttcaccatgttggcc

SEQ ID NO: 200630 - DNA, 437 bp, Homo sapiens
ctgtcaaagcagttggtggtttgggttaataaaatttttagatcttataaaatgtattttcttttgaggtatttttgcattgtttttagaataatgagatctgagatataaacctgagactcaacagaagactgcatagaagttgatggccgaaataaaatgtagattctccctcaatggagaaacataatttttcccaggcacaaggcatgaaggagactctgtcccagccccttgctgcttttttgagacatatcagaagccgtagaaggagcggggagggatagcattaggagatatacctaatgttaaatgacgagttaatgggtgcagcacaccaacatggcacatgtatacatatgtaacctgcacgttgtgcacatgtaccctaaaacttaaagtataataaaaataaataaataaataaataaataaat

SEQ ID NO: 200631 - DNA, 451 bp, Homo sapiens
aaacaatgctgagagtgctgccatctcaggagagcaggaagtctatgcactcttttttcccgtctaaggcaggggtccccaactcgcagcaggggaccagtactggtctgtggcctgttaggaactgggccttacagtaggaggtgagcagcaggccagcgagcattaccgcctgagccccacctcctgtcagatcagcggtggcattagattctcataggagcacaaaccctattgtgaactgcacgtgcgagggatctagcttgtgcgctccttttgagaatctaatgcctgatgacctgaggtggaacagtttcatcccaaaaccatccccacaaccccgtccatagaaaaattatcttccatgaatcctggtgccaaaaagattggctggtgtaagggaccctgtgatacgtgcatgaggtgtgaactgactctgttgattatccgg

SEQ ID NO: 200632 - DNA, 532 bp, Homo sapiens
  misc_feature (102)..(102): n is a, c, g, or t
agaagtataccatcaaaccccccagggacctgtgcagcaggtttgagcaggagcaagaggtgaagaagcagcaggagatcagagcccaggagaagaagcggntgagggaggaggaggagcgcctcatggaagcggagaaggcaaagccggatgccctgcacggcctgcgggtgcactcctgggtccttgtgctatcggggaagcgcgaggtgcctgagaacttcttcatcgacccattcacaggacatagctacagcacccaggatgagcacttcctgggcatcgaaagcctgtggaaccacaagaactactggatcaacatgcaggattgctggaactgctgcaaggtgcctagggagggggagctgggtgggtgtggcaggcacagtgcaggtgataggaatagagggaagcaatggcagccagaccttggggagagcgagacaccaggccacgagggctttgaaccttctccatagctgcgtctccatggcccactcccttgcccatgaataaccattctgatacgaaa

SEQ ID NO: 200633 - DNA, 410 bp, Homo sapiens
ctcagagctttttccatgactgagttagaggagtaaggaatccttctctccagcccagcgctgtgttcctgtgaagaatcctttggtcagttggccattgagaaaggggtagcttggagatgtaggaaaatgtaaaatgttccctgtcctctggttctcaatttgggtgtgtggtcatggagcaattagaaataacactccaaaatgcaggatccaatgtcatgaatatacaaattgttctctaacacataactcaagtccctgtccttccagaatagtgaaaatagtgggagggataatacccaatccatttgaacacaggtgctacatttcactctggacagcaaatatgtttctagaaagttccacatggcatgggcattttgtaaattgaattaaatattttcttt

SEQ ID NO: 200634 - DNA, 684 bp, Homo sapiens
gtgtctttctgtgcctggcttatttcatttagcataatgacctccagtgctatccatattgttgcaaatgacaagatctctttttttttttatggctgaatagtactcctaaagtggttagttttatgttatgtgaattatgcctcaattttttaaaatcttaataaaaataaagctggttctttgaaaatactagtgataacatcagtaaattcaaaagcttaagaaaaatggggctgggcatgttggctcatgcctgtaatctcagcactttgggaggccacagcaggaacattgctggagaccagcctgggcaacgtagcaagaccccatatcgattttttaatttattttttttgaaacggagtgtcactcttgttgcccaggctggcatgcaaaggcatgatctcggctcacttcaacctctacctcccaggttcaagcgcttctcctgtctcagcctcctgagtagctgggattacaggtgtgtgccaccatgcctggctaattttgtttatttatttatttattttgagacggagtcttgctctgtcgtccaggctggagtgcagtggcgccatctcggctcactgcaagctctgcctcccaggttcacggcattctcctgcttcagcctcccaagtagctgggactacaggtgcccgccacctcgcctggctaatt

SEQ ID NO: 200635 - DNA, 342 bp, Homo sapiens
tgaatgggtagcaacaattataaggatatgtgtcctccagtgtgagaaaacacattgacttggatcaaggacattttcctcaggttgtaacctcaagaataaatgggaggtgtgtagatgaagtagacaaagttgatatggaaagaatgtttcaggtagagcagacagctgatgatgatttcccagtgaaaacaaataacaccatctgttgtcaattaaaggtggtgggggacgaaagctgatctttaggaagttgcatgaggtctgatgcagccactacagaaaataagtagggaaactgacccatggatgcggaaatcttctaggtgttgttgctagcct

SEQ ID NO: 200636 - DNA, 284 bp, Homo sapiens
tcaaaaaggtaatggtctaaaaagggagggagaggaaatggctctagattgaaagagacttagtgagatgtaagaaccaattataatgtgtgaaccttgttttggtcctgatttggaacaaacctattgtaagatattcttgaaacaattgggcaaatttaaatgtaaactggatattacataataccaagggaattattgttacttttgtaagggtgataacattctggtaacataacaaaaatgtccatggccgggcacagtagctcacacctgtaatccca

SEQ ID NO: 200637 - DNA, 442 bp, Homo sapiens
cattcagaataccaacttcccttctccaattccaaaataaaccccaaactcacaggatttaaacaaggcagcagtcaaaaaggcctctatttatgtcaaacaactcactgtctctgagaatgaacgtcaagtgcttccaaagtattaaccaattgcttttaaaagtagtagttggccgggagcggcggctcacacctgtaatcccagcactttgggaggccgaggcgggtggatcgagtttgagaccagcctggccaacatagtgaaaccccatctctactaaaaatacaaattagctaggcatgatggcgggtgcctgtaatcccacctactcaggaggctgaagcaggagaatcacttgaacctgggaggcggaggttgcagtgagccgagatgccgtcattgccctccagcctgggcaacaagagcgaaactccagctc

SEQ ID NO: 200638 - DNA, 609 bp, Homo sapiens
aaatgaaggaaaataatccctgttcttcttatttcactagatgatgaaagaagatgaagtgaataagtttgatgtgccaccatttttaaaactctggttggggccaggcgtggtggctcacgcctgtaatcccagcactttggggggccgaggcaggtggatcacgaggtcagagattcgagaccagcctggccaacatggtgaatccccatctctactaaaaatacaaaaattagctgggagtggtattgcatgcctgtaatcccagccacttgagaggctgagatgtgagaatcacttgaacccaggaggccaaggttgcagtgagctgagatcgtgccactgcactctagcctgggcgacagagcaagactttgtctcaaaacagaaacaaaaacaaacaaaaaacccagttggttttaaaaatacaaggagctgtttttaacagtttggttaacttttaaaggataccttcttatatttatttgctacgctttgtgtgcttggaggaaacaactgtttctttggttatttccttattcttagaatgaagacctcctttgccatcttcagaagagtttggatttgatttgtgggcatcagaggacc

SEQ ID NO: 200639 - DNA, 538 bp, Homo sapiens
agatggcaccactgcactccagcctggatgacagagcaagaccccgtctcagaaaaacaaaaaaaaatctccattgctgcttgccatgaacattttcactcctttaaaaaaaacctattaactagaactaatcaaagccagattgacttctcttcattcaccatggctgcaccataaggtagccaagcctaattttaggaactccgaaacagttgtaacttaaaatttgctttgatggattccattaggccaccttcatttccaggtcttcctaacccatcactgggattcaacctgaaaagaacaatcaaggcccaaagttttaaggaagccaagttcctggggtcagaaattgaatctgtagcaaccttgttacttttggaaaaccttaagaacattctcaacctcacagttctggccagccccactagagtagtgctaagagatttttatacagatatgactttttgcaaacctagaaggaaattgtgcaaggtgtacctttgcctctagcaaagaaaacctttggcttggaatg

SEQ ID NO: 200640 - DNA, 464 bp, Homo sapiens
gcctactctgccacggggcctacttatgttctctccaatcgccttcccaacctaccatggcaggctatacagatgaggaagctgaggctcagacgctgtcaagaactcaagaataggggccgatgtgtgtctgggctggggttggaaagcaggccagcatgtccccagacactctcacggctgcctcagcctctgctcagatgtcctcttctgatcattctgttcagcccattcctgtttcctgctttaatctctgtagtacatctcattgtgtaacttactacctattttacttgctcacttgttggtctgtcagccccaggaggacgggaactttgtccatctgcgagggatgcaggaaggcacagagaggcttcaaaatatattggctaagagctcagggtctggagtggtcctgattccagggttactggtgcacattccagattcatctctcacaagct

SEQ ID NO: 200641 - DNA, 468 bp, Homo sapiens
gacaccttatctctaaagaaaaacttttaaaaatttttaaaagaaatacaatgttatgagcagagttgaagtaccagtatgtctacctgtcttcctttccagggtaaacctttatcctggagtttgtttccttccgttcatgtttttgtgcatttactacatatgtatgtactattcttatgtcccagttctttcctaaagaaaggattgaaacttctctgaaactagctaactcattgtcatagagatgtaaagaaatgggacataagaatagtgagattgcctttaaaaagttaaactatagaatgaacattcaatgaatcagcagagatatgtcaaatcattttacctgactgaatgtattaacatatataaagaaaaatgtgttaacgaaagatcattggccatcccagaagcaaaatctcactgctaagtctctttgtaaattaataaattaattaaactaag

SEQ ID NO: 200642 - DNA, 465 bp, Homo sapiens
caattcacagccaaataaacttttaaataaatgttcaatcttaacaatagtcaaatgcatgcaaatttctaaaaaaaattatttttatttaaaaatattaataaaatgcaatgccttataccatccaatttatggcgcactgcttggctggccttatacatttccacaatctctttggaaaacagtttagcaatgtgtcttaagagagacattaactgttcttactctttcacctagtaaatccattcctgagaattaaactcttggggaaaaaaatccagaaagaaaaagccatcaacacaaagatattcattatacaattatccttaattttgaaaactaaaaagagaaaaaagcagtctaaatgattaacagaagaaatggttatgtaatttaggggaaatgaatgaagtggaccatcatgcagccttcaaaagtgatcaatggcctggcatggtggttcac

SEQ ID NO: 200643 - DNA, 278 bp, Homo sapiens
catctaattagtagacggttcactttctacacatagttggtcacgaccaggtcctcggcgatagtttgctcctgctgctcgtctttgcctgacatcttcctgccaccaccactgcagcctcgtttcccctgagccgcccctctgcctcccttcccagccacaggctgtggtcagagctccctcgatcctcgaggagagggccagcgaaagccgcgaacttagtcttttagcgtgacttctaagagcatctgaaattatacctgtggctcgcctggtag

SEQ ID NO: 200644 - DNA, 198 bp, Homo sapiens
gcattcaaatttaatgtactacagacttcagtttgttacagggtgtgggaaatcattaaaaggaggaaattaaaagatgaaaataaaccttaaagcctgacttttcatacatttgttcttcaatttaacgaacatttattggttttctcccttgtgcctagcactaagaataaagtataaataggacacagtttctga

SEQ ID NO: 200645 - DNA, 178 bp, Homo sapiens
aagaaataatttgtttataagctggaccatccagaaataatgcagttctgtttgaacatctctattcaccttcgtttaaagctacattctagctctgggcctttcatgtgagtcaaatttgccttttaagttacttcaaatagggcttctgaaacccacgtctcttgacaactatggt

SEQ ID NO: 200646 - DNA, 704 bp, Homo sapiens
gttttttaaagtttgtgacaatctgtacacaacacaaggaagagacccatgcccctccccccacctcccccccagaaagcccacaggactctgtcacctcaagctctgtgtctaccaatccttggtgactttttcttttatcaagaagattggccttgtccagtcacacaggatcctgggctcaataggcaaaaggtgtaaactcacgagaccccaggatcacagagtcacagaggatgctgagtgttgactgatgctctgtgtctttatgtacatgacactgtgttagctccatcagtgaagaacacttgaacccatgcacatttccatcactcaaaagaagtgagcagtcatgactttatatttgtgaagaaaagtgcacctcaatctataaccttaggtgaatgaagcttggggtgtgtgagtaattaaaccatccttgcactcctgtaatgagccccagttgatctttatgtattctttactggtctggtggctttaatagtattttctttataattttttatacatttcataagattggtctatgatattatttgtgtgttacctttcaaaagatgtcttatattgtttaatctaagtttacttcttatttgaattatttaacttttttaatgtttacttttcttttatagcttttgctatatgactgtcttcttttttgtaccctttggttatttaga

SEQ ID NO: 200647 - DNA, 506 bp, Homo sapiens
ccgcgcgggtgtcgcaacatccccattcacaattcccgaccaagaatcgaactggctccgctcccaggtcagcctaaggcagggagtccatccggacctggtcccatcagctgggcggggcctgggcggggtcccagggagcctccggcctgggcacctgagccctagaatgagacagcccggcggtcccgcggcgcgctggcgccctcgccctcgcgctccatggtctcgaagagcagccgcaccagcgccggccgtccctgggccaccagggcccgggccagccccaacacctcgtccgtgtgcccgcgccacacgcgctgcagctcctggcgcaggcgcgccgcggggtacttgtcctgggcgcggcgcagccaggcgtccacctcgcggcccagctccccgtcgctcagctgtgcctggctccactgcgccagcagcgcctcgagcaggcagccgaagccgtcggtgtggctggagcccgcgtcgtccagctccactgcgcg

SEQ ID NO: 200648 - DNA, 452 bp, Homo sapiens
cttggggtcttctatcaagttcacgtggtttttggcagaatttagttctttgtggttgtagggccgggcctgcagttctcttgctggctgttagccagcagtgctcaaagctcctggaggcccctgcggttccttgccatgcccttgcacacttccaagctctttcatcagaggaagccaggcactttatggcctcaccttatcagatcaggcccactgaggataatctcctatgttcaggtcagctgatttgggacattttttttaaatctaaaaaatttcaatttcgtctataaaatctcttcagagtggcacctacattagcctttgactgaataactaggaaaaatgtgtatgccagggttcaagaatctttgggagccatctcagaattctgcctaccatgatgcataataatcatttgaactcaataaattatatttaaaactatg

SEQ ID NO: 200649 - DNA, 351 bp, Homo sapiens
tactccttgacctgtagggcctcttcagtctcaaagataaggaactactacagcttccttttttaaaaaactcattcattcagtaaatgtttattaagtaccaaactagttgttaaatcaatgtttattgatcacccttccagacactaagggcacagtagtgaacaagataagaccctaccctaatcaaactcactgtggatgatttcaatacagtgtagtgaccatataatggggtaagcacagggtgctatgggacacactggcacctgatctagacttgggaggacagggaatgtctcctaataagtgtaacatctgagctgcaaactgatggatgctatagttagc

SEQ ID NO: 200650 - DNA, 583 bp, Homo sapiens
accctttggcaagcacgacttctggcttcaccgtttttttgttttttgtttgtttgtttgtttttgacggagttttgctcttgttgcccaggctggagcgcaacagggcgatctcggctcactgcaacctctgcctcccgggttcaagcaattctcctgcttcagcctcccgagtagctgggattacaggcatgcgccaccacgcccggttaattttttttttttttttttttagtagagacggtttcaccatgttgggccaggctggtctcgaactctcgacctcaggtgatccgcctgccttggcctcccaaagtgctgggattacaggcgtgagccaccgcgcccggccctggcttcacccttaaagcagaaaggccagaagtcatcaaggccatgggtttactagcttagcttccccagacttaatttcaaacaccaacaaccgaaatgtttcctagaatgcagagctaatgagacatcaacctctgtcatttcctatgtttttcacaatgtgccaaaacaactgcacacattggaggcgtttttgaatgtgatattcaggcgaccttgccaagcattg

SEQ ID NO: 200651 - DNA, 853 bp, Homo sapiens
tggttctttagtgcctttctcatcaaggggtgactggagtttgatggaaaacatagtctgtacagagtgaggaaatggccatttctgaggtgctcagaaccacaggctcacccctttcacagggttaggatgggagctgttacagggagtttcctgtactttaaaaaagttaaacaacagaatccagcctttgctagctttgggtactgtaaatgatttactgtaacataaaacacatcgagtgagaaaaatatagaataagttttttcttcttcaataagatatgcaaatatatatccaaattatgttgcttacacaaagtaactaaaaatggcgttgcttgtttggtctcaatgaattaaaccacacattgagtttccctgggttatcttcactatcatttcagattcagggttttggttcttaattactgatatcctttggaagacaataataataacaacaataataatacagtggtgctaaatgctgtaaaaactgcattagatgcatgaccccatttggcatctacttttcaaaggtgtgcatgtttcacgaggacactctatatatacatcttaaggctttgtaaggactaattgagataaagtacatgaagttccaagtaatggtgcctggcatgtgacaggcatccaagaattggtagttactattgccactgtatgacaacaatgccatctactctaagttatggcattgctttgtggacgaatcaggaaaaaaaaaccagacactgccaattaaactatgatgtaatagttttatcccttacttttatttttgtttttgaaagagctctcttagacttatttagacatacattttatcatac

SEQ ID NO: 200652 - DNA, 312 bp, Homo sapiens
atcgtctgccaagtaaaaatagacactctagaaaatatttcaaaggttttagtatgcttgacccaggactattggcaaccattgtgaacttcagggatgattacggtatttaataatgaaatgcttaagtacacctgaaaatggatgataggcacttttaaaacttcatttgtttttacctccatttcattagagtcgttatagtattaaaaatattatatttgcaactcaaggggacatcatagtatgctaacaagctaaaacaaacctatcatttatttccactgtttcttggcagcagatatgatgatt

SEQ ID NO: 200653 - DNA, 575 bp, Homo sapiens
caaaaagtccatggaaaatgtgtattatcaagaaactatgcatggattgcaaaatcttttggcatcaaaataaactggtactaactcgttaaaaaatatctcgacaggatctagtttgaggcattaaaaaggagaaagcatcagtgtgaaaagagctcctatcagcgaaaaatggattctgctaaaattgaaggaagaacaaacataaaatttaagatgaagcttgggtggaagaacggtaaaatcactgatgctttaccaaaagtttatggggacaatgcccctaaagagatcagcagtttacaaatggataacttgtaagaaaggacaaaatgatgttgaagatgaagcctgcagcagcaggtcatccacatcaatatgcaagggaaaaaattaggatgtgaaattatgctttatgaggaagtggtcctcacccccactgcctacaacacaagaaaggagaggaagggagcaaactagaagaagaaagatggtattgggggaaaggatatcaattaaagatggattttaaaaattgcttcgcaggagggagggccctcctgtggtttcactgg

SEQ ID NO: 200654 - DNA, 632 bp, Homo sapiens
aagatgtgagaagtgacaagacacagggcatattttgaaggtagagccaacagggtataagggagatggcgctgggaggaaaagaggcatcaaggataactgagaggctttagcctttcatttcacatcagctgtgcagatgtggtctgtggaagcaggcttgggagcactgtggaaacagttcattttttggcatgtccagtttgaggtgccaattagatatatcagtggagatgacaagaaggcagctagtctagtcatgtctgggatggagatgtagacctgagaattctcagctatgatacttcagcttcccaagtagctgagactacaggtgtgtaccaccgtgcctggctaatttttttaaaaaaaactttactagagattaggtcttgctatgttggccaggttggtcttgaactcctggactcaagaaatcctcccaccttggcctcccgaagtgctgggattacaggtgtgtgataagcagaattctaagatggcccccaagattcccagtctctggtgtagctgccctagacagcctcctcccttttgagtgtgggcaaatctagtatgacagctgtcactcttataaggctacaatatactgcaaaggtgaagggattttt

SEQ ID NO: 200655 - DNA, 288 bp, Homo sapiens
aattaaaatttagcataagggttttagtttagatcagagaggtttatataaaaggtatggagtaccctctgactgtttaaatatgaagctgctgactgctgtggaggaatgggatgatgactcaacacctgaattttacttagagtttgaatagtttgttgtattccagcaaaaaattgtagaatctcctttttaaaatagatgaaatagacttaatttgtaatgtagaaactctagtgtatctcattgtaaataaccaaacaaggttaacctgatttctttttaact

SEQ ID NO: 200656 - DNA, 348 bp, Homo sapiens
catggactccactgctgcaatcatcgtttgcatctgatggttctcaaatccatagcttccactcacacctcttctaaacagcttgtccaaagcactaacagagccagccatggtggtgtgcacctataatcctagcttctcaggaggctgagcagggaggattgtttgaggttaggaggtcaaggttgcagtgcactatgatcatgcctgtcaatagtcactggtctccagactgggcaacatagtgagaccccacctcaaaaaaaaaagcactaacaggtctatttggttatcctcctagtatcatcacttcaatatgctctaaactggataatttgtcaatcccct

SEQ ID NO: 200657 - DNA, 688 bp, Homo sapiens
aagggatctaggttgtgctccgtatgagcatctaatgtccagtgatctgaggtggaacagtttcatccagaaaccatgccccactcccacccccgcaacctgtttgtgggaaaactgtctttcaagaaaccagaccctggtgccaaaaaggttagggaccgctaccttagggcccaccaattccaatcctaggtatatgtctaacagaaatgcacatatatggataccaaaagatgtgtaaaagaatgttcattgcagcactattcacaatagctggaaatggaagcacagtgtccatcaatagaaggaatacatacagtgtggtatacatagttacaatacacagtattgtaaaggaatgaactacagcacgcaaaaaaacttggttcaatctcacaagcacaatgactaaaggaatttagacatgagtacatatggtatgatcctattcttataaaattcaaaaaaagataaaactcatctatgttatcagaaattaggatagtggttacctttgggaagaggaagggttacctttgggttacttttggggaggaggtagggactgactgattggagggacaaggtggtgctgctaatactctttatcctgctctgtatggcaggtacacagttgtgttcatgtagtgatgattcatagagctttaccttcatagcgtatttttct

SEQ ID NO: 200658 - DNA, 495 bp, Homo sapiens
ctgtgacagtccaagctctactacatgaatatctatgagaccaacttgcgcgcttctgaaattcatcaatagctgcaataatttaccaaaaaacacagtagactctgtcaacaaagagtttttctaagggggaaaaatatcttagaactataaaataaaaaataacctttcctttgaaaaattgcttttaatagtccaggcgatttgaagcagaactgcttttgataaacaagccaatttttttaaaactgtgagcattcaagcatttaataatttcagttagctcaaaaattataaagcatgaagaaaactcccaaaatgttggatacatttggaatcatttacacctatgctattaatatcttcatattccaataagcaattgccaaccattttcatgtaaatgtgctgctgcttgtacaatatcattacaatgattacatagcaccttgtttgttggggtggggaagggatacacgtagcctaacattcact

SEQ ID NO: 200659 - DNA, 901 bp, Homo sapiens
taagtacactttttgagcaaatccacccttcgttctggaagaagacactctatagtctcaggctgtttctttaccaacatcaacaagctagtcttaaacagaggaacctcagtgcctcactttcaagacaatcaagattatttcccaacattccactagtagagggtcagaaacagagttaaaagttctcagactagaggtagaattgaaaccccagctgagaagtatcaaggtgccctccttccccaaagctacatattcttgtgtcaggatcttaccaggaaatggaaggcacatttacacagggcagcccaagagactgtttcaaaggaaaccagcaagatgtgacaaagcaccccaagactagcgacactgggagaccttctcacttgacttaaaaggctggggcaggagagttacaggacccagtattagctgtagccaaagcctgggcagggccacctaacatgagctgcacccttctgtagagcagcacagaccttgtgcatctgaggcccagcaggatggggccttgctcatccttcccttgcagttcttgctaatgcttcctgttgcctgaacccagctggaagccagagggcaagggaaatcaattgagacagataatggaggtaatcccctgggcacagggcagcatggcagaggtaaggagtctgtctagagccacaaaggaagaggactgagtccagaggtgaaagcagtcacgtatccccaaagacacctgctacacatttgggctttgatttatcaatgagaaggcttgagggacagtgggaaaaatgatgaggagtcattaggtccttgtggaaatggtgcccttgaaggatgagcctgtaatcactaggtacacgtgggtggatgaatgctggtgaaacaggtg

SEQ ID NO: 200660 - DNA, 179 bp, Homo sapiens
aggaaatttttaaacatttttattgtactaaaaaatgaatgcaatggtgttggcattcgaaaagcaaatattaggtgtccattgttgtggttttgcttcctgaatggggacaaaagatcccactctgtgtgcaagaacagcttccttctaggctgcagcggatactttattccagattc

SEQ ID NO: 200661 - DNA, 543 bp, Homo sapiens
ttggataaggagttgcttcttatggatgggcaaagaaagtgatttcctaagatggaatctactcctggtgaagatgctgtaaacaccactgaagtaacaacaaataatttggaatattacataaacttagttggtaaagtagtggcagggtttgagaggactgactcaaattttgaaagaagttctaatatgggtaaaatgctatcaaatagcattgcatgttacagagaaatctttcaagaaaggaagagttcattgatgcagcaaactgtattattgtcttactttaagaaattgccaccccagccttcagtaaccaccactctaatcagttagcagccatcaatactgaggcaagaccatccaccagcaaaaagattatgactcactgaaggcttagataatcattagcaccttttagcaataatgtattttttaattaagatatatacatttttatacataatgctactggacacttatagcagtgtatatttatactgtaaactatagtataataaatatgacttcactgggaaacca

SEQ ID NO: 200662 - DNA, 353 bp, Homo sapiens
gagaaaagaagccttcactaagctctaacgctagtcatagtgaatcgtctgttgtgttctcaccttaacgcggaagagtgatgtttcagtcacacgaaatgattcctaccatacaatacaacacttgtgtgaggctctgtcctaaatatctcaattaccaatatgtggtttggtagtatttctcatcattctttgctcaagtgcaatgagactacaactaggatgtgaattttgagtatcctgtctaaaactcaaacaacgataggaaaaatccatttgttttttcatttgatttttactaaggactcagctcaatcttaaatgaatactagtctttttccaaagcattgttg

SEQ ID NO: 200663 - DNA, 537 bp, Homo sapiens
  misc_feature (438)..(438): n is a, c, g, or t
  misc_feature (461)..(461): n is a, c, g, or t
  misc_feature (474)..(474): n is a, c, g, or t
  misc_feature (516)..(516): n is a, c, g, or t
agagcaaaccaaacacaaaattagaagaaataataaagatcagagcagaaataaataaatttgaaacaaaaaaatataaaagatcaatgaaacaaagagttggtgttttgaaccagatgaagtcagaaaaaagagagacaagattcaaagaaatagtatcagacatgaaaaaggagacattaaaccaacatcacaggacttcaaaggatcattacaggctaccacgagcaactgcacaccggctggaaaacctagaagaaatggatgaattcctatacacacacaacctaccaagacctgatggcttcactgctgaattctaccaaacaccgaacaattacatatatacatcagtgaaattcaacgaactagatcaacagagatcaacagagatgtcagaaaaacaatgttgagtgaaagtggcatggaaaatgtgtngctgttgatttttaggggctgtngatgcatcttttngtctctaaaatttaaacgctgatacagactttttaaaaaatngctttttgctaatgttgtcgc

SEQ ID NO: 200664 - DNA, 218 bp, Homo sapiens
agtaaaacataacagtcaagaaaataaaaaggtgagagtaactgtgcagtggggaaatcttgtgtgtggaaagaatgaatctgtaaaactgttctttcctaagagagttcagcaggatttggatgatagagagctttgtgtacaagggttccagttccacatagtttaggtctaatttcaaaggcaacttctagtgcaacctgtgactcacgctgtcc

SEQ ID NO: 200665 - DNA, 528 bp, Homo sapiens
cattcctgagatgccattttgaactcatttttgtcttctaactgctgatttggttgttatggtatttccgtacatttggaaatctagtggctatgaatattttatacaggttgagtatctgtaatctggaaaccagaaatgctccaaaatctaaaactttgagtgccaacatgacactcgaaataaatgctcattggaatgtttcagatttttgaattagggatgctcaaccagtaggtaaaaaggcaaatatctgcaaatctgaaaaaatcccagtctggtgtcaagcattctgtataaaggcctctcaacctgtatttgccttctttcgctgtctggtcaagtacttgtacattatgtatcacttattttaagcaagttagttgtacttagcagttattagagatgtgattgttggaagtgaatgttcagtgttgcaaagtgaaaatagcactcaggcaaaagttttctcagcaaggcagtttacttctgtagaagggtgtgtcttgcagatggagcaatcgtgag

SEQ ID NO: 200666 - DNA, 301 bp, Homo sapiens
ccactgggttcctgccaataaatggggtttggggttggctgcctggaattgctgtcgaagttggcagctgcttggcagctttgctttctgagcccaacaacagctccaagaatgtgtccggcaggatttaagcctgagctgggaacgcacatctgtgaggctctgatgtgaatattcagcagggagatctggatttcttctcgattgcctgtagcatcaaatctgtgacgaggcttacccaggactttcttctcctgacataattgcggttttcaaattcagttatgttcccactcttgta

SEQ ID NO: 200667 - DNA, 446 bp, Homo sapiens
gaccctgggttaggatggcatccagagacctgagccttgaacaatggtgtgatggttgatactgagtgtcaacttgattggactgaagaatacaaagtattgatcctgggtgtgtctgtgagagtgttgctaaaggatattaacatttgactcagtgggctgggaaaggcagacccacctttaacctgggtgggcaccatctaatcagctgccagtgctgctagaatgtaaacaggcagaaaaaatgtaaaagagagactggtctagcctcccagcctacatctttctcatgtgctggatgcttcctgccctcgaacatcggactccaagttcctcagttttgaaactgggactggctcttcttgctcctcagcctgcagacggcctattgtgggaccttgtgatcgtgtgagttaatatgtaataaactcccctttatatatata

SEQ ID NO: 200668 - DNA, 242 bp, Homo sapiens
ggaaaaaaaaaaaaaaaaaaaaggatgagctcataatgtacatgcaattgtgtaacttccttttttcaataaaaaatatcctaggcatccataagatttttgttatcagagaatggagataaaaatatggaaaggaagataacgaggatgaaccttctggagttggattccaaattgagtattggtggaaacattttcttcaatatatatggatagatttggaaataaatatacatatatgc

SEQ ID NO: 200669 - DNA, 513 bp, Homo sapiens
tagaggcttccattaattaggaaatacaggaaaagaatctattcatttccagtctctttttatattagaaatcctgactcaattttagttttccctggttctgtaccaggtgttctctgagttcctagaagcaaatcatgccttaaggatttaggagaaaaggcccaaagctcagtgtactcgacaggggcacagtgttagaaagtgtactaacttcgaccagatgtggtggctcatgcctgtaatcccagcactttcagagggtgaggcagcggatcgcctggggtcaggagttcgagatcagcctggccaacatggtgaaaccccatctctactaaaaatgcaaaaattagcaggctgttacaaatgcaaaaattacagctggtgcctgtaatcccagctactcgggaggctgacgtaggagaattgcttgaacccaggagatggaggttgcagcgagctgagatcacaccactgcactccagcctgggcaacagagagagattccgtctc

SEQ ID NO: 200670 - DNA, 107 bp, Homo sapiens
ccaggcgtgaatacttttccttggtcataaaccaaagctaaaaaagaagagttaagaaaactatttttttttttttgagagagagtcttgttctgttgcccaggctg

SEQ ID NO: 200671 - DNA, 906 bp, Homo sapiens
gtgcttgatcaggaagttcatctgtattgcttattaaaaattcatactcctaagcctcatccccagatcgactgaatcagaatttctgggagggatctccagcagtctcttaacagacatcctggacattcttgagatcaggcatatttaagaaatactgaattatgtgatccttctcccagcagattacctttctgattatatttttttgaaatcatatcatcccttttgttttcttgaacatactttaccccagcagcagtaaagaggcagctcaggattgctagtttagtattgaaaaccagaaagtgtgtatagctaaatactgcatgatattgtttgtccataatgtaagcatacttgattaacgagtattaacttagtgtgagtttattaacttattaacttattcatactattgtctgttccatggatagtgtcctgaagatggcaagtgttacatttagtctgcaaggaaacaagatctaaaacagtaaaatgacgaaccgtcatgaagtacattaggggtatatgtgtaggggctgatggggagaggttatatgtgtgatttgccatgtcttactctgcaactccttttcttaacattaaacttgtgagtgtgcttcaacctcagggacaaattgttgttatttagagaaatgaattatgcattcttttccttataattacatagtttatgtaccatcctctttgaacgtagcagaaggatttgtttcttataaagaaataaatgtgttggcctctaatttagtattggagtaatccttgtgtctcagacaaaaagatgaattatcaaatactttagggtactactgtgttacacattgttgaatctattatttgtgtgtataaatccatgattaaattaagtagtgttatctaatt

SEQ ID NO: 200672 - DNA, 415 bp, Homo sapiens
catactatatagtatgtttccttttcatatttgctttttttcccactcagcataattcctggaggttccttcaagttgtgacatgtatcaatagttcattcctttttattgctggatagtatttcatagtatggatgtactataatttaagcattgtcaattttggtagtttccactttgagctattccaaataaagtttctgtgaatattcatatacaagtttctacattaacataagttttcatttctctggggtgaatgcccaagagtgccattgctgggtcatttggtaaatatatttttttgtttttctgagatggagtcttgttctgttgccaggctggagtgttgtggtgagccaagatcacaccattgcactccagcctgggcaacaagagctaaactccatctcaa

SEQ ID NO: 200673 - DNA, 490 bp, Homo sapiens
ccctctagcccccttccttacctggtaagtcaaatgaaccaaatgtcaaacagtttggaaaggagagttgaagcagaaggaaacttccttctgcccctttgaatttgttactttttcttccaattaaaaatgtgttatttttacaataccattatattgacattgcaagggtccctgatgtttttattgttttctgttgtcactttgtatctcttctcccattcccatcccactcccattagcatcttctctgatgtgtttaatatgtatccttggatatatatgtattcttacatggtgttttctgtaaatttatataaatagtattacatgataattctcattctgatcctttcttcatttaaaactatgtttttcagttctgttggtgttgtgtttatatggtgcttttagccactgcattgtatttttattgctctgtctactgcgttttatttgcctgttcccctaagtgacagacaccttattt

SEQ ID NO: 200674 - DNA, 503 bp, Homo sapiens
aggcatttcacagaagcagaaacccggagggtcaatatccatgaaaagattgtcaacttcatgaatagtcgggaaacaagtgaaacaccaatgagataccatttcacttccatccaattaacaacaaagttcaagatcaacatggcctggtggcagcaagaatgcagagaaataggagcctcttatgctgctggtgtgacagtgcacacgcagacatcttttaaaaacaactgacaatacctggtaaaggggaagcatccacttctatgtatctgtcctaaaatcactcgcatgtgtacacaagaaaacagccacagaatgtgtggcagcattgtttgtagtcataggaaatttcaaacaagtgtactttgcaaatcacaggacagtcataaattatttgtgacatattccaataatggaaaactccactgcagttggaatgaatgaagggaatcaagatgcatcaaaatgaatagaaataaaaatatattgtgttggacaaa

SEQ ID NO: 200675 - DNA, 1094 bp, Homo sapiens
tgaaatacctcttcctctggggttgggaggtgggcagcaccacaagctgggaagaaactattggcaggagggaagatgacagaaggagtgctgctggaaaagctgattcatttcacccaaaacagctaggtcatcccagcaaaattctttgaatccactccagcttctcctctctccacccctactgattcccaccaggcagtgggacctgtggccaggccagcgggaagcactgtggaccttggccatggcttctagaggtggatggtaaagtctgaagggttctgccctggagtggttttgcctctcatggctgagggccttgaccttaccatggctgagggccatgacctacacagttggtctgtggagccatcttcctttgggtcatctgaaccagaaaggattggaaactgacagctcctgtagcacccaagcacatcctaaggacagccacctcctaccccaggatacagagagaaaaagtccagtaaagcagatggcctagccagatggagctagatccaggcaacagattgcagaccttcagggcagtgtgttagtctaagaggactgcctggaggagagggagccagaaggagggattgagatggattctaggttggagaacctgcagaaggcccaaagtggagttgggagagggagcctggtaagtggaagagtctgtggatataagaaggggaagtgagaggttgggtgatattgagagaaagctgcatgtgtgaggccagtcagcactgcaggacaatgggagctgctgcgacttagttcctaagctgggggagaaggggcagggcctagagtgaggaaagtgggctggatctccactaaccacttctgggactggctgactgcccagtggacagcaggaggaatggttagtattcacctggaccacaccaatatcaggtctcaggagcagtcaagggataccaccctccactgttgctgcggtaatccttctgtcccctccttcacttccattcattccacctggactatacagaactgtgctgggacctggcacaaagacaagggggtgtggcactaaactccaagcctagagaaggaaa

SEQ ID NO: 200676 - DNA, 643 bp, Homo sapiens
tcgaagttacacaagttgtttgtagaaaatatggaaattaccaagaagcaggaaggggaatccgaatccctcaaatgcagcggggagacggtgtgactttgcctcctgttctccttcgttcctgctgagtgtgagaggcctgcttaggtgctgagaggtgtgaggggcactaagcctccaggcatccagcaaccctcggccgcgtgtcgcacacatcccgggtttcggacgagtgtgaagctcacggaaaagccaggtgggttctccaaggtggagccacagggggacaggagagcgtcggtgaccagggtcagcatccggtgaggtgcagttttgtcctgcctttcacctgagctcctgaggggtgcccggtgcagaaaaagtcttcagagacccccccagtggccgcgcgcaccacgtggttgaaccccgaagaaggctgaactccatccaagcccctgaggccagacatctccacggttcccagttttccaatactgcggagagttttccagcctctccagggcagaggctgtgtctggtgaatgtccaggcactgcagcgcctggcacacggcactgggtaggtgcttaacacaacatgtgaacaaatatttattgaactacataaaggtaaaccactc

SEQ ID NO: 200677 - DNA, 642 bp, Homo sapiens
ataatacatctacaaacttacagttggaaggccctctggctgtcataatcatatagttatttaacatttgaaacctaaagcaataggtccttggtaaaatcagggccggcacaattagttgatctaaaatatactttatatccttttcatttaaacatgtcttttaagaataatctgggtatgtggttacctctgcccattcacttttgaaacgtaagagttattacttttccaaaaagcttcttaaaatttttctgattacgttttttcattgtaaaagaaattggaaagtaaaaggtatctgaaaagttttaattgatttttagcttgagcaaaactaataatccattttccataatttattatataaaatgtgatgatggtagaagaaagaaaagaattctactaagatggcaacaggtcccaccaacaccacttcctcagggtccagctaatcccatgagaagagcccttgcaatatgtaaaagatgggagcgccattatgcttgtcaccgtgagtagtaagtaccacgccactgaaatgtgctctacacttattcaaactgacaaatacaatgaacacattttaaaagtcaaatctttatagtaaagcaatttgggaggctagtttgctttctcgtg

SEQ ID NO: 200678 - DNA, 283 bp, Homo sapiens
ctggtgatggagaaaaggaagtgtcatccatacaagatgaatttacactctgaaccccaggaggtcctgcacgtaggaagtgcctacaatccaagtaccatgctctttactgcctctcctgcttccagcactgtccctggggtcatccaaaccagtacagtaacccagctggcctctcttcttctgaaaacatctccaacttcaacaatactttgagataccatattgctggtatttcaaaaactgctgccagcagggaggaggccaatggcgtgtccataga

SEQ ID NO: 200679 - DNA, 352 bp, Homo sapiens
cctggaagactgcaaaggagaagaaggtggcataaccgaggacccaaggccagcgtgggtcgggctccacgcactggtttggtattgcacgtggggacaaggaaaccaaatatgctgagagtcaggtagctcaagatacctctttatcattaagaaatttacaaaccagagcggctgaggattaaactgaggggagattagaaagatagcagtgggtgccttcattcactcccccttgttcctatgatacctctttgcaggaggaaggtccaagatccatctggaagaatatttcccaaagtgggtctctggagctcatataaagagatgctgcttggagaaagggagtcat

SEQ ID NO: 200680 - DNA, 480 bp, Homo sapiens
cccgaccaaaaacagggtatggtggtcaatcaggttatggtggcaagaaagattcttggagggagagaagaggaggcctggctagcagaggtggccctgtcgtgtagatgaaacctcctaggtagcagccctcacagagaaggcagatgtttctttcagacctttaaagatgtcagactctcagtcaatcttccctagatctggacaagggagggccttagagaaagatggcctcccatcagtgcagtttcctccccaggtgcaaatctccccccacagacctgccctctgaacagccattcacagtgtatcaaagaggtatattttggggtgaaatatttttattcccttcacccctagtttatcatgtgtttccttgatgggctgagggcttgacagatgagcagatagacacaatcttagttcatggaaaaggcacagaatagagatgggtagcggagagtttttaagttgctgctg

SEQ ID NO: 200681 - DNA, 439 bp, Homo sapiens
ccactcagattctgtgccccagagacctgctgggtgtgtgtgggggtttgggggtagggcatggggctcctgctcactgatttagcatttgctgtggctaaactacaaagtggacagtccacatggagacagttgagagctacttgcacccaggtcctttctttgagaatacagtgatgtaacaggagacttcttgcattttgcctatgtgaaaccagctggattttgctgaagctgtaattgtgtctctacattctttgattcctgtctaaaaaaaatggtttccacaaatgctgtgaagaatagactgacagagctggaaagcgttaagtagggatcctttaaacagatccctacattgtacattgatcccttcaaccacagccagagaggggcagggacttacttgctctgatcacacagtcagaacaagaactaa

SEQ ID NO: 200682 - DNA, 601 bp, Homo sapiens
gtctgaaatgtgttgagccaagatttactttgagctatacttttatataatttttttttgagacagtttctttcttgttaaaagaaaacagagttaacatataacccagcaattctactcggagatatattcatatgataaatgcttcggaggctgaggcactttgggaggccgaggctggaggattgcttgagcccgggaggtcgaggctgcagtgaaccatgttcatgccactgcattccagcttgggtgacagagcaagactccttctctaattaaaaaaaaaaagcacacacatggtggctactcttattttacatttttagaaaactgattggtggtataactcagctaaagctaagcaattttttaaaattcagttttaaatttttattaaatactgactgcaacctccaggaggtgtagtaatttagcagtggggacagtaatggggagattggaattctagctaaccaattcaactataatggctgggaaaacaagatttcggtgtaagtttaccagaggagagctaacaaagaactcaggcctgaagggttgtcaggacattactggggtgactatcttctcatctccgaac

SEQ ID NO: 200683 - DNA, 171 bp, Homo sapiens
tctgcatccttggtcacacagcagcccacctcagtgtcattgtaagttgtcctcatcctagatctggttgggggtctgcgtctagcttccaggctgtggctgctccctgtcacaatggcttatagttggcacgctcagcagaaattgctaggctcagaagcagctttttat

SEQ ID NO: 200684 - DNA, 355 bp, Homo sapiens
tcacgtttgaggaaagatgggttacctttgtattataaaatgcttattaaagtggttattttgcaatctcccaaatcaggggttagcaaactttttctgtaagaaaaattgcaggccttgtgggcccacggcaaatcaaagatattatataatgagaaaaaacaaaatttccaccatacaaaaacaggcagtggactgcattgccccataagctatagtttgctgatgtccaaatcaaagaagcaatgattttttttctagaatgggtgagggtcacaaaaatgaagagtaaacaactctacttaaaaatattaaatgaggccgggcgcggtggctcacgcctgtaatcccagca

SEQ ID NO: 200685 - DNA, 661 bp, Homo sapiens
tccttcaccaaagagtatcaacatgatgctagatttccaggcagtgcctcctgacttgagatgcaggcctcctgcgtggagcaaatggattccagactccagtatacggctccccgtggtgcaggcttcagtttccctctccccagcggcctcactaacagggtggcagcttagccagtccctgggcagcttcaacagctttgattaaatctggtctgcttccagtcctggagatgccagagaaatcacactgattaccctaacagactggatgaaacactaaacacatacattctgcacagcctcaacaacttcaggagagagagaacccagactctgggcaatgcctgtctgaatgactctttctgaatcacagatcagggatctgccatcagccctcacagtgattgttctgcaagtctggcagccctaaactgattcctgcttattctaaaatacagtattgagcactgggctggcttcgtgagtgtgcgacctgtgacctgtgcagtcatacagaggtcctgtgcttgtctgagaatttttttgagacacagtctcactctgttgcccaggctgcctcccaggcttaaaagcaagcctcccacctcagcctcccaagtagctgggactacaggcacacaccaccatgcccaactaa

SEQ ID NO: 200686 - DNA, 1035 bp, Homo sapiens
  misc_feature (1035)..(1035): n is a, c, g, or t
ctgctgtaagatgggggtatagaggctgggcaattcccaccccctgttgtatagttggactatgttataacgcacaaaagagagctgaccccagggggagccagagggtgatgggttccttgcctccctttccttcccctttctgcccaagcttgtgctgcagttgaacctcttcctgggggtgggagtaggtaaggggtgggtgaggccccaaacccctctctggtagggaaccgtggggatgaagatgaagcttatatgcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtn

SEQ ID NO: 200687 - DNA, 360 bp, Homo sapiens
ctgctgtaagatgggggtatagaggctgggcaattcccaccccctgttgtatagttggactatgttataacgcacaaaagagagctgaccccagggggagccagagggtgatgggttccttgcctccctttccttcccctttctgcccaagcttgtgctgcagttgaacctcttcctgggggtgggagtaggtaaggggtgggtgaggccccaaacccctctctggtagggaaccgtggggatgaagatgaagcttatatgcagttctcttctaggggctgtgggcaaagggcaagttttggattttgcttcttccaagtttgtttttaaacgacaaataaaaaaagaacattttaaata

SEQ ID NO: 200688 - DNA, 424 bp, Homo sapiens
gtggtatcacattgtggtttcgatttgtgtttccctaatgactaatgatgagcatcttttcatgtacttctgggtcatttgtgtacttttgctggagaaatgtctattcagatccttagcccatttaaaatggggttatatgtctttttattgttgagttataatagttctttatatattctggatactagactcaacagatttacagatgttttctcccattctgtgggttgtcatccattttcttgatggtatcctttgaaacacaaacattttaaattctgatgaagtccagtgtatctcttttttctttggttgctgtgcttttggattggtgtctaaagaagtcattgcctaatccaaggtcaggcagacttatggttgcgctataagagttttacagtttagcgcctacgttcatacc

SEQ ID NO: 200689 - DNA, 425 bp, Homo sapiens
ggggcaatgttgaatggttatcactgtgtgtcactgaggttttagggttgtttctcgggcagtgttgttttggcaatagataattcatacaccctactactagcactgcccaagactggattatctgtgacagggacttatatcagacttgtgacctatgaccttcgtctgatcacttttatgtataccaatttccctacctgtgccatccaacatggtagccaccagtcatgtgtgactacagagtgcttgaagcatgttagtctgaagtgagatgtgctataaatataaactacacacctgattttgaagactttctacaaaaatctaaacgatctcactgacaatttttattgattacatgttgaatgtattatattttagatatatcaagttaaaataaaaatatttggaaaattaaaaat

SEQ ID NO: 200690 - DNA, 243 bp, Homo sapiens
catgggtaggtgaccaagtctctccttacacagtgacttatgtgaggtcttatttgggatcaggagcctggcatcttgtgataccatcacaagatataccccccatgtatacatcacaagtatacatcactgtgatactctcagtttagtgcgtatctgttatcttttggcaacaattgctacatatcttactgttaattttattgaactcttattcattgaaatacatatgatatttattgg

SEQ ID NO: 200691 - DNA, 508 bp, Homo sapiens
tggtcctgaactcctagagctcaagtgatccacccacctcagctcccaaagtgctgtgagctgaaatcgcaggcatgagccactgcaccagaccctgtcccctctcttgttctctcctacagctccagggctgtaaggcttcacctgtcatcttaataacagttgccatctctgtcactcttctccctcctgggctggggatggggcaaatgtaagcttctccagttccccaagcatatgggtccatttaatataaaaggctttatggccaatcatgactggggaatagtcagataggatcggaagtgactagatttaagggaaattttaaactgtcagtggggcttcacctcaaaccactaaaaagccagaagaacgaagggatgtgtacaggaaggctggggatagtgtaagcgcctcatgactgggataatctactgtggagtcacacgggaggaccaggccttcaaagatgctttgattgaacacgtccctttaggaccttttt

SEQ ID NO: 200692 - DNA, 470 bp, Homo sapiens
gagagggagaatgctcaaagcagaggtggcagagggctaggaggtgggagcagtggtgggggaagaattgaacacacagttttagaggccacagtggggttgggtattattgatcatcagagcaacgggagccttttcaggactgcgcttgaggaggagcaagacaatgagatttgcaccccagctgctggatggggaggccagtgtggaggcggagggggtcagtgaagagactgttgtacaagatgagggaaaacatggtgataacttggaataaagtggatgtggagccagagagaaatgggtggatttcagagacacttgggaagaagaaaaggacatggagagaggtgatgaaatcagtaatggctcacagatttctggcctgggcgttggatggggagtggaatcgtgcttgagctagggcacgtgggaaaggaaaggtgttctctttttattggcagaggtaa

SEQ ID NO: 200693 - DNA, 291 bp, Homo sapiens
ggaggcagaggttgcagtcagccgagatcgcgccatcgcactccagcctgggcaacagagcgagactccgtctcaaaaaacaacaacaacaaaatatgtgatgcgaaaactgatagaactacaaggggaaatagatgagttcactgtctgcagttggagatccagcaccctctatcgtaaatggacagatccagcaggatgcagttgagtttaacagcaccatcacatcagtcagctgggaataatttacatctgtagactgcttcatccaacgatagcagaatgcacatt

SEQ ID NO: 200694 - DNA, 153 bp, Homo sapiens
agtttctttctgggtatataggagatgtaacaacacagaggtatcttgtaatctttcatctggaaaatcatattctgtggaggccagttggattcaaagatattagtgttatgaaaagcccttttagaagagcacacatgaatttaatttatt

SEQ ID NO: 200695 - DNA, 612 bp, Homo sapiens
  misc_feature (11)..(11): n is a, c, g, or t
tcaacgcttantatattctcaacgctatacttctcaacgctttatacttccgtatgaattcaagtataaagcgtgagctcaacgctttatacttcactaatcttttcttctggaatgtctaacctattaatctcatccagtgtatttcctatctcagacattatagctttcatctgtagatattagttttgggtttcttatatatattatatctctttacttgctcaacctttcctccagcctctttaatgcatgcagtagttacagttacaatgtctttgtctactaattctatcacctgtgtcatttttgcattggtttcacttggctttttttcttctcactattggttatattttcctgcttctctgcatgcctggtaatttcactttagctatttttgtattcctataaatattcttcagctttgttctgggatatagttatttgaaaatgtatttcaaataaggatcaaatgtttgatcatcttaggccttgcttttaaacttcattgggtaggaaccaaactaacattcagtctatggtttattttactacactatggagcaaaactctgagtattctacccaatgccctgtgaattatgaactt

SEQ ID NO: 200696 - DNA, 415 bp, Homo sapiens
agaccaggcggccgggcagagacgctactcacttcccagacggggtggcggccaggcagaggcgctcctcacttcccagatggggcggccggcccttatttcaaataaacctaattcagtcaaggaagttagcgaaaataccaatttcttacattttgttaagaattttttcatctaagttcgtaagagatattgctccgtaactttcttttcttgtaacgtcattgtcaggtttcagcatcaagattatgctggactcaaaatgatttggaagtgttcctcctcctctatgctttgatggcatttgtacacgattggtatttcttctttaaatgtttgatacaactgacaagtgaaatttatctgggcctagttttgtttgtgggaaaagattaataaaaaattcaatttattt

SEQ ID NO: 200697 - DNA, 322 bp, Homo sapiens
gaggacggaaggctggagacccaagaaagggttgctattgaagctccagtggaaggcagtctgttggcagagtccttccgtcttgggagggtggtagtgagtctttgctttattaaggtctgtaggtcagatcatgtaagctggagttcaaggcaagggttgaacctcaaattgaggaactggagtgaaaatcaagaacccaggccaggtgcggtggctcatacctgtaatcccagtgctttgggaggccaaggcaggaggaatgtttgaggctgggcagttcaagaccagtgtaggcagcgtagcgagacccctgtctctc

SEQ ID NO: 200698 - DNA, 666 bp, Homo sapiens
cttttaacataatagctttacaatctttttcattactatttttactgagcattttatttagtcctgcttgtttcagcacaatcgaaactgttttaagagtattagctgcttcatgaatcaaagagaagtcattccttcttgacattcccataattcccatcactgtagtatctgggcacagagaacaagatgatctacagctgtgttacccacaggggagaaggatttagacaatagttgccaggactatttgactctcattcacccaacatggactgaatgtctatgttactgacactatactaggctcagttcacagagctggaagaatttaagggccactatgcctattgactcctgcaggcaactaatcacttaaggttttcacacctaggattcctatagtgttactacaaaataaaacattttctgcttcaggctggcaaggtacaactcagaattaataaattactagtacagtcccatcttacttcaatactctgaccttaactgctttcttccttctctcaactctccaactctctgggctttccacatcttcacctcttcctccactcccttcggcaatttggattagagaaaagaaaacaaaggtgaaagatgagactaaaggcataatgaactgtttaaggggaatacaaggta

SEQ ID NO: 200699 - DNA, 712 bp, Homo sapiens
tttgaataccagaggacaggactaacacagagatagaagagacggaaaaggcacgcagaagatttattgagtacttcctgattacgacagtgtggaatttatataaagaccaggacaagacttaattttttgttttttaaacaactgtctccagttgtttaatggtaactagctttctcttaaggaaagtttttagaggctacgtatgcttatatgtcactggttagaacttagttgcatgatccgatgctagaaaatctagcctttattctgaaagagtatgtgcacagcaacagaaaacaaacctagaacaaatattgaggatgacctgctgtttgaagaaaaagcaagaaattaaatttagctcatagtttacttcctatgtaaaatataaataatcttattgtcagatatctttgttttagaaagtgactgctaatgttgggctagtactagagagaattttctgttatgtacattttatttagatttgacaagctttgggtcagtaatttcgttacgggtaggcactaatttttcaaagctttgggataagtaggggcagcaagagaaactagaagttgttttatggtccccttagatttcttcatctctgattgttagttattaatggccatattttaattaactgtggaagcaggtaaaaatgactttatcatgtgtttccttctttaaaacggctttacttaca

SEQ ID NO: 200700 - DNA, 392 bp, Homo sapiens
agaatctggaatctccctttttggttgccatatttccaagagaagaggaggaaaaagggctctacctgcttttcatcattatcccggataatcttggaagtccatagcccaggaataaattagtgttagaaaacggagtatgtagcaatgttctccctgaatcataacataaacctgtttgcctggtgtgtacacatttcattgtaccaaataagtacttctaaattctttttacatttaactggtgccatccagtagccagagcttgctttagactaaggtgacctgcttctgttggaagatttaccttaacttctccaacagaagaccaacaaatgtgaattgtttctgaagttggattaggtcctatggatgacagaagatagtctgcc

SEQ ID NO: 200701 - DNA, 353 bp, Homo sapiens
tgtgttgctataaaagaatacctgagagtggctcatggttttggaggctggaaattataagagtatggtgctggcatctggtgggggcttttttgctgcttcattccatgggagaaggtggaaaagcaagagagcatgagagcaagaggaagcagaactcactttaataacaacccactctcgcaataaccaacccaactccagtgtgaatgacgttaattcactcatgaaggcagtgaccccacgatctaatcacctcctgtttggccctacttcccaatagtgttgcattggggattcagtttccaacacacaaactttggggacatggttaaaccatagtaagagggaag

SEQ ID NO: 200702 - DNA, 486 bp, Homo sapiens
taaacattagcctggcatggtgacacatgcctgtagtcccatctactcaggctgaggtgggaagatcgcttgggctcatgaatttgaggtcaccatgagttatgatcatgtcactgcactgcagccggggcaacagaatgagaccccattttttttttttaacaaaatatccactagataaaatttgcaggagcctatagaaatccacagaaactcagagctcaggtaggagctaacaagcccagggtgtaaccactccatgcagatttaatagcagatttgatcagccagctgaatggattagtgaattggatgacggatcattaaaatctcattgaaactgaatcagagacatagagagagagagagagagccaaagaattggccaggcacagtggttcatgcctgcaatcccagcattttgaaaggccagggcagaattgcttgagcccaggagtttgagactagccaggcaaacttcagggg

SEQ ID NO: 200703 - DNA, 594 bp, Homo sapiens
cacaactgtaccttttcccatcgcccaaactctgctgtattcactgaagttaccagcccaagtcttacaatcctgtggagttattaggaattttacattttcctatagaaaggatttgttcaattctcctgccagataagcacatgtaatgaatgtccattctgatttctttgaaattattgaattctaaagtgctaatctgatgactatacagacatatctattttaaggtggacataaaatggacatacggtaagtgctagcaattcctgtgttctttttaccatattaaataaagatatctttcacacaagcaactgtcagtagtaatgttttactttaaagactattatgcctaagagttccttttgtttttatacattttgcccccttaatttggctttaatgatcagtcataatctgctatgaattttagggataaacatttgaatgaatgtgtacatcacatacattcattttctattcttttttcagtttagttgaaagtcacactgtagacctttagattgttgttttgaatagaagctctcagtgagactggagtgttattagagaagacattgcctgctgaat

SEQ ID NO: 200704 - DNA, 449 bp, Homo sapiens
cgtgcctgttatcccagctactttggaggctgaggcaggagaatcgcttgaacccggggggcagaagttgccagtgagcagacatcgcgccactgcactccagcctgggcaacagagttagactccatgtcaaaaaaacaaaaaaacaaaaaacaccattcccagtctgcactttttaggattattaaggttaaatttatgtgaaagcacatttcctatttaatcacttggcatcaatttaattgattttgtattttgttttaacttttgcagagtttagtaagaattaaactatttgttaaaagatattttctatgaattttaatattaaataaaataaggtttatttttgtatttgaaatataatgcacatcaggcaagaatagcacgaattctgcagtttgctttttcaaaatggtctttgtaatttaaagttcacccctagaggg

SEQ ID NO: 200705 - DNA, 439 bp, Homo sapiens
gtcacagggagccaagattgcgccactgcattctagcctgggcaacagagtaagactctttcaaaacatataaataaccagaactctggcactgctggtgggcgtgccagccagcacagcatctgggagggctcagcagcccctcgaaagttggacatgtgcatacaactcagcaactgtactcctaggcaggtgtcccagagggtgcctgcacagataacccccagaggcattttcacacaagtgttcctggcaccagcgttctgccgaccaaacagaggcatctgagtgcccatcggtaacagaatgtgccagttgttagggtctctgctaacgtagtgaaaatacgcaaatgatgtgaaattgaaacacagctttggggggtttctgtgtgtgcacccctttccagtgacatcagcacagtgtggatgcttctcag

SEQ ID NO: 200706 - DNA, 481 bp, Homo sapiens
aacagagatgtacaaggagaagagacgaatgacctatggagcttaatttataaatgcaaacagtacctaacaaacccacaggtcctaaactaccaaacctgctttaatttattaatgcaaacagtacctaacaaacccacaggtcctaaacttacaagagaagagacagtaatgctgtgtggactatgcattcagacatttagaaaatattgcaggcagagctggggattccgtggccagagcatatttggtgaaccgaggacgcatcaaagagcttctctggtgttcagtaacttgcactgtatttcagaggtttataaagggaagggacaggaaagcagtgtgccagtaagacaactcctcttctcgtctggattttagaggaatgcagtgaacaaatgatgaaaaagtctgaagggactttggtaattcagtatccgaaaaacaatcagtgttttgtgacattcttagttgtgatcta

SEQ ID NO: 200707 - DNA, 661 bp, Homo sapiens
tcaacaactgattaaagcatttccctgctaccatgattgccttgacaaattctgcagtgctggagtattttacctcccattatttcttccgctgaacaggacgtttggttctaattgttaagcctgcctaatgctgattgaagcgggccatagtatcaagggtggaagaaggtgggaatataaactagatttgctcccttctgtaggaataactctatgaagactttctttttggagacaaatcatcttatgcaggggggaaaaaaaactccctaaaaaagacaaatgacagcgcaagatccaaaaagacaagtgctcagtcattttgtcataatgccagaagagacagtaatgctgtgtggactatgcattcagacatttagaaaatattgcaggcagagctggggattccgtggccagagcatatttggtgaaccgaggacgcatcaaagagcttctctggtgttcagtaacttgcactgtatttcagaggtttataaagggaagggacaggaaagcagtgtgccagtaagacaactcctcttctcgtctggattttagaggaatgcagtgaacaaatgatgaaaaagtctgaagggactttggtaattcagtatccgaaaaacaatcagtgttttgtgacattcttagttgtgatcta

SEQ ID NO: 200708 - DNA, 504 bp, Homo sapiens
tgttgatatgggcaggaggcagggaaatattggataccagggggtgattccccgacaaaggccctaccatcaagcctgaagacccacagccctaagtgggaacagcatttctgttttcatgtccttttggcctgccatgcccccctatcctgtacccatataaatcccgaaacccaggctccagaagcagacctgtaggtgaggagacaagcacacgaactgtggaatgacgtggcagagaaagagagaagaggagggatgtctgaatgctgagatgagtttggctgggggtggtcagagaggagtttggctgctggacggccaggcttcaagggaagatcgtgttcccactccaacccctctttggctccccatccatcccactgagagccacctccatcactcagtaaaactcccacattcatcctttaagtctgtgtgtgacttgattcttccaggatgctggacaagagctcaggatacagaaagctgtcacactggccc

SEQ ID NO: 200709 - DNA, 447 bp, Homo sapiens
cttacacaaccggggattgtggggtgaggagttgagattgaggatcaagggacaagatcaaatatggaaactaagaaaatcctaaaatgcagaagaggagaaaaattaacacttctttaagaggaatcagaagcctctctctctctctctctctctctctctctctcctctctctttctttcaatctctctctctctcacacacacacatacacacatacacatacacaaacacacatacacacacagtcttagagaaatgattcagccttttaaatacacagatgcctgcattccctctcgctctccacataccctctggagattctgactgagtcagttcagtccaggactctatatttttaaaatattaatatcattccagggatttcagggaatatatcctggggattgccggacgtatctgctctagctctattgtaaaggc

SEQ ID NO: 200710 - DNA, 488 bp, Homo sapiens
tgctagaagatcctgaagctccttggccagacagctggaaggaaggctggcctttgctctggaggaccactcggctggcgaggaacattcgatgaggatttgggaaatgaagtgatttttaatattttgtatacgactcaagcgacatactaaaacacacacagatctgtcttgaaaaatgctggtaagcaaaacaaacattcaaactccaatttgcaccaccaggataatccctgttaaaacttatggcttgcgatgggaggcaaaactgccacttccatattaccttaccaaactaggatcaggtggggaaaaaaagcatgttgcactgtcagaaaaattataccaaacttagataaagtcaccttcagttactggatgtcatttcagggcagtgcaggatgtctattgatttacctatttttcaactctgtagacactgatgttaacatgtagatattttattcaataaatatgtaaatgattta

SEQ ID NO: 200711 - DNA, 302 bp, Homo sapiens
aggtgggctgaatgctgctgagaggtcaagtcggatgagggctgggaagtagccattggatttgacaaggagaccttggcatgcatggttgtagaggaggatgaaggcaaaagcctggcttgactgattcaagagcaggagatgagaaagtggagacagcatgcaggggcagccctgccaaggactttgctctaaaggggaacagagaaatggaggagaagcaggagggcaataatccgatagagaggaaaaatctgatgatacagaagagagatgaactgcaagagtcaagcctttgagtt

SEQ ID NO: 200712 - DNA, 409 bp, Homo sapiens
tggctctggctttggtgggcgagaccttggcctgagaactttggttcacaggaagcttcccttgacaatacttgagtgcaaagcttcatccaggtcccacctgggctgttgccaaggatgctcaagcgttctcttcaatcttccctgtgacttccaagaaacgacaagatctctagcccatccatcggtaaaccaagctgccaagtggcctggaaaacgcagtcagtacagataaaaagaacagggcttctcattactcttaaggactgctgagaacaaatcccccctctgcaatcagcaagttgctctctctttaacagaccttcttctggatgcagctatgcgagaggaagccttgtgctccaccatcctgttggaaatagccctattgaggacggcagccagaaca

SEQ ID NO: 200713 - DNA, 474 bp, Homo sapiens
actaatagaaaggctaggaccaaacctataatagtttatgctgtaatagtttatgctgtaatagtttagctgtccacagctgtcgaatctccagcacccagctgtatctggcataaaggtactacataaatatgtgtggactgagtaaacaaatgaacagataatgtgaaaatgagataaccttgtaagacgttcaactcttaaatgtggtacctagctatacagggcattacaatattattataatctaaggtatgcattttaatgaaaaactggctagaatagcatattgtgttagaaaacaaatgcatttaaaaattttttcttttgataatgttgccatcaaacaaatgcatttttaaatcatgtttaaggaaattttcggcgtaattacttaaattcatttctgttcttagaatacccttttggaacttctacttttttacctcaactttaattattgggactaaacca

SEQ ID NO: 200714 - DNA, 485 bp, Homo sapiens
tcctaagattagacatgtatggggaaacactaaagatggaaacggccctacaagcaaatggcccacaccctctttaggctgatgaaccaagagagaaggagctcccagacagggcttggtataggtggtgccttcagctcaaacctactccttcctattcagagccaggggacatgattgcactatttgtggccttgttgctgaacccccagcagcagagattatctgcggccctcttcccatttatctcaaagatgaaaaaacacagagaataaagggcaaagcagaacaaacccatgctatgtgagataagaacctgagctccaaagaagggttttggggaaagtagtagacataggccacttggaaccgacattagttttctcttccgggaagtgaggatgctgtatttaccagcaccttctatctcatatagttaccctctggatcacatgaaaaggcctctgtaaaagttcctacagaaa

SEQ ID NO: 200715 - DNA, 376 bp, Homo sapiens
gggtatggtgcatttacacagtgaggggtgggggaatcagtaacatgtgaggagcccgtcatgccgccacgtgggagtgtcctctctcctgctcacagggagtagttaggactggagatgagcccaagtttgtgaatcttaacaagggtgttgatgcctcaagactggacataatcaccaaggaagttggtggcagtgcagaagtgcacactggggtgccaacatgaaatggggaatgagaggctaggagggagtagctggtgcaagtaaagatgggaacacctgctgtgggtgctgccaggatggtgcaactcagatagaactgaccactaggatttggtaggcgttgacacataatgatgacatgtggggctgc

SEQ ID NO: 200716 - DNA, 220 bp, Homo sapiens
ggctgagcactggatccctgaagtggcactggtcataggcacgctagaaacatggatctctgtctatttagctgagaattctggattaaattcctagaaagccgctgaaggcttttaagcacaaaaatgtcttcagaactgctgcaggaatatacagtacggcgcccaacaggtacggcgccggcgtaccgacgctcgagattcgtacatcagtggtcat

SEQ ID NO: 200717 - DNA, 425 bp, Homo sapiens
atgcagcacaccaccatggcacacgtatacctatgtagcaaacctccacgttctgcacatgtaccccagaacttaaagtaaaattttaaaaaaatttaaaaaagaaaaccctaaaagaaaaatgtcactgtacaccaccaattattattcataaaagaggtatgctgtcttttttttaagtccattaatgggcaaaatctccttagggactttcataaatgtatgcaaattttaacttatcaggtttatttttcctagaaggtcttaaactattcaatcataagctctagtattatgtggtttttcaagaatatctggcctgtatatgcactgtatttccagcatagaacctaatactgatttataattgatgctttagtgctagtattcataacacaattattaaaatattaaacttgaactaa

SEQ ID NO: 200718 - DNA, 451 bp, Homo sapiens
ccatatgcaaagagtcatgcagagtttttctaattctccatcaggctgcttgagggagatgtggttttgatgccatgtaccaccagcatcctgggttttgtcccccttgctcctttattaactgttcttcctgtggtgtgtattcaggctccattggggaatcacagaaaagaagtagagctggaatctgttgggattgcaccctgagaactacagctttcgcttctctatcagcctttctgtttccttgtgctataagggttaaggccctttgatgctccctgcaatgaattacagctacagcctttggcaggtgtattgcttccaaaagctgcagaatttcaggcctatgctttacaggggagtgtttgctagttagcagccctcttcctttccagattgtagcatgagcatggcaagggttacctggtccggtggaacctcccttact

SEQ ID NO: 200719 - DNA, 543 bp, Homo sapiens
atctgtcttcttgactgagtcacagggtacagatatttggtgagacattatttccggctgtgtctgagggtgttcccagttgagacaggcatttaacttagctgactgagaaaagcagactgccaccctccccaatgggcggcggggggggcatcactcagtccagtgaggctctaaacagaacaaaaccgccaaggaagcaagaattctctgcctcagcctgactgctgagttggtatattggtcttctgctcttggactgggacttacaccattggcactccttctctggccctggaatggaaccacacctccatctttcatgggtctccagcttgtagacagcagactgtgggacttctcagcctctataatcacgtgagtcaatttctcacagtaaatctctcatccatccatccatccatccatccatccatccatcttcttattggttctgtttctctggagagccctaactaatagggtatcatatgtctcattgtatcacaagccatcattttaatataatttgctacattcaaa

SEQ ID NO: 200720 - DNA, 494 bp, Homo sapiens
ccgcatggcgtttctttcccggatcccgtttcaggaacgtttctgttggctacaaggaccgtctccaacatgcttaggctctgtgaactttcccaggatcctgagtagggtatccgccattcgtccttagggctccgggatgtctcgttcttactgtgtccctgccaaccctggtcccatctcgtcatgatcacccactgcagaagagaggaggtgctagagtgaacagggtcaggggagccccgttcatccccagggtcccagaatgaaccagtgttaccatgtacccctgcccttgccttcctccctgctctaatggccgtgtgttagccggagatcagtttgggtctgggtgctatgggtctgttgcgcctgtggccttggtccggcctctgtccttgtctctgtgaaatgagagtgactgtgcctgagagcgttccagcaagacaatgatgatctccactgtctgattcccgcttcccaggttctcacaa

SEQ ID NO: 200721 - DNA, 721 bp, Homo sapiens
cagagcagaccacagagttcggaattcacaaaccacatcttggcaagagctcaagcttggataaacagctgccaggccccagtggtggtgaggaagaaaaaccgatgggaaatgggagtccaagcccgcctcctggcacatccctggacaatcctgtacccagcccctccccttctgagatctttcctgtcacacactctttccccagctctgcacattctgacactcaccacaccagcacagcagaatctcaaaaaaaagccacagcagagggctccgctggtagagttgaaaattttggcaagaggaagccactcctccaggcctgggtctcaccctcggagacacatccagtctcagctcagccaggcgctggaactgggtcagccaagcacaggtgagagatgggggagattgtctatgtaaatgtgagcaatgtccccctttgcttcctacctgcagaggttacggctttctaaccacacagacgtctgatgtgacaacccacctgtcactgtcctgctggtagggctgccccttgtggtggtaatacctcaagacactgctgcgtttatagcaagaacataatagtagtctgtaaatatagcttaggaattgttctgcacggtcagatttggagctcgcacattgcagaaacgcaatgccaccagtatcttaactgtctcagaactaactggcattgagtggtagtagtatctac

SEQ ID NO: 200722 - DNA, 446 bp, Homo sapiens
aaaactaaaaacagtagaagagagcaaatattagccgagaaaaatgaaagaagacctaaataaatggagaagcatactatagtcatacattaggagacttgatattattaatatgttagttctctccaatctgattcatagactcaatgtaatcataaccaaaatcctggtaggctgtttttctttttctttttattcatttatttagagacagggtcttgcattgtcacccaggctggactgtagtggcgggatcatagctcactgcagccttgacctcttgggcttaagtgatctcctgcgtcagcttcctgagtagctgggattatgggtgcaagccactatacctgtttgtttattattatttttttttagatggaggttgctgtgggccgagatcgtgccgttgcactccagcctgggcaacaagagtgaggctccgtctc

SEQ ID NO: 200723 - DNA, 545 bp, Homo sapiens
ataaatgaggaccacgtccagatgcagagctgtacgtagaaattaatctttctgtccttgctccaaactctatgttttctttttttagacacaaagattaacactaaagaggtagatgaagaaactaaaaagggaaaaagcaatagtaaatttgaaagaaatagcagctgcaacagcaggtaatacatatccccagcagcttattagaagcaagacttgagcacagatacagagccgctcattaacgataatgccagttccagaattagcaatgccatttcttcctttcttcctgcatatttgtttaccctcacattgtggctccacactgcatgtgaagttcctaccttgtgccacatgctgggaatacaaagatgtgggaccctaatcttgccttcagaggactgtaagtctagagtggacattgctcactttctccttccccctatctcccatccaccacttattatctcctggatgccccattaagccatgaaaatgtgggagaaatcttagaagaaaaacagggactacttatgtttcaa

SEQ ID NO: 200724 - DNA, 468 bp, Homo sapiens
atgagcgctttggtctgatatggttgggaaccagtgtaagaggaaatattttatggctttcagtcttgataaggaaaataagaataaacttccacatattgaaaaaaaatggaaccctaaagaccgttatttccattgatgctttctaaaagcaatgattaggaaacaaataccttagggcagtcatggtggctcatgcctagaaccccagcactttgggaggccaaggtgggtaggcagattgcttgagcccaggagttcgagaccagcctgggcaacatggtgaaaccccttctctcaaaaagaaaaagaaaaaaaaaattagctgggcagttgcacatgcctgtagtcccagctactcaggaggctaaagtgggatgatcgtttgagctcagaaagtcaagtctgcagtgagccgtgattatgccactgcattctagcctggacaacagagcgagatcctgcctc

SEQ ID NO: 200725 - DNA, 367 bp, Homo sapiens
aggcttttaaaaagaggtaggcagcagaacacaaaagtggaaaggcatagatgtggcacagtgtggatgaggaactctaagtaactcaggctggctagaggacaagttatgcatttcatggcgtagtagcaaaatacaagaagtaggtaggagccaggatcccagaagtcttgagagccattcaaagaatgtgaattttgccactgaagagttctcactttttttgagacagggtctcactttgttgcccaggctggagtgcaggggtgagaacacggctcactgcagcctcaacctctcaggctcaagcaatcttcctgcttcagccccacaagtggctaggaccacaggtatgcaccaccacacc

SEQ ID NO: 200726 - DNA, 505 bp, Homo sapiens
cctgctgttctcagttttctcactgttcttagtttcactatggccggggggaggggagggaggaggccatgttaacgaaggagaaacagagctaaggataggattatctataaagtatagatatccaatgactcctgtgttcttaatgcccacgccttccgccacacctgcactggttgaactgtgcaccccccaaagtcctaaaccccagtatttgtgagtgggaccttatgtgcaaacacgatctttgtagctgcaatcaagttaagatgagatcatcctggcttaggatggggaataattgcttaacagatacaagttctcttttgggatcgtgaaaatgttctggaactagagagaggtgatggttgcacgacatggtaaatgcaataaatgccactcaattgtgcacggcaagatggttcaaacaggctgggtacagtggctcatgcctataatctcaacgctttgggaggccaaggtgggaggatcacttgagcctcag

SEQ ID NO: 200727 - DNA, 661 bp, Homo sapiens
tgggaggctgaggtaggaggtttccttgagcctaggagttcaagaccagcctgggcaacagagcaagaccgtgtttcaaatttattcattcaccctcattcatttattcataaataaataaatacataaataaataaccaaccaagcagacttgatctcaggaatgcaagaatggtttagcaacagaaaatgaatttatgtaatctgtcatattcatagattaaatgacaaaatgattgaaattatagagatggcaattatatatttaatgcaaaatcaaatcaaaatcccatcagaatttttttgtagaatttgacaatcacatgagtgaataaaagggcaagaataaggcaattttgaagaattattatttaaacagtaagcacagaccatgaagaaaaatgaaaaactggactgttatgacaaacaacaccataaacaaagttaagatatgttagatcctagaagaaagtatctgccttgtatataagcattaaaagggtggtatccagaatttctaaagctgccaggtatgatggctcatgcctgtaatcccagcactttaggaggccagggtgggggaggattgcttaaggccatgaatttgagaccagtctgggcaacacgatgagatcctgtctctacaaaaaaaaacaaacaa

SEQ ID NO: 200728 - DNA, 757 bp, Homo sapiens
  misc_feature (16)..(16): n is a, c, g, or t
ctactactactactanattcgcggcccgtcgacggagatagaagtttctaaggaaaaatatatctgcttctatactattggtgtgatgaatgaggtatgttaaggatgaggtttaaagacaattacttttaaaaatattatgcatggtagatattgaacttatgacctattctaataaattagagattggatttcaatctgaatttggttgtttttggcatgtccgtgtagaaaaacaattagcagaagtgtagcaaattaattttctatgaatagttataaatggttaatatttctaccagtttttagagcgttttcttgaaaaatgcatggggataaattttttctcttgatatactttttctctcatagtctacatttgttatgtatttgtaaaaactgttaggttactatacattaaactagtagtatagaattacttttcctggttgtgtatgaactatattagttttatcaagcatttttttaaatacttcaaaagatttttttcaagataattttttagtgagaacagtacagacgactcactttctatttttatgttgaaatgtgttttcttttactgtgactttgaaacatacttaacctaaatatattcttaaacttaagatttggattcatctatctgtgggatatctacctcctgcatattaatgagtaatgtgttggtgataaatagaaaaaaaaaaatcactagatgatttcagtagacattactattgtcaaaaaaaagaaa

SEQ ID NO: 200729 - DNA, 588 bp, Homo sapiens
ccagtagctggggctacaagtcctacacttcttaaatataggggatattgttgattaccaatatccccttgccttgttgaactgtaaaccaagagcagaacctttgtgtcctcattaatgtatcctaaattcctagaaaggttcctagcaataaatatgtggataaatccaagagaacaataaatatgtggataaatctacaataaataataaataataataagtccacaataaatatgtagataaatccaagagaactttgcttaagatgtatgtaagtccctttggatccttgtagcacatctgaggcatgtgtgtcagggatgatcagcctcattttataggttagtatatgtgtgtttgtagtgttttttgtttgtttactgtttgtgcagtgagtgttcccctctctctccaacttaatggtaatgtaagctgttggagaattaaggctgtgttttaaagctctattttccattgtatggggaaacttacacagtactaacttttttatcttctagttctttgacactaagtatgtaataaattgtagttaaccatattcaccctacagaattacagagcacc

SEQ ID NO: 200730 - DNA, 400 bp, Homo sapiens
gtgtaaacattatcattttctgtcagtgccagaatgtgagttaggcttgggaagcataatttcactcagaaatggaaagaagaagaaatgttattttgttacttttatttttaaactagttctctctcctattgtttaattgatgatgagatatataaatattcatattggatttaaaacttgaaatttgtactgggtagtttattgttagtgatgtcaaaagttatagcataaaagttacttgcataaaagtgtaaacatttcctgagcaatgcaatatgtggccaccagtcagttgtgttagttgacaaagggcaaacatgacctgttttctgagagtgctgttcacctgggttcttttcattttcagtactccttttggagaagtttggtttactag

SEQ ID NO: 200731 - DNA, 298 bp, Homo sapiens
gaccgagacaagtgaaccataaccaatactaccaatcaatactcatcattaataatcattatggctatacgcaataaaaccaggaatagccccctttcacttctgagtcccagaggctccccagaagcttctcctcctttttgaggccttctctggacaccaaccacgcaccagcttcctcaccagcaagattcatcacttctcccttctgcccctctggactgcaccgtgtttattcatgtgtctgacgcctgagcaaagtggagttccttaaagtcccggagctgtgacactcatc

SEQ ID NO: 200732 - DNA, 588 bp, Homo sapiens
ttttgattatttttgtaaaaagaattaaaaattttatttccagttgtttgttactagtatatgaaaacacaattaatttttggaatttggacttgtattttaccatcttactaaattcattataaattctagttatttttggtagaatcttaaaaatgtagatatcatgccatcttgcagagacaattttagtgctttctttgtaatttttatgtcagtttacttctttttctagccctattgtactagttaacaactccaatataatactgaatggaagtggtgagagtggacattcttgtcttgctctcagtcttaccgtcttagtttttcatcactagatgtgatgttagctgtaaatttataataaatgccccttattgagttcaggaagttgcattctattctgagtttttggagattttttaaaagaatgttacattttgtaaaattctctttgttctatatctacttgaatatcttatataaattttctgtttttttcttataatgtgttgaatcacaatggttgattttcaaatgtcgaatcaatcttatattcctaaaataaagctcatttatttagtt

SEQ ID NO: 200733 - DNA, 999 bp, Homo sapiens
caggtagtggcaggagaccctttagctcaaagggcaacgtgagtcttcgctgataattgctcgcgtcgcttcattgcaggccaactggccgctgatcgaacaggtgtctaggcagaaggagtaggagaccttgtgctaggtaggtgaaccagaaaccaccctgccacaacgtaaaggttgtggcagggcgaagccagaggaaactctggtggaggtccgtagcggtcctgacgtgcaaatcggtcgtccgacctgggtataggggcgaaagactaatcgaaccatctagtagctggttccctccgaagtttccctcaggatagctggcgctctcgcagacccgacgcacccccgccacgcagttttatccggtaaagcgaatgattagaggtcttggggccgaaacgatctcaacctattctcaaactttaaatgggtaagaagcccggctcgctggcgtggagccgggcgtggaatgcgagtgcctagtgggccacttttggtaagcagaactggcgctgcgggatgaaccgaacgccgggttaaggcgcccgatgccgacgctcatcagaccccagaaaaggtgttggttgatatagacagcaggacggtggccatggaagtcggaatccgctaaggagtgtgtaacaactcacctgccgaatcaactagccctgaaaatggatggcgctggagcgtcgggcccatacccggccgtcgccggcagccaaccgtggactagtagcctaccgtggactagtatccaaccgtggcagctagtatgcccaaccgtggactagtacccaaccatggactagtagccaaacgtggagctactagccaaccgtggactagtagccaaccgtggactaatacacaaccgtggactagtagccaaccgtggactactagccaaccgtggactagtagccaaccgtggactagtagccaaccgtggagcatagtagccaaccagtggatctagtagccaaccgtggc

SEQ ID NO: 200734 - DNA, 882 bp, Homo sapiens
gttgaggtggatctgaccgcagctttgatgacccgttctattgttttatcattctgcctgtcaggatactccctgttgaatgtcgtgttgcggctccgtggcgggtcctccatctgcagttcgcccgtccgccttggggtcttggggctgagccgttgttcgacaccctctattactggttccctccgaagtttccctcaggatagctggcgctctcgcagacccgacgcacccccgccacgcagttttatccggtaaagcgaatgattagaggtcttggggccgaaacgatctcaacctattctcaaactttaaatgggtaagaagcccggctcgctggcgtggagccgggcgtggaatgcgagtgcctagtgggccacttttggtaagcagaactggcgctgcgggatgaaccgaacgccgggttaaggcgcccgatgccgacgctcatcagaccccagaaaaggtgttggttgatatagacagcaggacggtggccatggaagtcggaatccgctaaggagtgtgtaacaactcacctgccgaatcaactagccctgaaaatggatggcgctggagcgtcgggcccatacccggccgtcgccggcagccaaccgtggactagtagcctaccgtggactagtatccaaccgtggcagctagtatgcccaaccgtggactagtacccaaccatggactagtagccaaacgtggagctactagccaaccgtggactagtagccaaccgtggactaatacacaaccgtggactagtagccaaccgtggactactagccaaccgtggactagtagccaaccgtggactagtagccaaccgtggagcatagtagccaaccagtggatctagtagccaaccgtggc

SEQ ID NO: 200735 - DNA, 692 bp, Homo sapiens
gcctgcaggtgactctatgagatccccccgccgagccaccgcccccgccacgcagttttatccggtaaagcgaatgattagaggtcttggggccgaaacgatctcaacctattctcaaactttaaatgggtaagaagcccggctcgctggcgtggagccgggcgtggaatgcgagtgcctagtgggccacttttggtaagcagaactggcgctgcgggatgaaccgaacgccgggttaaggcgcccgatgccgacgctcatcagaccccagaaaaggtgttggttgatatagacagcaggacggtggccatggaagtcggaatccgctaaggagtgtgtaacaactcacctgccgaatcaactagccctgaaaatggatggcgctggagcgtcgggcccatacccggccgtcgccggcagccaaccgtggactagtagcctaccgtggactagtatccaaccgtggcagctagtatgcccaaccgtggactagtacccaaccatggactagtagccaaacgtggagctactagccaaccgtggactagtagccaaccgtggactaatacacaaccgtggactagtagccaaccgtggactactagccaaccgtggactagtagccaaccgtggactagtagccaaccgtggagcatagtagccaaccagtggatctagtagccaaccgtggc

SEQ ID NO: 200736 - DNA, 120 bp, Homo sapiens
acccggccgtcgccggcagtcgagagtggacgggagcggcgggggcggcgcgcgcgcgcgcgcgtgtggtgtgcgtcggagggcggcggcggcggcgggggtgtggggtccttcccccgc

SEQ ID NO: 200737 - DNA, 216 bp, Homo sapiens
aatccacatctataaattctagacttttatgttcaaatataaatacaagatagcaagactgcttatggagattatctaatcccccaatttataaatcatgaacagaatataacatgtctttaataaaccagatctcacaatgcctctttagaagcagctttttagagggccagagtcctggaccaatgtcctcaggcactcttataaggtcactgg

SEQ ID NO: 200738 - DNA, 780 bp, Homo sapiens
gtgaagccaagacttttaaccagaaagtctagctttttgagcatgcattctgataccaggtaggagagggcacatataatggaaaaacatggagagaaaagggtactagagttctcagtaaggtcagagaactgataatattaggacatctgaaagagagaaatagagcagattgagatcagagaaagagttgtttgaatgtaagatttcataagtaacatagttacaaagcaggatatggctagaccaggggtgaaggtctccaagatgaggtctttatagaattaagaggctggggtattttgtgtgtccctaatgtaaaccataaagttggacagaatggtagcaggactttacatgagaatggaagagtgatgttaacacctcttaataccaccacagtggagtttaggtttcagcatgaatttgggaggggcacagacatttggaccatagcaaatggtgtcttacattcttttatcgggaaatagttttccattttcctcattgactaggattcggtatttctttaatacacttacaaagctttctattaaaataataagggccctaaatttagcaagccctaagtgtgttttgggatgagtcataaaatatttttcttaagttttgagggtcacataagaaaaatgtatatagagactgggcatagtggcccacacctgtaatcccagcactttggaaggccaaagcaggcggataacctaaggttgggagtttgagaacagcctggttaacatggtgaaaccccatctctac

SEQ ID NO: 200739 - DNA, 306 bp, Homo sapiens
agtgatgtgttgatggtatattaattcaggtaagacaatatgaactgtaatagtgttatgcttcacatgaatgtcagcaacatacaaagaagcctaataaacgagttcttatacttttggtggaagtatatatgttagtagtttttaatgaaatatatgaatatatgttattgaattctattagtcttctgtatctttcagtggaaaatctctaatgataaaaataactgctcaaaaataaaattacataatgtgtatgaatacatatcataaccataataaaaagatgttatttaaatgctattt

SEQ ID NO: 200740 - DNA, 575 bp, Homo sapiens
ttaaaaaggggggaaaaaaagaatgtaacggaaatctatttccacaatacacccaagggtaactaatgtaactaactggctaatgacaatacaagattaaaataaacaccaaaacccactatacctggattcatattacttagatgagaagctaagttaagatattgtagggaagctcacttaattacactggtgatgaaattgtcttttctcttttcttgagtttaagcagttatgccttgggcccaactttcctgaccttgtgagtaagttgagccacatgttcagcagaagatatcacagtagctgtatttttataagaaaattcctttttaattataaaactaaagcagagaaaacaaaaaaaaaaaaaaaaaaaggaagaaaaattattcctaatcccaccaccttcagataccagaacggttaaatctacatccacgactccttttagaatgaaaggatgaggttcctccagatctttggccggcagatagaagtaggctttctatgtaggcagtcttcttaaaggccttcagaagctatttcactaacatttaccctttccttcaaat

SEQ ID NO: 200741 - DNA, 688 bp, Homo sapiens
cattgtcactgaatctcaaccttgtcacttgtatactagcacaagagcaactagattcagtctcagctgttttgtattttatgcgacagaccaatttgaaagaggcttcaactattgtttgtctactaaagacctcattaactaaactgagggtttggaggcagggtttttttgtgggcttgaacccaggagttggagaccagcctgggcaacatcggaagacctggtctccataaaatatttaaaaattagctggatgtggtggtacgtgcctgtggtcccagctacttgggaggttaaggcaggtggatcaattgagcccaggaggtcaaggctgcaagtgagctgtgctcgtgccattgcactgcagcctgggcgacagagtaagacactgtcttaaaaaaaaaaaaaattagttctgtcctgcaggattattgccaaaaataaacactgagttgtatcatactctaaaggtattggtgacagctggcaaattagagtatttgtaagtggccttataaataggagtaacagggacctcctgccccatttttgagttccttgttcattgagcaactaattttgttatggcttcttcatttgtagttgagacaaacttagtatgtcaggtcataaaaacattggttttaccttcattagtctacttcctctttgctcttttaaaaaa

SEQ ID NO: 200742 - DNA, 749 bp, Homo sapiens
gcctttagatgtctacagtaccactgacggagtaccaggtcacatggagtataggccccaggaagaaaagatatccatctcccttgtctcttggtgttgatccatctccctgtctagaatagtgaaagccttctggaccagggagtctcttggctcccacttggcccgagtcagccgcagcagtgtgaactcttcatcagtcctttgcagcgtaacttaactgggagtaaatgtttgcaacccctggactgcctcaggtcctttagctttggtgacctggggccatggagtcagcctagcattctcctctctgtggctctatgtacctggcatggtgcagtgaggcagaggggactggagagataggcacaagaaatgaggtcttggtccagaagttctgagccagacccagagattgctcatggtgggtgatattagcatgactcagatttaatctaggttttatttttcttctcatttttatgagtaacaataatcatttatcagagatagcagataggatctgatagcagatgcttagacatttgcaacttatcttttggactgtttttattgaagaagaagtattctgtgtttgaaaatatccacatcacctttgaatgtgctgttgaagaagttatttgggtggctaggttttttgagaagtgatcaggatatgaaagaactggaaataccacagattgtgcatttgtgacactccgacccccactcctcagccaccagtgaag

SEQ ID NO: 200743 - DNA, 467 bp, Homo sapiens
aactcggcattgtgtgatcaaagcaaataaatatattcttgttttctggaattactaaagctttgaaaatggacttatcgacctcaaaccaatgggacatattcccatgtggcctgctcccctgttaggtttcccaggagtatttgcaaatatgtctgaagagggaagagaaagaaaatgattccaaaaaagctgataacattaagacatctgtttatagaagatgtaaatttgcaaccacaaattaaaagcttataggagctacacagaatgtgaagaaaaataaatgaaaccaaaccactacaagaaataaccaaactaagaagacagcaagagaggaaaaataaagaactgcaaaacatatgaaaaacaattaaccaaacgcaagttactccttacccatcaacaatgactttaaatgtgaaaggattaaactatctaattaaaagacatagagtggcacaatg

SEQ ID NO: 200744 - DNA, 733 bp, Homo sapiens
tggctaataacaaagggaggggacagtgggtgctgtgtgggcaaaaggagcaaaaaataatcctaatctgtctagacttcatctcagaagccatatacaaccttcttcaatggaaatatttaacacttcaggagtgccaagaaggctatgaggaacatatctcttaaggacttaagttagggcattctagaatgtatgctttatggatttaccttataaatatataactgactaatacacacagaaaatatattgcagagtaacatagatgacagaacttgaaatacatgacattctaccgcagtctatcattattttctaacttatcaaaagactcagaggatcttttttttcgtattgatagatttttaactagagccctatttacttgtgtcttgaaaaacagtatttgcaaatatgtctgaagagggaagagaaagaaaatgattccaaaaaagctgataacattaagacatctgtttatagaagatgtaaatttgcaaccacaaattaaaagcttataggagctacacagaatgtgaagaaaaataaatgaaaccaaaccactacaagaaataaccaaactaagaagacagcaagagaggaaaaataaagaactgcaaaacatatgaaaaacaattaaccaaacgcaagttactccttacccatcaacaatgactttaaatgtgaaaggattaaactatctaattaaaagacatagagtggcacaatg

SEQ ID NO: 200745 - DNA, 560 bp, Homo sapiens
tacatagacatgaaatgaaaattggagagactgtgttatccatttcgcgatacaccctggcagtgatacctgtgatggctgtgacccacagcaggtcagagctcactttcaccttgataagaaaggtgaatgtttgtcggtccaacactaagaagaaaaagattctggaaataagaaaataatttgtaaaatgtgagtaaaatatggtttacagaatacagactatgaagatgaatagacactagagcttccaaaatataaaaatagagctggaaaatgtagtgagaagattggaagtgaaggaactttccaaaaagatgatgcttctgcatctattcattctgaaattactgacagcaacaaaggtcagaagacgttgaagaagatgggttggaaaaaaggagatggactgaggaagatgatgggagaatgaaaactccaatttagtgtcaagttcaccaacacacataggctcggagacaggaaatccatcctcaattgaagatgttcaccttctccgaaacaaaacaaacaaacaacaacaacaacaaaaaactggg

SEQ ID NO: 200746 - DNA, 525 bp, Homo sapiens
caaaaaaaaaaaaagaaaaactgttttttggtttttttttttgttatcctaacttttgaattacttcataaagaagtttagtgatctatttgattatgtagaagctcttctgatagttatacatgcttaatcatttaagaataattaaaggaactatattgtcatgttatcaggcattcctttatgaaaatgttagaaactcctctttcatctataccttccccactgtttaaccctccaatcaaaagcacatattctgtggtaagaacagagaatatctattttaaaggtcatttgtgtcaaattgtcctaactagctgttgggattgggaggtgctatttgggtcataaatagcaagttttctctcccaataaagcaatgtctgagaatcccaagattctcatttagtagatctgggttgagacctagaagacagttaattcatttagccaccaaatgtgtattgagtgtcttcctattatatatttattaccatattgtgtaggtagtgttagaagacatcc

SEQ ID NO: 200747 - DNA, 387 bp, Homo sapiens
aagacatgagctgtttaagacctggagcgatgaatttcttcaagactgtgcttagcatgaagcaatgtcaggtatatagctagtgctaatagatgctggtggaatcctattaatctgagagctcaccttgttaagtatgtgttaagagatacaaagattaacttggaaactgctcattgtattcatgcctcccctccctggtctgtagctcagcccaataatgtcaacattgactatcttatactgaccatttcctgtgtttctgcggcaaacgataagtaagaaataagcaatttaaatctaaagtgtcttatatgttctatttccatgtagctcaaaaatactataaatttactaaaattacaataaataaatttcaagtcttta

SEQ ID NO: 200748 - DNA, 301 bp, Homo sapiens
ctccagggcactagagaaaggagctggctgagataggcgcggagggtgactgtgtctctgcatgtcctcaccggctccacagccgtgaataagagtgtttgaggccatctttttttcaagtgcttttagaaatcaaacaatacatctttattttttcttcctatcgagtgttcatgagcaaagatttggagcaaaaccttgtgccacgcaaatcagaatgaattgtagttctgaacttgatttaaaaaaattaaccacagggtagaagaaatccagtagagcagtgtgaagccaaatgaaa

SEQ ID NO: 200749 - DNA, 366 bp, Homo sapiens
aggggggctggccaaattagtagggtttatccattaaaaatttaattatgaaagtataacatacctattgcaaaaatttttgagatagattttatatctactgacataaaaagatgtcaatgtgtagttacatgaaaaatgcaagttgtaaaacaataatgcaatgtatgatcccattctggtttgtatgtttatgttggtatagaaaatatcctggaaggatacacaacatgctgttattagctacgactggagagtaggatttgtttggggatctaaggggagaatacactttttttctttctttctttcttttttttttttgtgacggagtctcgctctgtcacccaggctggagtgcaatgg

SEQ ID NO: 200750 - DNA, 578 bp, Homo sapiens
attttgtgtgttagtttatcatatcaaggtgttcatgatgtagtatattttgttattgatgatgtgtaccttgatcacttgtttgccatagatactttcaacgcagttgggttgactaggttatgtaagtcctgatgagcagagtagcacccatatttccgaaacatccatacaggccattcagtaaaagtgtcctaccagtacaactaaatgtgatatatctttcctccaaattacaagataccctccatgaattttatctatttcttaataggaaatgaaatcagtcaaatgcattttctgtgtctattgaatatggtcctatggattttctctttgcgttagctttttgttgctgtcttaacgaattaccacaaatttagtggtttaaaacaacacaaatttatcatcttattgttttgtaggtcagaagttccatatgggtcatactagaccaaagtcatagtattgggaggctatgttcctttctggagattctatgaaataatttctttcccgttcagttagactattggcagaattcagttccttgtggttgtaggattgaggtagtgttc

SEQ ID NO: 200751 - DNA, 809 bp, Homo sapiens
tgcgggtttggaggtttccagttgtccatctgtgttagttgtaagtgttctgggcagaatagtattgttgccccaatgcttgccctagcagagctggagtttgtgaacgtgctcagatgtgtgtctcctacaaagaagggaaaatgaaccctcgtctgagcctagaacaagttttaatagggcatgtctgacatttcaaattgtttttctcttgctgacagtctgcccccaggtgcatctagggccttggtcagcttctctgttaccagtggctcactttataaaacagcccacagggataagggctgaaaatatagccacttggctacatcattgactaattaagtaagttaactgtggatttatagcatcttttcaggatgttagtgttttgtgagccagtggaaaaaataagcttctatttcttcatttgtaaaaccagagagttggattagatgaatctctaacgtcctgtccagctcaaatgtgctttcctctatactagggtatagatttttgaagagcctagctgacttcagcatcacctcaccctttggtctccagtattacttctttacattttacttcattagctatttcttaatattaaatgtctgaagagtgtggcactgtatcaggagttggggcattgaaaggttgaagacatcatgaaatatctgggaaactctgctcttaaggaaattgcaccgatgttggaactcattgtccagttaaagagctctttggggactcaagcatattattcaacatgttgttttgggattatcttcaaatgatagtcacctacc

SEQ ID NO: 200752 - DNA, 517 bp, Homo sapiens
ctttctgtgtgattcttcacactgtgaatgcagctactaataacaccgattttacttcagaggagttccctgtgcaagggaagcacatggtagggttaatgctacatggaacatgaactctgaagaccctcattttggtttccatgaaggtggtgaaggttctccaaataaaagcatttccaataagggtgaagagtagagagcagtgatgtttccaaaaagtttagaattcctccttcaaatgacttcctaatgaatatcagaaggcaatgtgtggagtcacaagtcattggaatggcacccactgtgtaatttcaacaaaacacttcatccctctgagcctctggtggctcatctgtaaattaaggcaaattctatcttcaaatttcttcactctttgatcaacaacttttattcaactttgttgaaaagaacaaaaaaattgcatctctggttgaatttggtggctctttttctggttaatataaaacgtgactgtcagaatcccatctctaaa

SEQ ID NO: 200753 - DNA, 557 bp, Homo sapiens
aagacttgaggataaactaagataatcaaaatgatgcagagaaagaaaacttctctcttttaatatgtacagttttatttgtttgtttgctgaggcaggaggatcacttgagcccaggaggcagagctttcagtgaacggagatcaggaccctgcactccagcttcagcaacagagcaagttcagggcaggaggcggggtgtggtggggggaactagccaggggctcatcagtctcccttcattttatgaggctatgttccccttttctgcagggcagtgggaatttgtgaggatgagcattggtttaaccctcacacttcgaagaaatcagaaggatcagggctgctcaattagaattgttattcccactggtccctcatgcatacatattgcatttattcattcaacaaataattgttaaggacccattgtatgcccagcactgctttaggctctggagttatagcagggaacaaaacaaagacaatgctctcataggctcacaaattctgctgagaattcggataagaaataagcaaacaggctgtgcttggtg

SEQ ID NO: 200754 - DNA, 199 bp, Homo sapiens
gctggtaaagaatttttaactagggcaggctgaccaagttcgttttaaagataacacccagtgttgaggcttaataataccaccgctatgaaccttgcacataagctagtcatacatacatcttatctctggctagctttcagcctctggaggaaagcattgacgacattcatctttgattgcactataatatccagcc

SEQ ID NO: 200755 - DNA, 165 bp, Homo sapiens
caggtggatcctaatggtgagttgtttgcttgagctgagctgcagaaatgggttggagcatgagcaagggcaagccccagacaaccaagaacatttcatattctgctccccataggatgcaatgtgagattgatactcgagggacctccaccctggctgtgttca

SEQ ID NO: 200756 - DNA, 644 bp, Homo sapiens
gtgacaggaccaccaaaaatcttatttcaaacatttaataacctgaacaatgacacgctgttaaatttaaccgaacataaaactttacgaacctgatcatctgaatgtccttataaaatgtatgtatataaaagatcggaaatattacaaaacattaaagatgattatctttgcatggtagaaccaagagtggtttttattttcttgatatttttctgcatttctctaagtcgccataataaacacagactgtatctgtagggtttattttaggctattaattctttaaaggaaaataacgagcatcaacatttagacagattttcctctacatctgcccctcccagatcccctctcattggccaggaggagcagatgggactcaaaggctgtaacttttttcatttgtccctcagcccctctgatttacctagctcctgaaggaaaacagagcatctgggatggacttctgctaccctctgaattcctgagggcctgctttgcaagccacctaagtctgctctgaagcctgctggtgctctgaaatccttggagggaaaaatcaccacccaaacgtgtgcagataaacaacactgctaggtgtctgtccacattagagtgccggtgacgcgatgaactctccc

SEQ ID NO: 200757 - DNA, 237 bp, Homo sapiens
tgcaggcaagagcaaaagcagcagtctcaggctattcaacttccacaaagcctccttaactccggttgggaagtacagttgctgattaactgtgttaacacagcacagtgctcagaaggccaaaggtcaaagactaaggtctgaagccccacctcctctgtgcctgggcgccctgcacatctgtggccggcgtaagcacctctgcgagctttctgagcacctgctgcccgagcgcct

SEQ ID NO: 200758 - DNA, 479 bp, Homo sapiens
tctgctttcctgccctgatttgaccatcagaccttttatattagacatgatcttgaaacttacagaaaaagtacagtgagaaaggtctttatgataactaacagcttctccaattactgctttagttgtgccaagaacttaataaaggaggcttaataatttataggggaatatcaataaataaacaatgtgcacactttaccatgtttagtataaatgatatcgtctggagattagtgaatggaaaggagaggagataaaagatttagtaaacctatcctttggcaagactgcccctaatttaaacatcatcatatgcatcttaacagttaacacttatggaacactcactatgtgcaatgatcttgcattatggttttattttcttttttggagacagagtctcactctgttggagtgcagtggcgtaatctcggctcactgcaacatctacctcctgagttcaagtgattctcctg

SEQ ID NO: 200759 - DNA, 676 bp, Homo sapiens
ccagccttggcccccgtcaggcagcggttcactccctcaccagggatgtcatgttagttctgctgctctcaaggtgtgtgccctgggggagacgctgtgctgggcagtaggagagaattgaggtaggcatctccacccccatgggtgggagcttctacaccttgggtcagaagcttaggagtgggggctctgtctaccaggctcctcaacccatgccaggcgttgcttggggagttgggctggaagctgcgtggtctcagtgccctgaggaaggccttggcatctcctgcagggagtaggggtggcagggcccctagtcacccaaaactggctcctcagaatgcctgaggtgtgtccttccacctgcctgcccccactcacagaagagatgcagctgatgtgcagaagccaggctgagccgagccaagctgcctgtcacccctccgttcgccggtcaccccagttactgggaagcctggcttgttggagccgctccctgggactgtgtgtggggtgtcagggtctctgaagggaaaggcagggctcctgtctgagcaaccagctccctccaggcctcatcaaggcccagtgcgtgccctgcatgcaggctcggccatggtctggctgtaaccccaccttgcttgtaccctctgtgcagggaggaggagtctcctga

SEQ ID NO: 200760 - DNA, 258 bp, Homo sapiens
tggtattatgccgggactttgaagagtctatcagatagtgaaggaattgcgaagccgtactatgttgaggtctccagaataaacatcctcagaatggaaggtccagatgagaaggttaccttgatgagaggcctttatgctttttgtgctattttcctttatgggctctggtagttctttagtgttttataatctcttttcagagaaagctttttgtaaattcttcagattttactttttaagtaacacttacaaaag

SEQ ID NO: 200761 - DNA, 463 bp, Homo sapiens
ggtggcacatgcctgtaatcccagctacttgggaggctgaggcaggagaatcacttgagcccaggaggcagaggtcgcactgagccgagatcgcaccactgcactccagcttgggcgaaagagggagactctgtctcaaaaaacaaataaacaaacccaaaagaaacacacctaaacaatattaatattaccaacagtataccattattaaatgcagttgatttttttctgattttaggctttgtcacactaaggatatagagtcaaattaatgagttttacagttaatttgtgtggttatgccagtgactcaatgtactctttatttcttttcttttaggaaatgctttgttattttcttttaaaaaaatagttatgtaggctcttgagctgcttgctttggcccactcttgccctgaggagtatactttcattttcaatacgtctctgcttttgttgcttc

SEQ ID NO: 200762 - DNA, 551 bp, Homo sapiens
gaaatcagagtagggtttacctctggataggcagggatggaggttgtagtgataatatgttctgaaaagaaacacagttgagttttacggggttttggaaatgttttgtgtcttgatctgcatggtggttacctgggtgtatacatgtaaaaataatctaactgttcatttaagattagtgcacttcagcaaaggaaaatgtcagcagagtgaacagacaacctacagaatgggataaaaatttttcaactatgcatttgacagaagtctaatatctagcatccataaggaacttaaatttacaaaaaaaaacccattgaaagtggggcaaggacataaacagacaaaagatgacatatatgcggccaacaagcatatggagaaaaagctcaacatcactaatcattagagaaatgcaaatcaaaacaacaaagagctaccatatctcaccagtcagaatggctactattaaaaagtcaaaaaccagcagatgctgttgaggttgcagagaaaaaggaacgcttatacactgttagtaggagtgtaaatta

SEQ ID NO: 200763 - DNA, 660 bp, Homo sapiens
gcccaggccgaagtgcagtgacatgatctcagctcactttaatctccacctcctgggttcaagtgattctcttgcctcagcctcccaagtagctggggctacaggcgtgcaccaccacacctggctaatttttgtattttcagtagagatgggcttttaccatgttggccaggctcgtcttgaactcctggcctcaagtgatctgcccgccttggcctcctaaagtgctgggattacaggcgtgagccaccatgcccggccccttgagatgacatttaaatttaagctgggtttgaaagagaaataatttgtcagatggaaggaggaaaagagtgttttataggaagggaaagcaggtacaaaggcatgaaagtgagaaactgagtagtttgaggaactgtaaatgattccattattttggagcatcaaatgaaatgagatacaagcagagaggaggttgtttccttgataaggagctgggactttgttctctgaacctgtgttcctcaaagtgtggtccataaaccacatgcacgagaatgccttgaggtgcctggtataatttaaaatctctgaattccaaactgctcttacagaattagaatctcttgagatggaccaaggatctgcattctgcaagctccagtgctacttatgcac

SEQ ID NO: 200764 - DNA, 671 bp, Homo sapiens
acagtcccatatgggggtgatgggaaccagtgacagatcatcaggcattagattctcataaggagcatgcaaactagacccctcacatgcgcagttcacaatagggtttgtgctcctatgagaatctaatgctgctgctgatctgacaggaggtggagctcaggtggtaatgtgaatgattgggagcagctgtaaatatggatgaagcttcgtgctctctctgtccctgctgtgtggcctggttcctaacagaccacagaccagtactggtccatggcccgggagttgggggccccgggcttaaacaacagaacttaattttctcccagttctggaggttaaaagtccaagatcaaggtgttggaaggtttgttttctcctgaggtctctgtccttggcttgtggatggccaccttctcactgagttctcacatggtctttcctctgtgtgtgcattcctggtgtctcttggcatgtgcaaatgtcctcttcttataaggacagcagtcagagaggattaaggcctaccctaaggggttcattttaacttaatcacatttttaaaggtcctgcttctaaatgcagtcacattctaaggtcctgggggttagggcttcatcatataaattttgggaggatagttgaggccacaacaagtgctgtcagctttt

SEQ ID NO: 200765 - DNA, 151 bp, Homo sapiens
gggaacacaggacagtcagaacaggaaacaggaggcatgaatagttagagcgatccaggtagagtcaaagaaagcgataaaagaacgggggtactcggaaggaacaagagacatttagagggaataggaaacagagggaccaaggaaaagt

SEQ ID NO: 200766 - DNA, 327 bp, Homo sapiens
gaggagttggagaaaatagtattttaaaggtgacagagaaaatgaagcagcatgtataaatctctcatgaatactacccgaagatttcaggtaatagaagaggggaagtataatctaaggaaaatgaatattggtaattatttttgtccttgaattcctaaaatagccttaaataagaaattaagtgcattaggggctgggcacaggtttcaccatgttgcctaggctggtcttgaactcctgagctcaaatgatccgccctcctcagcctcggaaagtgttaggattacaggcgtgacgactgtgcctggcctaaccctgcctctt

SEQ ID NO: 200767 - DNA, 488 bp, Homo sapiens
gcatcactggcacagttaggcagcgagagggtaagagtcacagagcccgccgagggtggggagcgccatgagtcccatcggagagagggtgagcgggactctgaggcctggggcagtgccacaggtgcgggtgtgaagctggcggtgggccactgaggtcctcaggctgaggggcggccagagtgagggatggagagaagccttccatgaacagcaactcaggctaccaaggtccctttggggtggctccagtgacagagaatgggcggggacgctggtctcaggactgcttcttcccatcctgaccttcgggccccttacctgcgggccttttcttccaggtgagccaggccagcagcggggggacgacgccatcccccatgcctggcccctcctggctgcctcgcctgcccgcccacccctcctctctctgtgtgcacctctctgcctgtttgaactgcagcttttaaagctttttgccttttgaa

SEQ ID NO: 200768 - DNA, 372 bp, Homo sapiens
acagcataaactattctctcagattcatcccttcctttcctttctcacagcctctgccttgatctaactggaatcatttgttcactggtctgtactacaaaaacattcattgcaattccacttacaacagagaaaagctgtgaataacctgtatgtccaacaacaggggattggttaagtaaatcatgactcacccatccattaggacattgggcagctattaaaaataatgctgttgaaggatttagtgacacagaaatactattacatgaaaaaaggcagtttcttgaacacttccattttctttttttggctggcttttttttttttaataatagttatgctcgaatagtttatgctggggcaccgagc

SEQ ID NO: 200769 - DNA, 271 bp, Homo sapiens
cgcccccgtccctacacaagatgaagaccccctcctgtcattccctcacccagggcctcccccttctgtcttccctcattcccagacggccgtaccctctaccccgaggtgggcctgctgggcagctggccctgagttcctgggctctcccagtctgcccccatctttgctgagagatccaggtgctccttgtgggaaatgccctggggatggtgctgtggagtgccagcctggggtcctgagttgtaccctctgtcccaggatccaggag

SEQ ID NO: 200770 - DNA, 147 bp, Homo sapiens
tggaaagtgttgggattacaaggcgtgagccactgtgcccggccaaattcttaaagtacctaacgtcaaagtcagtcttgaataattactctctaatttagattaagcttgataataactgttaaaaaacctttcctctgtaggttg

SEQ ID NO: 200771 - DNA, 837 bp, Homo sapiens
agtgatctgcctgcctcagcctcccaaactgctaggattacaggcgtgagccaccgcacccagcgtgatctcacctctttaaaaactttttatatgtggcaactagaaaattttaaactatagatgtagtgcacatcatattctatcggacagtgctgctctaagcagaaaattcctgctgattactttggcaagagcaattcactaacaaacttgggcagctaaaaatgtgttactacaaataaaaaggtgttactagtcttggctaaacaaaggttctggaggatacccattatttggtgccctacttacattttggaaaaacaatattgcacccaggggaatcttcttggaccctttccatcaagttattcagaagaaaatgtaattgtttttctttttttctattctagtgacaattacactgtcactggcagtgtagttgccccaaataataaaagagcatgtatttaagtaaacaaaatggattccaactgaagaccaaacctaaagacagaaagaagatggtggggggcccttgtaaaaggacactcaggaggggacactaagaaaatgggctcacaaatctcgtaggacaggaaggcgttgccgtcgaccaaggagcgtgggttggaataggtgacgacgatgccggagccaagaagctaagcatgcttgggacacaagggctggcagaggccaaccgtgagggaggccacgccgtgggggccggccgatagggggcaccgcacctgcaacaaaaacaggtccggcatgaaaaacctggctgcttggcggacacccaatggggcgaagacggccgtgaatgatacagag

SEQ ID NO: 200772 - DNA, 495 bp, Homo sapiens
  misc_feature (113)..(114): n is a, c, g, or t
  misc_feature (120)..(120): n is a, c, g, or t
  misc_feature (127)..(127): n is a, c, g, or t
  misc_feature (137)..(137): n is a, c, g, or t
  misc_feature (141)..(141): n is a, c, g, or t
  misc_feature (143)..(143): n is a, c, g, or t
  misc_feature (153)..(153): n is a, c, g, or t
  misc_feature (158)..(158): n is a, c, g, or t
  misc_feature (160)..(160): n is a, c, g, or t
  misc_feature (167)..(167): n is a, c, g, or t
  misc_feature (181)..(181): n is a, c, g, or t
  misc_feature (191)..(191): n is a, c, g, or t
ttcacaggatcttctgacgtcacccaatcaccactacaaagcaatattacagtatctacttaaggaaaagaacctactaaaatattgttatgctggcttttttggtggatggnntctatnacacaantacagatcanagcnangaacacatanacatntnccaatanaatgtggataagtntaaaatcttncataaataaaaattacacttatgagatcagaagatctcactgccatctatttatggtagtgtgggattaaattttgcatcatgaaggtaccagaaatgtcatacagccttaacttttattcaagtttagtcacatgtcctaagatcacagaaggcactataaatgagacatacttctcaaccatacaatgaagtccaccggccccaatgcaaccatctaaaagctaaattacagtatctacttaaggtaaagaacctactaaaatatgttatgctgctttttttgttgattgggttgacgtcag

SEQ ID NO: 200773 - DNA, 570 bp, Homo sapiens
gtcaggagttcgagaccagcctgaccaacatggtgaaaccccgtctctactacaaatacaaaattagccaggtgtggtggcacatgcctgtaatcccagctacttgggaggctgaggcaggataatcgcttgaacccgtgaggcggaggtttcagtgagccaagattgcgccattgcactccagcctgggcaacaagagtgaaactcccatctcaaaaaaaaaagaatactcgatgtcagcatgtcaacaacttcaaacacaggataacctactgcattaggtttctgaggctgctttaacaaattacctcaaacttagtggcttaataccacagaaatgtattatttcacagttctggagaccagaagtccaagttctgtttcactgggctgagatcaaggtgttggtagggccattctctcccaggaggctcctggggagagtctgttcctgcacttctagcttctggtggctgctggcactccttggcttgcagccacatcactcgagtctctgcctctgtggtcatatcgctttatcctcttcagtgtgcatacatctaatctccc

SEQ ID NO: 200774 - DNA, 244 bp, Homo sapiens
attccaccagccctgttccaaatcaggaaaacctgccccaccttgcctgccactagctctggctttggtagcatccttttgttctgttagtgttgttcacttaagttcttcttacaagattgtaaattttgaattacaaaaactttgttttattaatctttgtttctcctaagtcagccagcaaagaaccttgtttacagtaggtgcttaataaatatttaatccatttatcaattgaatgcaa

SEQ ID NO: 200775 - DNA, 801 bp, Homo sapiens
gccttcgctcaatgcaggcaaccactccaagtcagaaaagacacagtgatactcaaagcagacagcctcaattcacgtgtgcgttactggctgaccatgcggtctctttattgtaaggacaggagaagggcccctttcctgggtttcttcaaattcacacaagtggactcttatgcaaagatcctgggctagcctccatccatatcagccacctccaaaaatcccttcgggctagctctcctcaccccaaatcttctcctggaagaaagtcccctaaagaaaaggagaatcacttcctaacccaaaattgcttaacaataccctaaatccattttgagttcagagcagaaatccgtgttccttccaatctgctcagataaccaggaaatgctgtacctgctgggtctgcacgtttagctcccgacacacctgctactccagccggcatgagtcacccacgcaggcattgcacggtgtacttgtcaaccacggattcagtggctcagcagcttgctctcacgcacaccagatggcaaacgtctacccccaaaaagacgtgtcagggcagaccggctaataacccaatttcactcaatgacacattcccactgtaggtttggggagaggaaaggagggagggggtacacagagatgctttccccacttatgggcaagctcccataggccctggaagcctgatacggctctgctaccgtcagtagaggaagggcaaattcacctggggaggaaaatgaaaatgacgtcccaatttcaaacctcctcctgaacaaaggctgtctt

SEQ ID NO: 200776 - DNA, 705 bp, Homo sapiens
atggtctgggtctgtgttcccacccaaatgtcatgtcaaattgtatccccagtgctggaggtggggcctagtgggaggtgactggattacaggggtggcttttccccttcggtgctgtctcagaaagtgagttatcgcaagatctggttgtttaaaagtgtgtagcatctccaccccaacttcttccagctctggccacgtgaagactacctgcttccccttcaccttcctccatggttttaagtttcctgaggcctccccagccacgtttcctgcacagcctgtggaaccaagagccaattaaaccccttttcttcataaattacctaatctcacacatttctttatagcagtgcaagaatgtactaaatataccgtccaaagtgacagtcctagaaatacaagtacatcatgttcctaaaactgtatctttttttgtttttaaaacggagtctcgctcttgtcccccaggctggagtgcaatggcgtgaccacggttcactgcaacctctgcctcccgagttcaagtgattctcctaactcagcctccagagtagctgggattacaggcacccaccaccacgcctggctaatttttttgtatttttagtagagacggggtttcaccaggttggccaggctagtctcgaactcctgaccttaggtgatctgcccgcctgggcctcccaatgtgttgggattaca

SEQ ID NO: 200777 - DNA, 579 bp, Homo sapiens
aaagagaggcaattcattgtcataatttgtcatcaaaagcattataacaaattataaaaatactagaaaaggtaggtatagtatcaaaatgataaataccagtaaacatgatgctccagaacatgtaaaatatatattttggagtatcatagcatagcacggggaggggaaaattaagtttgcaagtcaagaatagtgtgggggagggagtttggagggaaaagacaagttgggtagactttggaggatacggcaggtgctaaatcttagaagaatctgcaatgctcacttggttcccagaagtagctacacccaagtcaacccctggcttgttttccactaacggagccaaatacaaactggggtggctacagatatggaaagctggtatcaagatcttatttttgataagtaaaaaggactatacatgaggagtgccatcaagatggggatggggtgactgggaggaggaagagaaaggtgagtcagtcatgcacaaaacttaattattttggctcctcagcagttttgtttgtcaccaagtgtgtgtagacaaataacattaaatgctcttaaaaa

SEQ ID NO: 200778 - DNA, 1090 bp, Homo sapiens
gctgaaatatttaccatctttcctcttatagaaagactttgctgagcgaaaccccatctctgcaaaaaatacaaaatttaggcatggtggcgtgctcctgtagtcccagctactggatgggggtgagggtgggtaacgggaggatcgcttgaacctgtgaggttgagactgaagtgacccaagatcctgccactgcactctggcctgagtgacagagcaagaccttgtctcaaaaaaagaagaaaaagaaaaaaaaggaagtttgccgactcctgaactagagcaccagagcatctcaagccccacccagtttggccacctttactaaagatgaactaggccgggcacagtggctcacacctgtaatcccagcactttgggaggccaaggcaggtggatcacgaagtcaggagttcgaggccaacatggtgaaaccccatctctactaaaaataaaaaaaattagccgggcgtggtagcgggcatctgtaatcccagctactcaggaggctgaggcaggagaacagcttgaaaccggaaggcagaggttgcagtgagccgagatcacgccactgaactccagcctggacaacaagagtgaaacaccatctcaaaaaaaaaaaaaatggataaactaagcctgccgagtgaaaggcacacatcatttcactgaatgataactgcagggtgtcccacaagctgctggccattctctacattcatcatagtttaaactgccttaattggggtgatttccctgcatcatttgtctgtaaaatatgtgagatctcttcctagaggtctcaccaagccacattgtaaaggaaacaaacatcatcaagtttcaggttccacaaagagcctgtaaattccttaggttagggagtttagcacaaatcattttctcacagacccaaaacactataatattcctattttgtcttcatttaattcccatggtcttaatgttaaatgtgatgttcattttttaaatgtgaagctcaagaataagttgctaactaacttgttgctaaaatccagttttatatgtagttaaacattttggctgagtgcagtggctcatgcctaca

SEQ ID NO: 200779 - DNA, 703 bp, Homo sapiens
ggatggttgtcagtcaaaggagtgagtcagatgatgagaggggaggacagcagagcagcagttgtttcttcagtctcgccgggactccaggatcggccatgttctgcagccaccgcctctacctgtctccccatgtgggatcctgaaacctcaagctgcatttagtttcagagtccggggaggtgctcactgtcttctgactcctgagatgccgactccctctgccataccccagggaaggaaccagtagcagaagctccagggaaactgatgaaggtcaacagaaggaagaacttctagcagcccaaagggattggaatgggcggcccgtgggagtggacatgcagaggcactggcctggggtgaagccttggaccaaattcttacttgcaggccctctggacccaggagaggagtctgcaggcctcggctgggccggattccgcagattctggcctaggtcctgaatgcctggtgagttactgagaaaggccctacaggctgagggtgccagtcagggtgaagcagccccgcaattggcccacctccttttgtaccttaacaaaggtgtctttgttacctttcttaaaggaaataaagccggtcaggagcaaggcctggcatattcagggggtcatctgtatttggtcgtccagcgggaaacccaaatggaaggaaagaaaaaaaaaaaaaaccatgcatt

SEQ ID NO: 200780 - DNA, 827 bp, Homo sapiens
gtcttgaactcctgacctcaagtgatccgcctgccttggcctcctaaattgctgggattacaggtgtgagccaccgtgcctagcctacagcgacatttatatttataaattatataccagtactactgaaccaacacattgggtacattacagaaacagaaaacaaaacgtatgagaaaaatatgttatttccaccctcacttgggtttgaagccattgccctggtggggacagaccatacggtgtcaacagacattttaaaaaaagagttattttctcccatcgcctccttatttctcctttcacctctctgtctgtctctaccttctctgccctcgttaggcacagagcccctgctttgtgcaaactcctgagctgggtgctggggacacagggaaaccacccagaccctgtcctcagggagcttatagcccagtaggtcgtggtccatagtacactatgagttgcagtcctggccttgccatgtctctccatctcagtagtttttttttttctttttctttttttttttggcagggtcttgctctgtcaccccaggctggagtgcagtggtatgatcatagctcactgcagcctcaaacttttgggctccaagcaatcctcctacctcctgagagtagctgggactataggtgtgcaccaccacactgggctaatttaaaaaaatttttagtagagatgaggtcttgctatattgcccagacaggtcttgaactcctgggctgaagtgatcctcctgccttggcctcccaaagtgctgggattacaggtgtgagccgctgcacctggcccatcttggtagtttt

SEQ ID NO: 200781 - DNA, 594 bp, Homo sapiens
tcaatgcccacagcttccctggggctcctagcagttgctgaccccctcagtgtgtctgagaccatgcctgactgacagttgctaagctaaggtggggaccctgactcccggctggcttggacttgagccatggccacacacagcctttgcacttaccggaaacctggaaaggtgttcagtccctgggtgtgtggcagcctcacaagcacccactttacccaggagcaccatgccagagggaaggctgaggtgggggagctcaccctgtcctaccccctgccaagatcactggcatttatagagaaacaggacagggtgggtcaggggagagaaaaggccccttggctggctcctgtatggcctcagacaagccttccacctgtgctcacgtctcctggaggatgaagtggggcctcagctaaggctgcgtagccggggtgcttgtgccgggtggttagggtgaaagggccttgcaaactgaccacaagggctaagacagaccctgtgcctggctcttgtttgtttacaaggcaagatggcttcagaaacactaacggaactgattctccactggactggagtcttgcctgtacc

SEQ ID NO: 200782 - DNA, 397 bp, Homo sapiens
ggctcccttgagcccaggaggtcgaggctacagttagttgtgattgggccactacactccagcctgggtgacaaagctagaccctatctaaaaaaacaaatcagagtcagcgcattgccagcgttactgcttgcatggcataggttattcctgaagagcccactgcaagatggaacagcaggacccctaccccagtgctgttatttatcagctgagtttcaccagggctggggagacacagcctaggggatgagtaaaatgaggagcctggggggtgtatgaagccatgtcccctgaccggaatgtgatgtgttaagtggaaaaatattgtcattatgtgtaacagggaggtgactttggcaaaatgtctgaactgtaaatgaaaactggaagagca

SEQ ID NO: 200783 - DNA, 477 bp, Homo sapiens
ccgcccttctccccagcccaaagcttccttcacgtcttcctctcgtatccccccaccttaagccacaagtatgggacatctctactccttccctggcaactgatcacatgcccattaccatcccattaaaacctaatcacccttaccccgctcaacgccaatatcccatcccacagcatgctttaaaaggattaaagcctgttatcactcgcctgctatagcatgggcttctaaaacctataaactctccttacaattcccccattttacctgtccgaaaaccggataagtcttacagattagttcaggatctgcgtcttatcaaccaaattgttttgccatccaccctgtggtgcccaacccgtaccctcttttgtcctcaatccgttcctccacaactcactattctgttctccatcttaaagatgcttttttcactgttcccctgcacccctcgtcccagcctctctttgcttt

SEQ ID NO: 200784 - DNA, 330 bp, Homo sapiens
acattcaatatttaggcagtttacacatctgtcctagcttttactttctatgttagtaaggcctcagatccagccaggaatgagtccctttgctagagccctctgtggtgtctcctgggcatgtgtgcaacattgtatatgggcacagccctccagaccatcacagataagtagtatcttattaaatctaactctggctgtctcatttcctggattggccttctaaatttctgactgagatgccagtctgttacttccccaaccagtattgttatctcaggctggctatggtgttggctttccctgactttttgccactaagatcactcc

SEQ ID NO: 200785 - DNA, 480 bp, Homo sapiens
aaagaaagtggaagatagtaacagagaaagtggaaaaaaggacgagaagggatagacatgcaaaactccagcattccaaagttaagggaaagagaataaccatgttgtgcctataaccctagaagattacaaaaattatttctagcaaattgacaacccttctttctgaaggtagctttgggcaaaaaggtgctgttttgagcttttaccctgaatcacctggggtgcacttgaaaagaagccattttgccaatgcattaaaagtgtctgagtgaaagctgccacttgattgtcctaagaggcttttaaccccagccacataattatttcataacaaacaatcaggaacatttctcttcctcatcagtttcccagactacctcatagcacatgcatgatacaatgtgtgattttgcagccttccatgtaacatcggagtcctaaagagatggacttgaagaggctcatggtgattttaat

SEQ ID NO: 200786 - DNA, 445 bp, Homo sapiens
cccaccacttaatagcaatgtgactttgagcaaataacttagtctctgcttctcctatctgtaaaataagaataatagtaccccccttcaagagggttgttttgaggattaaataaaatagtgcatgtaagtacttaccatgtggtaagattataatcctaatcagagatgtagttaaaggtattcatgatattgttacttatattagcaaggatttatttaacctgaatagttgacataaaggggatgatgttatagtgccatctgtataattaattattaggtacagatttacctaataagctcttttttggaaaacttaatgaccaaaaaatgctcacaatgttaagtgagaaaagcagagcacaaagatgtttattttatctcagtcatgcttttttaaaaaagatgtatatacgtacaaaaaaggctggaaggaaacaca

SEQ ID NO: 200787 - DNA, 278 bp, Homo sapiens
cagagaaagggggaagagccacttttaaacatcagatctcacaagaactccctatcagaagaacagcatggggaaaaccaccccatcatccaatcacctctaagcaggtccctccctggacatgtggggattacaattagagatgaggtttgagtggggatacagaaccagaccatgtcaaaagccatttcaactgaggtggtatgacatttcattgtggttttgagttgcatttttctgatgattagagatgttgagcatttaaaaaatatacctgt

SEQ ID NO: 200788 - DNA, 336 bp, Homo sapiens
taatggacaatttgtgaagaatagtccaacttacctttttaaaattggaagatcccttttacacaaagatttaaacagataatctattatatgaccacttatagctaaaacaccctcaagtttaacaaaaaggacagttatttgatagatttaggtatgtggacagccaaacaagcagaaaccatttaagataagataatccaggtaacggttggtgaagataactaactttaggatcgagtttagacttaatgttgactggcacgaggatgctgagatttaaagaagttaatatgacttgttcagagtcacaaagccagaaattggtagtcatgt

SEQ ID NO: 200789 - DNA, 266 bp, Homo sapiens
aatttttgtatttttagtagagatggggtttcaccatgttggtcaggctggtctcaatctcttgatctcgtgatccacctgccttaacctcccaaagtgctgggattacaggcatgagccactgcgcccgaccataaaagattagttcttttcaggtgactttaatttggatgtatcatctctactgagtcttctcagttatattaattaaggctactttaaacactattcaaagacagatgtactttgtacctgggtaattttgt

SEQ ID NO: 200790 - DNA, 513 bp, Homo sapiens
aataaaagtgttatactagcttttttatatctaatgactacagcaatcagtaaacatagtttatagttttatcagtgaaacatagtttacagtttcagtgtacaagcttaccactgtgcaaatgcaagctattttaaaagtaaacccttataggccgggcatggtggctcaagcctgtaatcccagcactttgggaggtgaaggcaggaggatcgcctgaggtcaggagttcaagaccagtctggccaacacagtgaaaccccctctccaatataaatacaaaaattagctgggcacagtggcaggcgcttgtaatcccagctactagggaggctgagacaggagaattgcttgaacccaacaggtggaagttgcagtgagccaagatttttccaccgcattccagcctgggtgacagagtaagaccctgcctcaaataaagaaagaaacaaattaattaataaataaacccacccttatatgagtctatgatttctgcatctggtacattat

SEQ ID NO: 200791 - DNA, 677 bp, Homo sapiens
atgttccttccactgttacactatacccctaagatccattgccacaaatcaaatactcctccaggctcctgactatacagtggcaaaactatacaatcttttagagtgcagcatacctttctcatgggtcacctcactctctggggcctgctgcaactacagtccagccacagatctacaagaaagaaggattacagggcagattctgaggaagacagtaccgtgctgggcaactacccaaagggaggccaattacaggtttttcaggcaaacggagattaagttcctctgggaagggttggaaaggctgcttctccgggaaaggcagcagagcagcatttaaggatttaaggactccagcttaaacagaatctgaccatatgcctccaatccaattttcaggattccattcctaccaatcaatgatctcacccacaaattaggaattacatttgcatttttagagcagtcacagaaaccttcgggtcccttacgtgtagcctgagctaaaaatttaaaagcctgagctgatcattctgctttgtatggtttgaacttggctgagctgaactacattccccagaatttcctttcctttatgtttccaacttgcatggctcacaagagatttttgtgcagcaactgaagggtgcagaagataaagcaaccaccctgca

SEQ ID NO: 200792 - DNA, 322 bp, Homo sapiens
taaggacaatgtaggcagaattagcagaaacaacactaggggcgtagtttttggacaccagtgagacaccctggccaggctgacactcctccttgctcagaagtactaaaagctttgggctgaggccacagcagacaggcgtgactatcagttccattctctgcctggagtgtttgtgtgtgatgctgtaaacgtgcatatgcggccaggtgcggtggctcacgtctgtaatcccaacactttgggaggccgaggcaggtggatcacttgagggccaggagttcgagaccagcctgaccaacatggcgaaaccctgtctcta

SEQ ID NO: 200793 - DNA, 483 bp, Homo sapiens
cacattatttttattcttaattttgcaagtggatataaatatacatagtcagccccctgtgtccatagttctgcacctgtggattcaaccaactgcagatcaaaaacattccagaaaaaaaaatccacaaagttccaaaaagcaagacttaaattttcttcacaccaagtactacattgaatccacatgaatgaagtgatgcacaggcgttgtgttaggcattataagtaatctagagattatttaaagtatataggaagaggggagtaggttatatgcaaacactaagccatttatgtcaggaacttgagcatccttggattctggtatccacagggcatcctggaaccaatcccccatggatactaagggtcaactgtacctaattttagaattatttttaaattagcaagtcaaaaccccctggacagagtgttttaaacaaatcaaatgatatcctatatctggtcttgcaacactctt

SEQ ID NO: 200794 - DNA, 643 bp, Homo sapiens
ctgtactgtatttgtagagatggagtctcagtatattgctttggctgatctcaaacttctggcctctagtgatcctcccaccttggcctcccaaagtgctgggataacaggtgtgagccaatgtacctggcctcttctaatttccagtttttgtttctaaaaactgaatatcacatggtacctaatattagcaaatgaggaaatggaagcaaaggaagtgtgaactttcttttgtagtagtcaacttttggcttaatgttttgggaatatagttctgtggaacatttctctgcttttacagtggtggaatagtaggattcactgtgtagctaaccttgaaatactaattccataaaataaaggatatacataataagaatctgtttagcaatagggtaaataagcactaaggtggtattctcatactagggaaaatgtttgctttattacatcagcaaataatgtgttccacaagttttgatttattattttaactgtataggtggtcttacatctaaaaaagaataccgcttaaaagacttgtagtacagcatataagttatattagacatggaactatgtttctgccaataacttgacattttgaggacagatagcatctcatttccaatttgagattggg

SEQ ID NO: 200795 - DNA, 791 bp, Homo sapiens
tggagaaagtaaatctaatttctgaaaatctaatttcagaaatcatacaccgaacactctgtttttttataccttacaaaaagttcagctttatatacttagggttatagtaaaattaccatctatgaagtatgagataattttttcaaaaagtagtccttagtactactaagaatcaataaagtgacttggaatagtcacatgtatttgtttcacactttttcttaaattgtttttgtgtgatatagaaatactgagttggctactaacgatgtggctatctggatataaaaagtgttattggattggttatgtctgaacaaagagaataactggagttttcttacagggacctgagtactgcccccaacatatatttttgcaacatttctctttaactttcataagctcatagagttgattttcttcgtcagtctttgtttcctctgaaatgcatgtcataacagtaagctttgaaaaccttaattctcttttcttagctgagaaaaaaaattctagtgttaactgttgttgagtgcagttatttaaatccacttttatgtgcaaagtgcatagtatcaatgttgaatgttcctgtatgtttacatcatagtagtaaagagataccacttgaagttattcctccaaattaatagttaaatttgaggtttcagattcttgtaagtatatgaagtacagaggataaagttaataactcgagttaataacttcctgtatcattaaaagcaatcaacttgattctgtttgttacttttagaagaatatataaa

SEQ ID NO: 200796 - DNA, 325 bp, Homo sapiens
gtagattggggcctgacattcaataggtactcaatacacacttgccaaatgagtgactcacctttgagaaagattctcttttagcaccttatgttaatacttaactttattatgacatttattacattgctgtctcatctcactaggttgttcgctacacacgattgcagttcacagacttaaaaatatgctcatgcatgctttcttttcttataccttccccctgaggttaaactctgccttaggtcacattactcatgctttcagaaagctctgcttctagctttctgagcgggggagattcagccccttgtttattttatgt

SEQ ID NO: 200797 - DNA, 526 bp, Homo sapiens
ggaggccaaggcaggcggatcacaaagtcaggggatcgagaccatcctggctaacacggtgaaaccctgtctctactaaaaatacaaaaacaaaattagccaggcgtggtggcaggcgcctgtggtcccagctactcgggaggctgagtcaggagaatggtgtgaacccgggaggcagagcttgcatcatgccactgcactccagcctgggcgacagagtgagactctgtctcaaaaaaaagaaaataaaataatggtagtcaaagtggagatattattgcaattaataactgaaacaggcccagagcacttggtgatgtagcaagcatccctggtaagtgtgtgaatctctgatccaagtggtgtcggctgcagcctggtcctcattactgacttctctgtgtgacattgggtatgaacatactttctctgggcctgagttttcctatctgaaaatcatggagtttaaactacgtgatctcaaggactcttttagcttttaaactgaggctgctttgtagcttct

SEQ ID NO: 200798 - DNA, 321 bp, Homo sapiens
tgaaacgggaaacagtgtcttcccttgagcttggacagggtcctccacagccacaggagtccaagagtgttgacctcttcccatctcttcaccccggaactgactgcagcatcacatctcatgaacggtgaactccaaaagttggcttaaaaggccaaagtctagtcctatccatactttatttacaaaaaaatataaaaattagccagtcatggcagcacatgtctgtgatcctagctgctcgggaggctgcgatgggtggattgcttgaacccaggaggtcgaggctgcagtgagccgaaatcatgccactgcactcca

SEQ ID NO: 200799 - DNA, 217 bp, Homo sapiens
gcccttccatacaggctagaccatcctggactcccacctgcaaggtatgagtgcctgtttactcacagcctcgcctaactgagtatgtcatccagctttggagttttgttattatattctgaaaggcgagaaatgtttatcagggatattgacctgaagttcccttttttcagtgtgtctttgccagattttggtatcaggaagatgctggatttgt

SEQ ID NO: 200800 - DNA, 489 bp, Homo sapiens
aatgttctagaaaaaaacacagggagctatgtgaaacaagatcgatttgataagatattgataattgtcaatgctagcataggtgcatgtgaggtagggaaatttcagcagtatctctaaatgtttgtgtttgaaaatgtacataatggaaagtcttaaaaaaagacactcaagagtactatgcctatgtcttatactctatggatttcatttgaaattaaaatgatgataagcataatgagacctaacatttactgagcaagtcttctgtgagcagagctccttaccaagcattctgcatgaattatctcatttaatcagcaaactacccccaggatatgggaagtatcattaactccattttgcaattaaagaaaccgaggcacaagaaggttagataaaatgccaaaaatcacacagctaataagtatccagggtgagattcaaacctaggttattcagtgcaaaaaataaaacaaagtaatgaaa

SEQ ID NO: 200801 - DNA, 390 bp, Homo sapiens
tttgttttagtcaccatagggtaccacacatttgctattacctatacttctatggaattattgcgtagagtcttatcaaaatcaactatttaaaaagaccttctggctgggcatggtggctcatgcctgtaatcccagcactttgggaggccgaggtgggcagatcacttgaggtcaggcgttcaagacccgcctggccaacatggcgagaaccctgtctctactaaaaatataaaaattagctggtcatggtggcacgcatctgtaatcccagctcctcgggaaactgaggcaggagaatcacttgaacccagggaggcagaggttgcagtgagccgagattttaccactgcactccagcctggacaaccagagtgagacttcgtctca

SEQ ID NO: 200802 - DNA, 472 bp, Homo sapiens
agcatgtgtcataatttccttctttagggctgaataatacttcattgtatggatatatcacgtgtggtttactcattattcatcatacacagttggattgcttccaccatttaggtattgtgaataatgctgctatgaacatgggtgtacatgtatgtgttggagttcctgccttcaattcttttagatgtatatccagaagtggaattgctggatcagatggtaattccatttttaattttttaacaaatcgtcatattgttttccacaccagctcttccgttttacctttccaccaacaatgcacaatattcccaattcctccacatccttaccaatgcttgctgttttctgggtttggctagtagtcatcctactaggaggtatctcattgcagttttgtttgtttgtttgtttgtttgtttttgaaacagggtctcactttgtcatccaggctggagtgcagtggtac

SEQ ID NO: 200803 - DNA, 923 bp, Homo sapiens
tagcaaactagaaataaaatggactgtcttaatctgctaaagaatgattacaaaaccctatagcaaacatcgtttcaaatagtgaagcataaaactcttcttgagtttgggaacaaggcaaggctgcctcctcttaccatttctattcaatattacagtgaaagtcctagataataaataaagaaaaaacgcataaaaagtgggaagaaagtagtaactttatatgattgtatacatcaggaaatctacacattaattattaaaatgaatgtgtgaacttatgaaggatgctagatataaagacaatatacaaggctgggtgtagtggctcacacctgtaatcccagcactttgggaagctgaggtgggaggattgcttgaacccaggagttcaagaccagcctgggccagtgagaccagtgagactccttctctacaaaaattaatttaaaaaattagccaagtgtagtgatgcctgcttgtagtcccagctacatgggagacagaggtgggagaattgcttgagcccaggtgccactgcactccagcctgtggtgacagagcaatgccctgtcttaagacaaataaacaaaagtcaatatacaaaaattagttatgttcctatataccaatagcaaataattagaaaatgaagattttcaaatatcatttaaaatagcataaaaacttatcaaatacttagaaataaaactaacaaaaggtgtaaaacctgtacactgcaaacattgctaaaagaaatcaaacacgacataagtagagagatatattatgttcatgagttggaaatctcaatatttttatatgtcaattgtctccaaattaagttacatagtcaatccctaggtcaaaatactgtctgtgtgtgtgtgtgtgtgtgtgtgtgtgtgtgagtttgggtgtgt

SEQ ID NO: 200804 - DNA, 532 bp, Homo sapiens
ttgaaacaaaaacctaaactaaactcgtatgaattaattttaaattgaaacagacaaatattcaagaatggagagttgaaagatgatcaaaatgactagctttataatctaagataattatacaatttataattatctaaggaactgttagatgactctttgcttttaaggcgagattagtcttttttaacagtgttattactagaaaaaagttgctgagcatggtggctcacaccggtaatcccagcactttgggaggttgagggaggcaggcaggtcacctggggtcaggagttcaagagcggcccggccaacttgatataaaaatataaaacatatttataaaaataaaaaatatatttataaaaatataaaaattaggcatagtggtgcgtgcctgtagtctcaactactcagaaggctgaggcaggagaattgcttaaacccgggaggcagaggtggcagtcagccaagatggcaccactgcattctagcctgggcgacagagcaagactccgtctcaaaacaaaca

SEQ ID NO: 200805 - DNA, 529 bp, Homo sapiens
tttttagtcttggacctggtgacttctctgtgttttcttatctatagaatggggattagactgcatctgcccagagcgttgttgagaggattaactagaggcagataggaaacactgagcgtctctgcagggcggagtcatgttctcagcttggcctcacactggggtcacctgggcacttataaaaagcacttataaatgtatacttatttcaaaataaaatctataaaataaaaaatattgatgcctggagtctacccccagagattataatctaatcatatggtgtacagcctgggagtctggatgtgtgaaagctcctccactgattcaaatgcatagaaaaatttggaaccaaagtttagtgttttaaggccaagaaactggaactagaccagctaggttctaactctggtcatgctattcactatttgtgtgacctcagacaagttctcaaccttgttgtgtttgtagtactattatagtgctgaccttgaaggacctctgtgagccagtgccgggcacacag

SEQ ID NO: 200806 - DNA, 112 bp, Homo sapiens
aatgtaaaaatcagcccagaattttattttccgtaaggtgcttaggagagcgtgggcatagccatgagacctccgtgttgggttgtgtttaaagatgtgtattcatttctca

SEQ ID NO: 200807 - DNA, 386 bp, Homo sapiens
ccaaaacttaaaggagttgagagagtgaaccatgtagttacttgatgagagagtattccaggcaaaggggccagccaagtactaagtatgctgggcatgttcaaggaacagcaaggagactgatgtggctaaaagagagtgagtttgggagaatgtaataatgaggtcagagagatagcaggggctcagttcctatcggctttaccactgagggagatagaaagcctttttaatctcatcagcagcatgataataacttattcatttaataagcatttaacctactttgtatccagcatttgataattcagaagtgagtaagatacagtgtctgctctcaaagtcaaagtctgtgggggaaaaagatataacaatacagatgctcc

SEQ ID NO: 200808 - DNA, 349 bp, Homo sapiens
ataatttcccctacattatgctttatataaaaatctgcattgtatatttctttacatttcagatacagcaaattcatagtaaaaatgtatcctgaaaagtttcaatatgtatgtgtacagttacatttaaattattttccaacataggcctatttatgtcatgctgaaaccagaaaacttagttttgtagaatagtaatgttattttttaggacaaccaactaaaactgccatttaggcattatatatgactcactgctgtagttacgataccgtttttatttttaatcaaatcttccagaggccttatggcaagtagtattaaaactactaagcaaaagtttatataa

SEQ ID NO: 200809 - DNA, 480 bp, Homo sapiens
ccaagtttactagcttcagcttgtagggccttaggaaaaaagaaattttaatttttagtgattccaagtcagaagggtaggagaaaaactcaaaaacaatgaacagggctagaatctaacaacagatgcaccattgttttcttctgaaatgtaacttttctctctttagccttccatttctaccaaagatactcataatgagactaatttgtttgtaaaataagttagttttattaacttggcctgattacttgcataaagtacaattagaataatgatttattatataggcacttttcaagttggctttgctgaaaatttttataaggaatctcagattagacttttaaaagcctctcaaggctataagctaaatcaaagatttgacttgccctcagactacgtctgtaataactacacaaattgagtgaatttctctctttttgagcctggccgacatggtgaaatgttgtctctact

SEQ ID NO: 200810 - DNA, 624 bp, Homo sapiens
tctgggattacaggagtgagccccacgcgcacgcggtccaaaatcttttattgcctctaggaattgtgaggcaattcttggctattgtgcttctactccacagttaaggacatccccaggactcctgaactgacaaatgacaatgagaaattgactaggaacaattgtttttttcttcgctttaaaaagaagcaataaccaatacaacacctccttggggatcaaaatctcaaaatttgggtatcgatgggtaaagcatccacaatgcaactccttcttgtaatctcttttggggtcctagttgtttcctttcttctttgtccatgcaaaagaggatggcaggaagggagcatgagagtccttgccgaatctgcttccggggttgctgtgtggattacacaggcagacaggtgtgaatacgtctgcaaacatcacagcactctacagatgccatttatgagcagaaggcatgcttttttaatgcaaaaacttgggtgtctcctctgagctccccagcctgggtgaaaccattctggaatcttctgtgtttcactccaccagagcactgttattgcattactttcatttccctacttgcgagaaacaatgtaatgaacggatcct

SEQ ID NO: 200811 - DNA, 732 bp, Homo sapiens
aacacattgcctggtatatgcttagtacatgtttgttgattgactccccagaatacacgattaaccccttgaacttgtcatgttccctttgtataagatatgcagtgtaaacagaccacatttacttacctgggaattttgttaaaatatggtgatggtggcatttttaaaagcattatacagaagatggaaagtcttctggatggtcttgtaccttttaaaataactgtagtttaatttttctgcatttagttttataattaaccattttctgtacttttttttctttatttagtcatttttccctttaggtttttgatttagtgatttgatttttccttctaatgaatttcatataaattggcaagttttatggatgagtcattttctaaaactttgtaaaaatggttgttgagaatttcaattgcatttttccatagaacagatgtgtttaagatatgtttacagggtagcaaataaaatattaattttttctctctacttttggggccatgtcataaaagattcttcatcatctcaactacttctttttgttcgttttattcatttttttcatttatttatttgtagagagcctactgtgcagtaggaattatccccctcacttcctgtttattaaaacaaccttctacccctgccctccctcacctccagattattaaacccttttccctttactccacagtcattttatctcagctgtcatacttt

SEQ ID NO: 200812 - DNA, 562 bp, Homo sapiens
cagagatcccttatcggagataaagaaatgaagtcttgatgtctgtactttaaatattgtagtttaatttttctgcatttagttttataattaaccattttctgtacttttttttctttatttagtcatttttccctttaggtttttgatttagtgatttgatttttccttctaatgaatttcatataaattggcaagttttatggatgagtcattttctaaaactttgtaaaaatggttgttgagaatttcaattgcatttttccatagaacagatgtgtttaagatatgtttacagggtagcaaataaaatattaattttttctctctacttttggggccatgtcataaaagattcttcatcatctcaactacttctttttgttcgttttattcatttttttcatttatttatttgtagagagcctactgtgcagtaggaattatccccctcacttcctgtttattaaaacaaccttctacccctgccctccctcacctccagattattaaacccttttccctttactccacagtcattttatctcagctgtcatacttt

SEQ ID NO: 200813 - DNA, 339 bp, Homo sapiens
tttgtcctacatataattgccagtttgggaaattaaaatgtgaaacttaaattagaaaaaaacccaccacttggaaatcctttttctaaatgtgacttaaacctagatttactataatatggtaaagcataaaaaagcaaacttgtaagaaactatcacagctcctaataattgagtacaaagaagcaagtttccctactctggagtagttcttttataggatcttcagaacagaatatctgtatcacatgttccttgtctttcctctatgaagaggaagctctatgtctcgtttgtcaagtctgatgacatgaataacatgaacatgtattactttgc

SEQ ID NO: 200814 - DNA, 302 bp, Homo sapiens
cttagtctcaatatgcaggtggtgtttactcttatattgaaaactgggatgtgtctgggagtgttaatctcatctgtggacctttgtgcagatgagactgtgacatatacctctgcccatcacctgatttgactcttctgcctgggaccagacaacagatgggactgtgacatcactggacctagcatttaagtaatgtgactccatttgtctgccttggtactgtgtggcaaggggcattgtgccatgttgctgggaattgcacccaggtgatgtaaacctattcccctgccttggggctg

SEQ ID NO: 200815 - DNA, 231 bp, Homo sapiens
gtcttgctctgtcgcccaggctggggtgcagtggtgccatttcggctcactgcaacctccgcctcccgggttcaaatgattctcctgcctcagcgtcccgaggcaatctctgtaggtaaattatataatcttccaaaggccctcttacaacttgcagagaggaaatcaaggagttgctagcaatatgagaaaagttaacaccttgtcaacttttcgtatttttagtaaaga

SEQ ID NO: 200816 - DNA, 334 bp, Homo sapiens
gttcaacctctgcatgtttggagtcaagccagaccatagtcagaaaatacctaagacagagtagcttagcgatccaaggactgaacatcaacctcacactgttccacctgtcacctaggacctaggcttctgccttttctggattgagtgtccatcgagttccctcctgctaatgaccagatggtgacgtgcttccatcagcctgggccccaccctgacaccaagcacctcagcttccttaaagcaagggtgattccccattcctcgctggggaatcctgttcctggctaggacctcactctttgctactcagaattttctgatggcatctgct

SEQ ID NO: 200817 - DNA, 143 bp, Homo sapiens
actgtgggaagggacaggtccccagagagaggtgagacggtgcaacgcgagggtgagttcggagtcatcctccagatgtccacaaaggctcgagaggccctgctgtgtgtcaggcactgcgtgaaggttgtgggcacagtagg

SEQ ID NO: 200818 - DNA, 385 bp, Homo sapiens
atattaacatttaaatgttggaggagtgagcattgaggaggaagaagaaatagagacagtgaatttgaatcttctcttgaaggctggacagaatttagacacatagctatgtagacatgggagaaggggcattccaggctgagagaattgggtaaattagagttgtttgttattaagaaatataaaataaaatagtttacatattgttcaatacatagttcaaagtattatccatggaatgttaagcaaatcaaagcaataaagaatccttctttatatttaaacatagctacaaaaaaggtaggaaggtagcaacacagattagataaaagagccctgcttattgagtaaggagatttggatggctctttgtcataacagtggg

SEQ ID NO: 200819 - DNA, 790 bp, Homo sapiens
gaaagttgaatgctttccctctaagtgcaggtgaaggtaacaatgtctacacaccacttcttttcaacattgtactggaaattctgacccaaaataacatgaaaagaaaaaaaggattcatacaaattggaaagaaagaaattacttacatgacacactcatgtatgaagaaagtctattaagcttctattaaaaagctactaacagccctacatatctaaggggtctgcatccactgattcaactaactgctgataaaaaaaaaaaaaaagccaatacagtataacagctatttacaaagcacttacattgtattgggcataagtaagctagagatgatttgaaaggggacaggatgtgtggtgtgtagagagcatccacagacttttgtgttgagggagttggttactgaaggatgactttactactcaatgtagcaaggtcacaaagtcaatatataacattgtatttctatttgctcaaattgtacagttataaaaatatgagctactggccaggctcagtggctcacacgtcttatctcagcactttgggaggacaaggcaggaggatggcttgaagccagaagttcaggaccagcctgggcaacagagagaccccatctctacaaaaataaaaatttttacaagttagccgggcatggtagtaggtgtttgtggttccagctacttggcaggctgaggcagaaggattgcttgagcccaggaggtcgaaactgcagtgagttaagattgtgccactgcatgccaacctgggcaacagaatgaga

SEQ ID NO: 200820 - DNA, 221 bp, Homo sapiens
tcctagacctgacaagttaacagcatgaatgagcatgaaaaggtacaccaagatgggtggcggggacattggttagctgggattttgaagataatttaatgatgggactgttttcgaagaatgggcagggttaatgcaatcaaagagggctgttgaggcaatgaaggataaatatggtgagtgctgttaccacctctagtctgaaagacatcagggaggaa

SEQ ID NO: 200821 - DNA, 404 bp, Homo sapiens
acttttgggactcaaggctaagggctattgttagtgtgattccagttatattatactttaagtttacttttcatgactggtgtttggagttttccattatttatgacataatttaatagattaggtactgttgttgtaaccagttgtttagctaattatattactgtggtgatttttattatttttttgcatagaatgaagatgtataaaaaatagtagcattaaatcagaaacatagctgttaaatttatcctgtttttaccagcatgccttttgtaaaatattacattcatcctttgtaatttcattagtaatttagcatgattttaagatttttctctagtaaacataaaaatctaataattcaggtatagtcttactagtaataatctaatttcagttaa

SEQ ID NO: 200822 - DNA, 505 bp, Homo sapiens
atcttcggtaccccacgccgcaccgccggttcaaatgtttgagggtttttctctccacgtttcatttgtaaaccaaaaataaaattctaaggccccccaaccatctgaatggactgccttcttggccaggacactctaaaatttaacctgaaagactggttcaggccttgaccctggacgggaagtagtggttgggcttttgcctcattacaccctccagcacaatcaatacagaccttaagtcagataaaaagcatttaggaggccgggcacggtggctcacccatgttatcccagcacgttgggaggctgaggtggacggatcacctgaggtcaggagtttgagtccagcccggccaacatggtgaaacaccttctctacttaaaaaatacaaaaattaactgggcgtggtggtgtgcacctgtaatcccagctacttgggaagctgaggcaggagaactgtttgaccggtcgtgcggcgtgggagtgagctgagattgcacc

SEQ ID NO: 200823 - DNA, 496 bp, Homo sapiens
cagctctatcagtttggttctttgttaaaacggttattttgtctttcggctcatctcattttattggattttttagattccttggattgaaattttaactttctcctgaaacttccttgccatataaattttgaattgtatgtctgtcacttcagtcatttccaaaatgttaaggaccattcttggggagccagtggacttgtttatgggtagggggacacactggctatttgttttgccagaattcttgggctcgctctttttcaactgggaggactgacattccttcaactgtattgtaatttgattatagtcagttggctttgtttctggatgttttcagagggccaaggctctgtggtgggccttttttgtggctgaaatattgcccttggtttcacagatgagtatattagcaaaatatttttggtgttctagttcgggctgcaattcagtagatggtgcttaagagtaacagtaaataggctcttattac

SEQ ID NO: 200824 - DNA, 439 bp, Homo sapiens
atccagctacgcaggaggctgaagcaggataatcgcttgaacccatgaggtggaggttgcagtgagctgagatcatgccactgtgacagagcaagactctatttaaaaaaaaaaagaaagaaagaaagaaaagattgtgtgacatcatagtctgtgtattgcagcccccgtgctgtcctggtgctatggggagtagaagagaggctttgagaggcactgggatggattaaaagagggctggacttgaagccaaggctcacattctacaggtaccatttagtaattgtatgaccttgagcaaatttcatcacctccagagcctctatttcctcatctgtaaaatgaaaggggaggcatctctgctttactcatacaattgttatgagtttcacctaagagcatgagaggtagtttttacacaataaaactctgcacaagt

SEQ ID NO: 200825 - DNA, 660 bp, Homo sapiens
tttttgtgcttgtgccgtgtatctaggacagaaataggcagtgttgaagagtctgccaatctagggactgattcaggataaaagggacaaatggcaagaacactaaaggcatacgagggatgagtgcacataaaggagtgaaaggcaaaccaaggaaaaactatggaaggagcaagccaaaaaaaatgaagactttccagctgatcaataaaaatttgtgagtaacttggaattgtggatgagatgtaagtaaagtgaaggaaagggattagggataggactaatcctaaaaacacctgggacagcagggacccaaggactcaggcatccttgtggcgggactgtgaggccacatgcttgtagatccacaaaccagtaagaaataatagaaatcctgggtgccttggcccacccccaggggatatgctgcagcacagcaggtagaccttgataagatctgcatacctacatccctacaacccatcctgactcctgctgccactcctctattctccatctctgacctgttgttgcaggaatgttacataagtggaagcaccgtttgcaacattttgggattggttttttttcactccaggtaatttcctggagagtcaccggttctgtatgcagccacaggctgttcctctcagtgctggg

SEQ ID NO: 200826 - DNA, 415 bp, Homo sapiens
taggatgagagtagagaatttgtctggataacctctcaagtttctttctatgctatggtcctatgatgctcttgcctgtttctggagattactgactctgtctttttgcctcatcagctgcaatttttttatactaatagactaactctctctgaatggtgtcctttgccaacaatctattcaaagtcacagcattttaagttgtgctttgaagccaagtgcatatatatacatatacatatatatatacctatacaaatggctgcgtcatgaacttctcagaatttcaattttaaaatttaaacctacacaattatatgtctatcattacagctaaggtatagataaaactaggtatggttgtatgcatttagaacatttccaggaaggtacacaagacatcatagaatcatct

SEQ ID NO: 200827 - DNA, 447 bp, Homo sapiens
aggcagatagcttgtcatattttgaaagcttcaaatagtttaatattgatgaaacataaggtataagtagaagatgagatcacaggaaatcaagttattgaggaagggaaggtccagtcatgaaatacagtatctgctatgcagaagagcttatattttgatccatcaggagttttgttgcctatttaaacagggtgacagcgactgtagaggatgatcatttggagaatagcaagactggaataagagacaaggaaaaagcattttgtattattgggacaggatactacaaaagccctaaaatagatagtgtcaatgggaatgaaaacaagagagtagattcaagggagaatgaaatgtagacaggccttcaggaatgatgaagacccgagggattttttcccccgtcgtacagaacttcccaatattgctttaacagtgagaaaa

SEQ ID NO: 200828 - DNA, 209 bp, Homo sapiens
atcagatttgtagaatcggtgttaattctttagacgtttgatagaattctccactgaaatcatctggagtaaagatttcttgggggtgaagttttaaattacaaattcaatgtccttaatagttataaagctactgaaattatctacttcatatcgggtatgttgtagtagtttttattttttaaggaattagtccatttcatctaagt

SEQ ID NO: 200829 - DNA, 426 bp, Homo sapiens
aatccacagaaggaagacaatggagctacaaggtgggagaagctgcctgggtctctaaatcactgtaagataatcaactgcttgggaaaacctatttggattttaagtgaacatgaaataaactactagcctgctctcaattgactggggatgccattcaagaggagatgaagaagtctgtcttctgaattctgacctgatgtctacatacttaacaatctggcaggatataatattctcgggtcacaccttctttcagaacttgcagacactgcattatttcttttggcactgaattcaactgggagaagtctgaggccagccaaatgtttaaccatttgaaagtacttcttttttgcctaggttttccattttctttttaggaactctcttttttaatcactaaacttttatttaaatactata

SEQ ID NO: 200830 - DNA, 397 bp, Homo sapiens
acagagaacaccaagcagaattaatattttaaaaacactgtttgacatatcatagacaaattgcttaaaaccaaagataaagagaaaatctttcatacagccaaaaaaatagaaatattatacacagaacaacaaaagaattattacaaacttcttgttaaaaataagtaagccaaaaaacaatggaatagcattttaaagtgctaaaagaaaaaagaactgtcaactctgaattctataaccagcaaaaaatatctcagagctgaaggaaaaaaggctttttcagacaaacaaaagcagagaacatgaattgatggcagatctgtgctaaatgaaacattagagggaattcttcaggcagtacaaatgacactacatagaaattgggatttacaca

SEQ ID NO: 200831 - DNA, 198 bp, Homo sapiens
tgcatcaggtacccaccctactccagtgtgacctcaccttaactgattgtatctgtaatgaccatatttccaaacagtcacattctggagaactgggcattaggactttaacatagggggacgcattcaactcataacagccactaatgagactcacagacaaaaattgctaatgatataacagatttgaacaataca

SEQ ID NO: 200832 - DNA, 366 bp, Homo sapiens
gtgaagagatgcgtgattttctcagggtcagcaattatctatgagttcttgagtactctgacacaatttttaaaaatattttatgttattttcagaacatcttatattgtgttttatatatgtatttcatatacatgaagagctttaaacacttattttaaaagtcactaactcctaaaattttcttcctttatatgaaaatataaaagcatgtttatttcatctgaatacgctcttcagacattctttctcttataaacaaagactgtttccaaaaataaaacacaaaaaagaggggcatgaatttaagatcaccagaccaactattctctctttctaaaaatgcatcatgtcttactttgcatg

SEQ ID NO: 200833 - DNA, 407 bp, Homo sapiens
tctttcacttaatacataaacaagaagggggaaatgttgggagccaaaaaggccaaagggatggtgaccaactcagcattccactggaggctacatgatcaaacagcaaactgtttatcatgaatacagaatgtgggcaaactcgcttctgtgcctgcccagaaggtttgctgagggccatcgctccctggccccggctccttgaggttatctactgggacatctagagcctattgtttgaggaatgcagtcttgcaagcctactctggaccgagcagctgacctcttcttccacaccccttctcactatctcttttgcctaataaatatggagggctgtgtaaagctcagggcccttgtccactagaggcaaggtgtcccctgacccttcttccaaacatactctt

SEQ ID NO: 200834 - DNA, 592 bp, Homo sapiens
gcaatggcttatgccttcacgtcattcagttatttgctcaaatcacacatatccacctatgcacctgccacatctctctctctcatcactttgcacttttctacatagagcttatagtatgacccaatagtatttctttatgtgtctacttgtttttattgacctcttttattagaatattaaggaatttttgcctgttttattcttgaagctatctctggtatttttaacagtgcctggtacatactaggcacataaaatattttttgaattaataatcaaagtatataaacactagcatctcaaagtgaaaatgttgttttcttaaaatagtttctgattttattagagaaaagtattaaagaagtaattcaaaaaaccaatagtaaagcaggtgtcaggtatggggctcaggacatgaaaagacattttattttggagaggaggggaaggcagcacatcagttcaggacctacagactggacagatccgtcatgaaatggcaaaaaataaaggcagttttcagatgctggtaatatgagcaggtccagataggtggatttttgtcatcaaaaaggattgtctggcaata

SEQ ID NO: 200835 - DNA, 429 bp, Homo sapiens
tcaaggcaggccagacccacttgtactaaccctaccatccccagaagtctcttgggtgaataataaaatttctctcaaattttgttggcgtgtggagtgcttccagcatagacatcctacctgttaattggaagggttattttctacctccacagggtgtccaaagaatagaaatgaaagagaggacatctctataaaccttacagaaattaaaaggattataaaggaatacaataaacttagaaaaaaaatggacaaattcccagaaataaaaattactaaaactgagtcaaaaagagaaaatttggccagatgtggtggctcacacctgtaatcccagcactttcagaggccaagacaggcagattgcttgaacccaggagtttgagaacagccacagcaatatggcaaaaccccaaccctattaaa

SEQ ID NO: 200836 - DNA, 409 bp, Homo sapiens
tcgatcaaaccaagaaaaagggtgaaactgaatgcctgctcactgactcaagatttcagctgctcagcgagcctgacgtgacggcttatgagcccagaaaaggggtattttaaacccggctggctggatcatgtcactttcttatagaagccctgcctttccagagacctaaagtgtaacgcaatcagagacctttgaggggctcgaggctcggcggcttccgcccctcagcaccagcagagaccccagttttcaggggacatgatcccatagtgtcgccctcacttttgaagggccattaaaagcctggggcctcttatctcaacggctttgggcgtgaatgtggggcaagaagggggggggagacctgtgggtgtctcttttgcctgaggagttggagacacttgtg

SEQ ID NO: 200837 - DNA, 604 bp, Homo sapiens
ggcagagtggggagcaaggtgagatccctgggaagggggtcaggtggcccctagggagaatcacaggagggaggtcagacccaaagagcgcttgggtgcagtgaggtatgcggctctcactctgagtgtgatggaagcaccagagagtggcaggatctcctttgggtcttaaaagggccaccagctactttgcggagaacagactacagtgaggacaagggcagaagccaggaggagagtgacaagacccttgcaacaatgaatagggctgacctattaccttgcagaaatgacttcacaggtgtgtgactgcacaggctcagtcagaaaagttagcatggttcctgccttgctctctcttagaccactcatgccattcagcctctgacagaggctgatggctacggggaggctgagtgacttcccaaagtaataaagagttgggaatcagaattccaggtctgactcccagcagactgttctatttccttacacacctgcactttcatcaatcttctccagctccaatttcttgtgccccttcaacagcatctgcaggcaggatgatctttccgataaaaaccagttgcagaagttcctgttg

SEQ ID NO: 200838 - DNA, 488 bp, Homo sapiens
accccattttccgaggtattcataaggctaattgacttgttggccttgtttttaaagtggaggtaagctgttgattttagcggagtgaattaaaaaatctgaacattcgtgagccactacacccagccgcagaaattgaatagaataatgaactgcatgtgtttatcatcgacttttaactatttcagtcttatttatttcatatccaatcttaatttatttccctgtcccatgttatttcgaagcagtcttagataccaaataattacatatataaatatttcagtgtgtatctctgagatagtttcttaaaatagagctatcataacttaaaacaatttattggatcaaaatatccagttttcattcaacatttgtgtcagttttttctaattctttgatttatctcattttattagaactttttattcagcgtgatatttaatagcagttgaactttaaaatatttaaataagcttatccttatg

SEQ ID NO: 200839 - DNA, 435 bp, Homo sapiens
ttctcactggggaatgaggaaacttagaattagggctgccttatactgagctatataaagcataatacaaactatgaaaggttcctttggagacatacacaacaaccaaataaagcaccccaacccaaacaaaggaaagaaaaaactctctgagcactaactattcacacaagttgtactatagcaccagaagattccatcaagttgctctaccttcacctttggttggtggtcatgcgcctagaattaaaaaagcctataagcttaagaatctggcaactccaggtaataattttttttaatattgccttattgaatatatgtaataatttttcctctttgcaaacagaatacaagacaatattaaaaatctgtgagtacgactgggcatggtgggaagctggacttctaagaacggtaggtgatcctctagag

SEQ ID NO: 200840 - DNA, 728 bp, Homo sapiens
ttctcactggggaatgaggaaacttagaattagggctgccttatactgagctatataaagcataatacaaactatgaaaggttcctttggagacatacacaacaaccaaataaagcaccccaacccaaacaaaggaaagaaaaaactctctgagcactaactattcacacaagttgtactatagcaccagaagattccatcaagttgctctaccttcacctttggttggtggtcatgcgcctagaattaaaaaagcctataagcttaagaatctggcaactccaggtaataattttttttaatattgccttattgaatatatgtaataatttttcctctttgcaaacagaatacaagacaatattaaaaatctgtgagtacgactgggcatggtggctcacacctataatcccagcaccctgagaggcagagcaagactctatctcaataatcaaacaaacaaacaaactgtccaggtgtggtggcacagccctgtagtcggagctaataaagaagctgaggtgggaggatcgcttgagcccaggatatggaggctgcggtgagctatgatctcaccactgcactccagcttgggggacagggcaagtctgtctcaaaaaaataaaagaaattgaatacattgatattttgccaggaccctgccttctacaggcatctagtctaatgggactgagagtaaccaaggcagatgagctaatcccagtgtc

SEQ ID NO: 200841 - DNA, 563 bp, Homo sapiens
acaaactgaacttcacattatagaatttccaatgttcaggtcttaaattagtattaatgtctaatacatgagttttgcttttttccataatacattgtaaggtctagaccagtcattgtcaagtaggggtgattttgccttcaggaaacttttggcaatgtctggaaacatttgtcattgtcacgctgaaaatggtaatgctactgacatctagtgggtaggggcagggatgctgttacacattgcacgatgtacagcacagcctcccacgagaattacttatgccaactgtggcaacatagagaaaacctgtacatgatggtacataataattcattttatcctcacaacaacccttaggatacacactaatatatcaacatattttgtctaaaagtactgagccacggggatgttaagcagaattttcaaatttatagaggtggaatagaaacccagataacttggatccaaatatctctcgcttaactcccattctagagtctctttgtactttctaggattttcccctcaagtttatcactgaataccatactttacag

SEQ ID NO: 200842 - DNA, 657 bp, Homo sapiens
agtgaaataatacccatttctggtgagtagaaaggaggaggggaggaagttattctcatatgtattgctgatgggaatatgacatctttgttttcttataaaactttgaagtatagtatacttacaaaagatgaacatatcaatatgtatagttgattaactgttacaaattgaatacatgtgactagtactcagataataaacaagacattatttattccttgtgcttctcccagtatatctaacacaattcttctgaaacaaaataaatatcctgacagattgctgagtcatggctcattcatgctgagctttaatgtgttctccaaagtaattgtatcagtttatacttgcactggcaccagccctgtgtaaatgttccagttgccctgctttccatgattatcactttgaaaagcaatgtgtcaatatattaagagccataaatatatttataccaatttatctagtaattctaattgaaaagatagagatacatgcacaaaaacattcaatgaagcagtctaaattttgtctggtgcaaccccacaccgtttgttgtctgtggttgcttttgtgctgcattggcagaattgagtagttacgatagagatcttgcaaagcagaaaatatttactatctgacttactccaggaa

SEQ ID NO: 200843 - DNA, 340 bp, Homo sapiens
ttctcagagacttaattctttctctgacctaagacgttttgaatgtcttacacaattattgctttactggcactttgatgactcataattatttttaggatcaaaaatctaatgtaaccatcctcccattttccagtactaccaagtataacaaatacacacatctattgctgacaattaaattaatttcctccatctacaaacactgtcattcagagaaagtttactgaagggcaggaaacagattgtgaggggctgctgagccccacaggcagaactttaaacaaaacttatttttgccaatagtagtaaagaggctaatatgtaacttagagtgttc

SEQ ID NO: 200844 - DNA, 564 bp, Homo sapiens
taaatcctaactcaaccagaaaatatttcttaattgatgataatttgctatccctttgatgctttaaaaattctcaattagagtgcttattaaattgtactctgccaagataatacaaagttcttaaaagcaaggcaaatattttattcatctgacaaagctcatggaacacagcgtccaatcagtgaaaaatgaagtcaccaatataaaaaatgaagtcaccaatatcattttagttacacagagccatttattgcttaagttaataagaaaagcatcattagggccaggcacggtggttcacgcctgtaatcccagcactttgggaggccgaggcaggtggatcacgaggtcaggagatctagaccatcctggctaacatggtgaaaccccgtctctactaaaaatacacaaaattagctgggcgtggtggcgggccctgtactcccagctactcgggaggctgaggtaggagaatggcgtgaaccccggaggcagagtttgcagtgagccaagatcgcaccactgcactccagcctgggtgacagggcgagactccgtctc

SEQ ID NO: 200845 - DNA, 551 bp, Homo sapiens
gaatgctaagcatgtggaagttctttatatcctgctcaaggtcattgccaaggtctgatttttcacattcaacaaattgcaacctctggcataaatgggttaatacctaggtgatgagttgataggtgcaggaaaccaccatggcacatgtttatctatgtaagaaacctgcacatcgtacacatgtaccctggaacttaaaaaatttaaaatatatatgtatatatatttaatatggaattttaaaaattactaatgagttcttttatctgagtaattttgcatcaacatgcttttattatggaagagaagattcagtgagtacaaaattgcagatacatgtgtcagaagatccctgaatataataaggcttagtattctgtgtcataattgcctgtttgtattcctctctggtctttaaacttcattagggcaaggatcaactccatcttactaaccatttgattccctatgtattacacgatatatgaccaataataagccttcaataaatacttgtaaaataaagaatgttatgtaataaaaaaaaa

SEQ ID NO: 200846 - DNA, 2042 bp, Homo sapiens
  misc_feature (891)..(891): n is a, c, g, or t
  misc_feature (1832)..(1832): n is a, c, g, or t
catgggaatttgtttggttttattttttatgcttgtttttgtttttaaaataatacataaatgtagtttgccttaagaaactgttatttttgctgagaatataaattatatacaaataaaaccataaagtccagtgaaaatacaagaatacaatgctgcattacagaactccaaatctgaaagtacctccctttatcattcagttctcagatcaaaggtcatttctttaaaggtaattttctgagttccctagctaaaatatcacatcactaaccaattcagttcactctattttctgtattatctttttcatatcattttatttctacatgaaatcatctgatttatttttaaaatttttattgtctatcttatttcacttaaaagagaggagcaagaaccatatctgtcctgtttattagtgaaacacctaaaagaatacctggaacatattaggcaatcagtgaatttttattgattgaaaccatagaatcaaaatagcttgatttctagctttgttgtttcatagtctaactttagacaaattatgttctctgagcttcattatctgctctgtaaaatatcttaaggcttgattgaagattaaataagctaataaatgaaaataactgacacaataccggacaaacaggagcattcaataaaatatgtattttagatggtatacgcaattaatcaaggcagtctgtttacaaagaaagaaatcagcggggagcggtggctccatgcctataatcccagcactttgggaggcagaggcaggcagatcacttaagctcaggagttctagaccagcctggccaacatggtgaaaccctgtctatactaaaaatacaaaaattagctgggcatggtggcaggcgcctgtantcccagctatttgggaagctgaggcaggagaaccacttgaaccccagaggcagaggttgcagtgagccaagatcacgtcactgcactccaccctgggcgacagagtgagacccccccaaattaaaaaaaagagagaaatcaaggtatttttataattgttacagtattgttttgccacaaaaataagtttgctaagaaaattatgtttaactatcttaagcaattttgtttgtttgtttgttttgagacagagtcttgctccgtctcccaggctggagtgcagtggcaccgtcttggctcactacaacctctgccacacaggttcaagagattatcctgcctcagcctcccaaatagctgggactacaggcgcgtgccaccatgcctggctaatttttgtatttttagtagagacggggtttcactctattggccaggctggtctcaaactcctgacctcaggtgatctgcctgcctcagcttcccagagtgctgggattacaggcatgagccaccacacctggccatcttaagcaattttaagctcacgtttattttaataaacttcagtagatccttaaaacttctggtaagttgtttaatttttaatgtataattaagtaagtatttctaagtagttgcattttatttttgttttttatttctgtgttgggaagtctaagccctgatgaaactgcctggtggaccctgaccaccacccctgcagcacaagccccgcgtttaaaaattatagacccgtgctcacttcagcagcacatacactaaaattggaaccttatagagaagattagcatgacccctgtgcgaggatgacacacaaattcgtgaagcattccatatttttctgaaattgaggcagtaattaatagcctaccaaccaaaaaaagcccaggaccagatggattcacagccaaattctnccacaggtacaaagaggagctggtaccattccttctgaaactattccaaacaatagaaaaagaggggctcctctctaactcactttatgaggccagcatcatcctgataccaaaacctggcagagacaccacaaaaaaagaaaatttcaggccaatatccctgatgaacatcgatgcaaaaatcttcagtaaaacactggcaaaccaaat

SEQ ID NO: 200847 - DNA, 601 bp, Homo sapiens
gcactaacacaaaacttttaaaaggagtggaagaaactgtttaatatcatgggatgtagaaattgaatagatctttagactagcatattggtatagtaagtaaagctttctactttgatgctgaaaggcataataatgagaaagtacccaatgagcactaaataatacctaaacgcagggtaccaccaatgctttgctgaactaattcctatttataaccaagtctcagtttaaatgctccttcccgaggaagtaatttcctaatctaccatattaggttatgttatcattatattcaaacacactgccttgtacttcatcttttatgacacttattactcttgtaatcatctaagtgtctcatcttccctactaaactgtaagttccatgagggcactgactatgtcttctcttgtatattcaatgcctggtacaataggatttttgaaatcaattaattaaagaatgaatgcatacatgaaataaagatacatatcctatgcttatctctagatattataaaagattaactgggaaagttaatgtttataaagagaatagagtgaaagcagaaggaaaacacaaacttcccacatccat

SEQ ID NO: 200848 - DNA, 440 bp, Homo sapiens
cttgatctcctgacctcctgatccacctgccttggccccacaaagtgctgggattacaggcgtgagccaccacacctggccctcaggtctcttataggagcactaatcccatcatgagagctccaggcacatgacctcatcacctcctggagtcctcacctccaaataccatcacatcgtggttaggcttcaacatgcctactccaggaggatgcaaacattcagcccatagcagtcatgtacctgaggttgtgatgaaataaatacacaaaataacatttctatctatcaccatcctcctcctttttgactgttagctgggctggccagcacctcgaggatggtgggtttgctggcatcttccggcagacaatgggggccctgatgatgggctaagagacccagtggccctcactctgtctcttaagcccttgaccctg

SEQ ID NO: 200849 - DNA, 147 bp, Homo sapiens
gcctgaggtcctaaccatgactctcccacttcccctcccctctctgtggtcctttcctttctcctccacttgggcacctccacttggctctccctaggctcagtcccctgggagaaggacaccctgccagcctgcggccctgaaaaa

SEQ ID NO: 200850 - DNA, 239 bp, Homo sapiens
ctccctagtagctgggactacaagcttgcaccacagtgcctggcacgacctcattataaaagaaatataatctacacagctgatggttgtcagttgaagctgacagactgctagatgagggtcatataaataaataatattaaaatagagcctgctgttatagattgaattgtgtcccccaaaatgttgaagtcctaattcccaatacttattaatgtgaacttatttggaaatggggt

SEQ ID NO: 200851 - DNA, 308 bp, Homo sapiens
cttgacttgctggggaatactaaaaagctggagggagacacaggaacctgccttccaggggacaattaattcctggtctttgattcctaagcctctacccataatcaaaggcaggaacaacactcttgggtgctccgagcaccccacacttgctccacgggtgagttcatgcttttcaaggagactttgttaaggctctttgccacggtagacaccatgaaaaatttatctcttcaaattttctcttcccttcttatgtttttcttaattactctagccatcctctcgccaacactcagtacttttgc

SEQ ID NO: 200852 - DNA, 426 bp, Homo sapiens
tttggaaatgttttactattgtcaagtttcttctgtatgtctgaaaaatttaatgataaaagctgagagtggggcagccagccctggcctcaggcaggagaacagaccacgacagggctctgctgctcaggggcagcgacccacgctgctggtctcttagcctcagcccttctctgagatgaaggagtcacccaaaacccacactgtcaaatgatttctctaaggcatgtaaacacttctctgaatcaggtaaggactgggatataggaagcaactgcaacacaactggccttactttcagccatcggactgtcagtatccaattattttcaaggagttcaggcaaaagcagaatgaatgtaaaacttacaagaaaggggagaagaggtgatgcttacgctcatgttagagtcacattctcaggca

SEQ ID NO: 200853 - DNA, 866 bp, Homo sapiens
ttaaagtgtaaacaatttcaggaaaggcagatgtcatgttttatatggtaacttcttaaaaatctttaaacagatataactcaggctcttaaaaaaattgtctagttgtcatctgatgtactaacatgggggagagagagagagaaatgactggcatttccaaacacacagtaccattaaattgcaaaaaaaaaaaaggaaaggaaaagtgaggtcaagcccactttttacttaaagtgttaaacctaaccttttttgtttaaataagcaaccgtagaagtgaagaagcacgcacagggtccctattaagtgacttctgacagaagaaaatgtaattcccacctgcagtggcaccacaggagacatcttagccctgagttctggtctgtgctgccctctctcagtctttgcaacaggctggggcagcttgactcccagccatcaatcacgggctgactgaaatctggcacctccatttgcagatagaacagctccccaggtctcctgagctctggtctgagacagatgtagagtctgttgttttcatagtagcagctttgtggcctgaactcctgaatcccagttctggcctgatcgcagtccatagttccacactaagagaagtacggctgctttggacacacgaggcctcttctttctaacttttattaatactatggttgaatgtcttgcttgtagcgttagccttcaggcttcagttcaggctgacatcgagaagcacggcaagtcacggaaacatctcagggtttgatggtaaatgcttatgtctccccttgaaaaaggaagttcacatgtctggagcgaagagtctttacggttgcagtctgataccacaaagaggttac

SEQ ID NO: 200854 - DNA, 450 bp, Homo sapiens
tccctcctcccagcctgcctcagatcatggccctgaaagagaagacatcctgtttttccaactcaagagacaccactgcagggggagcagtagcaggcttggggacgttttccactcaagaagctggctatgggaagagcttaccctgtatttcatgcaatacaaaggaagatggctgtttggggttgccgtgtctcttagcaattaaggagatggctacagccaagcagtgtgaagtgacagcaccagaaagttttctacaccagaggctgagaacaggggctgtgcagtcatattcaatattgagtccccaaccctaacccggacctggcacatacaagacattcagcagatggctattgaatgaaaatatataaatgaatcaacgattaccagctgcctccactcccttaacctgctacagaattaataaactaatcttgagcatag

SEQ ID NO: 200855 - DNA, 320 bp, Homo sapiens
aagacatactttcccttcccccatcaccatctagcactcttccctgtcaccttagagctttcgacttagatgtgttcacacccagcagtcccagcagagctttctgctcacattatatgacataaaaaagcaggcaatgaacaattcatgcttctaagtgcttgcgataaagccaggctgagctgacctctcccatcctatacagctgcatgtcagaaacataagcttaaaggactgagagtagcaagcatgtgcgtgatgtggtataaacaaacaaattaaaacctgaggcctttcctctggctggtgcctaatgggac

SEQ ID NO: 200856 - DNA, 741 bp, Homo sapiens
acaagttgctggcatctgacatgaaacactgccacctaagatactttgattcatgaatatttgacctcatattttgaggtcttgccccaggagttaatatttttctgtctctccattgtgaactgttgagaaatcctttattaggtcagtgcaaaagtaattgcggttcttaccattacttttaatggcaaaaaccacagttacttttgcagcagcctaaatagcctgttgagatcccgcagaaccatgattatctaaaacagctttgcttcaaggaataaatgctgctggatgtatgagtttaggatataaattccagatgtttcttacctcatggggaggttgggagcattttgcactgtatctgttggacactaaatatgtactcctttttaggtgtaatttggagggaagggctttggtcttcaaatttattcattgtataagtagaatatattgagattctgtgccaatttttggtcagcttaattatgggtggaatagtaacagaagcaaccgttgtacttggagtgacagtcaactatgaatccatcacccatccttttgggttaatgggttacatcatgctttcataaaatatcactgttgaggttatgaaaagtcagcttaaggtaaaaagatctaaatttctttggtaattgggcaggtacttttattaggtattttaatactaatgtgatactgaaataaatctgacttcagtttagtctgacttacatt

SEQ ID NO: 200857 - DNA, 731 bp, Homo sapiens
gttaacattgagtgtcaacttgattggattgaagggtgcaaagtattgttcctggttatgtctgtgagggtgttgccaaaggagattaacatttgagtcagtggactgggcgaggcagacccatcctcaatatgagtgagcaccatttaaatcagctgccagcacagctagaataaagcaggcagaagaacgtggaaggactagactggctgactcttctggccttcatctttctcccatgctggatgcttcctgccctccaatgttggactccaagttcttcagcttttgtattcttggacttacaccagtggtttgccaggggctctcgggctttcagccacagattgaaggctgcactgtcagcttccctacttttgaggtttggggacttggactggcttagttgatccacagcttgcagacagcctattgtggaacttcaccgtgtgactgtgtcagtcaatactccttaattaactcactttcctgtatatatctatcatattagtcctatccctctagagaactctgactaatacactccctactatgtgcaaatgaatatgctagtttcagtaatgtgtggcgggggaaggtacagtagccctcatatgctcatgagggtgagcagagggcaattagcattgtgtagcagcagtggaaggcagtggggaccaggcaaaaacttaagagaacttcacacttacagcaggtgttcagtgataagt

SEQ ID NO: 200858 - DNA, 558 bp, Homo sapiens
cacgtatagcacggctgccccacccctccccggcattgcagtggggctgtcttccaaggcctggtgggatccccacatgggtccagtgtagactctgctttctgtagatgagactgaggccttatggcctcgcttgcctgttcattgctccaggaggccgccagatgccagcccaggcccaacgctcccgccagtgaccatccctcccccgagctggctgcctgccagggaggaacgcctcccagacctcgggggaacttaaaccctgggcctgagcagcaccgtcccccatcactccaaagcatctgtgggcatggcggccctggggagagagttggggacagctacagtggctgtctgggtcctcctgaagtgggggcaggggtactgcagcaattgggagagaaccttcaggcggctggacccctgcccccacttcagggaaggaggcaggtgtttgcactgaaggtgctgtcaggtaggggttggggagggcccagcagaggggtcctgggaggctgcaccggagttggacaagctttctgagtaccaggccgt

SEQ ID NO: 200859 - DNA, 413 bp, Homo sapiens
atgtggtagctcatgcctatcatcccactactttgggaggtggaggtgggcggatcacttgaggtcaggagttcaagaccagcctgcccaacatggaaaaattttgtctctactaaaaatataaaaattgtggtggcgtgcacctgtaatcccagctactcgggaggctgaggcaggagaatcatttgaacccgggagggcggaggctgcagtgagctgagatcacgccactgcactccagcctgggcaacagagtgagactctgtctcacaaaaaaaagaaaagaaaatatttgaagctaagactgtggtgatggttgtacaactctgtgagcacacacacaaaaaacgctgaattgtgcactttaaacgagtggattttatgacatatgagtcatatttcaataaggtcat

SEQ ID NO: 200860 - DNA, 300 bp, Homo sapiens
ctatatgcagccaaaatatcaatcaagtatgagaacagaataaagatgtttgcagatatgaaaggattttaaaaatttacctctgagcaactttctcagaaaatcactggaggaactgctgcaatgaaacctgggagtgaaccaaggggaagaaaatggatcgaacaggaaaggcaaagggaatccctaggatatgggtgaagggagatctcaggatgacaactatgcagcagaacagacagacagaacacaaggccagcctgacagagatgaaagtgactgaatgcctgatgaatctgg

SEQ ID NO: 200861 - DNA, 440 bp, Homo sapiens
tctctaaaaagtaaaaatttaaacatttttttaaaataagctacctaaagataattttgacaaaatgtgcaaaacctgtaacagaaaagaagacctaagcaaatgcaatgcaaagtgataccatgttcatggattagagcagttcaactccaaactaatctatagattaaacaccatcccagtgaaaatccgggcaaggaaactgagaaagtgtttctaagatctatgtggaaatgcaaaaggagcaagaataatcaaaacagtaaaagaactaagtcatgtgattttcactatctgacttcaagacttactataaagcagccggacaccgtggctcatgcttgtaataccagcactttggaaagccaaaggaggacagaccccctgaggccagcagttcaagaccagcctgaccaacgtggcgaaaccccatctctact

SEQ ID NO: 200862 - DNA, 597 bp, Homo sapiens
tggtttgaaaataggtgaatgcagtgcaatgacatactttgggaaagagaccacattcatataacttttattatagtatattgttgtaattttataacattattattaggtattatttgttaatttcctactgtgcctaatttataaattaagcttataggtgtgtaggcataggaaaaaacttagggcttggtactattcaaggtttcaggcatccactggaggtcttgatatgtgtcctctgcagataaggagggtctactaaataatgaaaaatatttatgatactgttgtttttttcatagtttcatttgcttgtttattttctcatttcttttacatattgtagtgccttagagatctgtagacctctctatcatactctttctcttagtcatctcatggttttgaatttaatctgtaaactgatgattctcaaacttccatctccatttaggatcttttagctccatacttgtttatgcaactatcttcttggcatcatcacatggatgtctactaggtatttcaaactcattatattcattattgaactattttttcttccttagatcttctccccaagccttttcatcc

SEQ ID NO: 200863 - DNA, 449 bp, Homo sapiens
attgacacagagaggtgatatgactcatagagcaagtaaatggcaaaagccaggtcttgaacccagatctttagaaatatagggaaggactgtttctgctattccacactacctcttaaagctttaaaggaaaaacggaggagtgtatactactacctttcatgccagtgcatgtttttctttttccttttaccactatctacccactaaatgcacatactcaaaactccttgtccagcagacttctcttaacagtgaggagaagcacaaaaaaaaaaaaaagaatatttatggatccaaagtacagtaaactttccagtaatgcctttataactgggtttgttttggtaaaactgtatttgtaaaaagagaaaagatgatagggaggggaacaattcagatgcttccacagcctaattccagttctgaaatgaaaataacagtacatg

SEQ ID NO: 200864 - DNA, 548 bp, Homo sapiens
cgatgaagatctgactgaatgctgagtgtggactagcttgagagtaagaaactcctggggatcacattcttagggaatcccgcacactttgatgactctcacctctagggatcccatcaggttcttacggtaaggaactaagaaaaagcaccttttgtctttgtcagggatggggaaaagtaaccatctgaaatatgcctagagaattctctatacataagcctcttccaaggagaaaacactttaccagtcaaatatttatctcaccaaggagaaagaattcttactgaattccaggcctctctaacctttctgtccacattacatagaagaaataaaactgtgatggttaattttataatatgtgccaatttaatacactaagaaagacacagcccagggatacaggcccacttaagaccagctgtaattgtaagattatagaatgttttccctccccaactttttaacaccacatcaacaggactccagtataataagtgaattatagctgagagagctggaaagcacatgctgcaacttacaaa

SEQ ID NO: 200865 - DNA, 690 bp, Homo sapiens
aagattataccactgagtcattgaaggattactgacaggataatggcatgttttagaaaaactacactggcaatatagatcaaagattggatggaatacagttacgcaagaatcagaagaatctttaatgatggcgcacgtggaagtgataaaaacttataaaacagcagaaatctgtaaatattgtgcaagacaacttactagcatattgatctctactaaagctacaaaatatctaatagagttttatagcacgcgatatatatgcttaacaataaatatttttggactatatctaatgttttctattttagtaaaacagaatttccattcagtaaagcaaatcattttcaagaaaattctttctgggtcatgaagtgccccattgtcctcttttccacaagcaagagagcttggcgaaaactcatgaatgtccctcagtcaacccaacagctggttttctaaaaactccatgatgctatcccttcccccacaccctttaatcctagaagaatacaatattttaatcattgttcaccacagaattaacatcaaaacaacttatttacagcattaccaatatggtgaaaccccatctctactaaaactataaaaaaattagctgggtgtggtgacgggtgcccgtaagtcccaaagtgctggatacccggcggacccacagtgcctgcc

SEQ ID NO: 200866 - DNA, 193 bp, Homo sapiens
gaattatatattaaaaaaagcactgaagtgttgaaagttgtagtattagaaggtttagaaaggaagttaatgacaaagtgcagttaaatgttattttgaggaaggtctggggtatttaatatctttggataaaagcaaacattttgatacttttttagtgactagtaaaaacaattttttgggcagaaatgtc

SEQ ID NO: 200867 - DNA, 314 bp, Homo sapiens
ccatttgaaatctctcaatatcttgtttaatcaatatacacactatctgaaaatcttaaacattaccagtttacaatatacattaaacatcttcaattctgagtgacagaatcatcattcttatgctcctttagaacataaatttaattgactcttctagatatactgtagctgcaatcacattcatgctccttttctttatcccatatgttcacaaacaattaaaataataacaaaataatagctgcccctggttccactataaaaatagtgctttagaaagagtttatttcaggttatcaaacactacttat

SEQ ID NO: 200868 - DNA, 409 bp, Homo sapiens
tagttctgccaacaaaatagggaactttagtctgatcaagcttctacatctatcaatttacagaaattaaactgagtatcatgttaaatggcaccatggggatgcaatcagcaaaacagacaaaatccataacatgggaatctttatacaacagagggtacaaaatgtttttagcacaaaaaggggtaaatggagataaaaggggaacctatagattaaatgagattaaggaataccttgatttatcttaatgtgtatggcccttatttggatcctgattgaagcaaacacgttgtaaaatggaaaacattataactagttgggaaaatgtatgtgaatattggatttttaggaacggatcattcatattttttaagtgtttcctgacattttggtttttattaataat

SEQ ID NO: 200869 - DNA, 442 bp, Homo sapiens
taccctaaccaaggtcttagcaacggaaccttttctaaaccttccccagccccaccaacgccacacagagctagacccttagtggtgggcactccctgaggccccgcttgattgagatacaattcacacctcatacaatccatctactgaaaccattccactcaagggtgtctcatgtattcgcagagtacacctctggcttcactgtattcacactgtattcttctgtgcttgtttgttcatctattcatacatcaaaaaaaattttttcaggcatcatcacgggctggctctggaagtacaggcaatggagacagaaaagtgaacaggaaggtgaggttcctttccttaggagagtgcagctactaaatatgacaaacagaatcataaaatctgtccactgctagaccgggtgcggtggcttacgcctgtaatcccagca

SEQ ID NO: 200870 - DNA, 661 bp, Homo sapiens
gaaaaaagggaaaaaataaccattttcctgtcaaaagagaaaaaagttaaagaaaaaaacctaccccaaacccctgaataacctacataatgtgggttttttttgtttgtattaaggagtgtttttaatatttaaaaaatacttttcaacaatggttctactgaaaaaataacagttttacatgacatatagatttataaaaattacatgttactgtgtttatagaaaaaaatggtggctgtgttttaaaaagacattgaagcaactcttgtgtgaaaatacacaggtggtgttgaaatagaaacaagcctaggcactagggttcctaaggtctgctttcatctcagcctctcatttgttatgttacatttcagggctatcattaatactgccattgtatcccatttttctttcatcttctcttttcaccccggaccctgtttgggggccaggagttcctttgagaatgtgaaggcggccctaaaagctctcctctaaataatgtgcaaatacacaacagatttgcatgtaagtttaggggtttcatggtttctggaaagcatctttggaccttagctgagtgtgcatgaattagaatgcattagtaagaacatggggctgcaaaatataccatatgaacaatagttagagcatttcactg

SEQ ID NO: 200871 - DNA, 621 bp, Homo sapiens
atcactagcgagcaacaaaagtcaacccccggggcagagggctcctgggtaccagcaggggcgttatgcactcccggagagggtcgggcagggctgaggggctccgaggtcgcttcacccctagatgctgcggcgcagtgagaggagctaccagcccaagacagacaaaggagaaagcaggcccacgctggggcgggggcggaggccgcgctggtgttcatgggccgcaggtgtcccggttgccatcaagcacgacttccttctggggccacctgtcctcccccaggcctctgtgagacggagcgccgcctgggcagtcgctggcctccagggttgaggaaaaagacggtggtctcaccaggggcagttggctggagggactctggccagtggccgagtaggagccgcagtccgaggtggcggagcagcctgtgccacctcagccctcccacctgccggcactggagcacctgacggcttctccacatgctccagtcctccatcgttcccatccggtgccagctctgcccccaccccggtcaggacgcgctggtggccctcgcctcgccgccctctcaccctccttttcttcactgttcccccatatccccatacccagac

SEQ ID NO: 200872 - DNA, 401 bp, Homo sapiens
aagaatgtgtctgtattacaacatcccaggaagactagatagttatataatgaacaaggcaactgtgttttcttcttgaaggatttttaaagacgacttttataaaagctctgttgcctaggcgggagtgcagtggtgtcatcatggctcaccaaagccttgaactcctgggctcaagtgatcctcccaccttagcctcctgagtagctaggactacaggcacatgccaccatgcatggctagattttataattttttcttttctttttttttagagatgagtcttgctgcgttgcccaggccggtgttaaacttctggcctcaagcaatcctcccacctcagcctccaaaggggcaaagattatagtgcaccaccattgcaggccaacattaaagtaaat

SEQ ID NO: 200873 - DNA, 534 bp, Homo sapiens
aagggtggatggtggggctaggcagggttggtaatcccaacactttgggaggccaagacaggaggatctctggaagccaggagttcgagagcagcctaggcaacatagcgagaccatatctctacaaaaaatttaaaatattttgccaggcatggtggcatgtgtctgtagtcccagctacttgggaggctggggtgggaagatcgcttaagcccaagaggtcaaggctacagtgagccgagattgtgccactgcacttcagtgcagccacagactgggtgtggctcacacctgtaatcccagcactttgggaggccaacggtaggaggaaagcttgagcccagaagtttgagaccagcctgggcaacataccaagactccatctctacaaaacattttaaaattagggccagtgggtcatgcctgtaatcctagcactttgggaggctgaggcaggtggatcacaaggtcaggagatcgagaccatcctggctaacacgatgaaaccctgtctctacttaaaatacaaaaaat

SEQ ID NO: 200874 - DNA, 714 bp, Homo sapiens
tgatgattaaggtgggccctaatccaatctgactggtgtcctcgtaagaagagaagatgaggacacagacaaacacagagggaagactgtgtgagggcacagggagaaaatgactctctacaacaaggagagaggcttcagaataaaccaattctgctgacacctctcaaacttctagcctccagaagagtgaggaaatccatttctgttgtataagccacccagtttgtggtgtttattatggcggccctagcaagggaatacagagggagacaggttcagacatgtaaagcgagcctttaaaagacaccacgtgcaccagtggagccccaggcccaggccccacagaccttgcctcctggtccagtccttactttatctcaggatgtgacattgcgtttcttatggaaaagatctcactaacctacttcatttaggaatgcaatttaattggcaactcaacggtgatgtcgcttcttttgccatttttctgcaacaccaaaggaaaaaattttaagccagctttttttagctgcaaagatgacaaatgttatcaacaatatccaaccagagtatattttcatcccttttcatcccgtcacgataagccagaagtatttgttgccagaaatggaaaacagcttgttcatcagccagatgatcgcagtgctcagaagttccactcgtttgccatgtgtgaaaagttaagaattg

SEQ ID NO: 200875 - DNA, 715 bp, Homo sapiens
aaggtgatctatataactgatctttgatgttactattgtaattgtttttggagtgccatgaaccactcccatataagacaacaaacttaatcaacaaatgtatgtgttcacatatttttcagatgggaactgaagcagaaagtacccaggcaacaattgatatctatgaaaaagaagaagcctttgaaatagactacagctctctaaaagaggatttgaaggtaatggaaagctttctgttgtttatcactcacagtaatacggaatatttaaatcttaccgaatcatttttggatgatagaattaagtttgtttttttttaaaagatttcctaatggttttggaagaaatatacaaaggaaaaacactgtaatcatgaaacttctgacacaaattgtgggtctctgccacaccaagcaattctctaattctttgaataccaaatgggggttctacaattaagttcaattctgacactgtctacctggagttagcatcagatcccacaaagtaatggctcagtcccacaagactggccactcttcagataccaatcacaagtccaggcctcccagactcatggccagttggctgtaaatcaggagttttcacaactccttccacagatttgataatatgctagaatggctcatagaactcaggggaatactttatttacattaaccagttcatttttaaaggctacaactcatgg

SEQ ID NO: 200876 - DNA, 394 bp, Homo sapiens
ccgattatgtgatttagaagaagtcttctaacctctctgcttcacttttactaaacagggatagtactacctaacttgggggagttgtgaaaatcaaatgcggtattgtttctgaagtgttttttaaactaacatctattataaagacttctagtcttcattaacaaaaacacagcaaatgtttactaaacatttttaaacactagtgtgctttataatgctcatcacatgttaatacaattatctccattgatagatgactaaaggcatagagaagttaaatgatttgcccaaggttagtgatttgaaccagaagtaagatgttcagactttagctttgttcttttcaccatactgcactccagcctgggcgacagagcgagactccgtctca

SEQ ID NO: 200877 - DNA, 421 bp, Homo sapiens
ccatggggcatgttctgctagtcatttttggcgcatttacatatacacacacatatgtacacttttaaaaactaaggccgggtgcactgactcacgcctgtaatcccagcactttgggaggccgaggcgggcggatcacgaggtcaggagttcgagacaatcctggccaacatggtgaaaccctgtctctactaaaaatataaaaattagctgggcatggtggcacatgtctgtaatcctggctactcaggaggctgaggcaggagaatcacttgaaccagcgagtcggaggttgaagtgagccaagatcctgccactgcactccagcctggcaacagagcaagactttgtctcaaaaaaaaggaaaaaaaaattaattaagattgattaaaattaaataaaaatttaacccacgcgtccg

SEQ ID NO: 200878 - DNA, 733 bp, Homo sapiens
gaggcaggcccaggagcgagcccatggtcttccgccgcggggccaggggcgggccccaggatccggagcttcgtgcggggccgagtccaggtttggggcccgggaggcggggccagttagggcgagggtccctgggatcgtcgggtcaggccttgggctaacgtaggcactctcgcagttcctccgccttcaggaaggtcttttcagcaggggccttacgggtgcatgcttcggtcctggaggccttatcctagcctcctctccatcagcgccacccgtctggggcccgaaaggagggagctttccctctgtcccccagcctttggactgtcagcaaacaagccattcgttcatcaaatactttttaagcgcctaccatgtgcctgacaggggagatgtaacggtgagaaaaactaggtgtggtccaggcccttcaggggctcaggtgctcgtggaagaagtggacattgaagtacttatcacacaaatgaggataaaagtacgatagcgatatctaccacgaagctgttgttccccaccagaaccaaatgagcgcaagatctgacaaagaaaaaaaaaggttcatcttttattcctcctactacattcctttttgctgaaataatgaagataataatcaataaaaactgagggaattcagagacctgtgccagtgcaggtccttagcatgctaagcgcaggtcccctgggcccgctgttgtttctctataaa

SEQ ID NO: 200879 - DNA, 1494 bp, Homo sapiens
gaggcaggcccaggagcgagcccatggtcttccgccgcggggccaggggcgggccccaggatccggagcttcgtgcggggccgagtccaggtttggggcccgggaggcggggccagttagggcgagggtccctgggatcgtcgggtcaggccttgggctaacgtaggcactctcgcagttcctccgccttcaggaaggtcttttcagcaggggccttacgggtgcatgcttcggtcctggaggccttatcctagcctcctctccatcagcgccacccgtctggggcccgaaaggagggagctttccctctgtcccccagcctttggactgtcagcaaacaagccattcgttcatcaaatactttttaagcgcctaccatgtgcctgacaggggagatgtaacggtgagaaaaactaggtgtggtccaggcccttcaggggctcaggtgctcgtggaagaagtggacattgaagtacttatcacacaaatgaggataaaagtacgatagcgatatctaccacgaagctgttgttccccaccagaaccaaatgagcgcaagatctgacaaagaaaaaaaaaggttcatcttttattcctccaaacactttcatttaaatcaagaggatgggatgtggttattgctgtgtatttagacagaatcaacggtttctgggtctgagatgttgcatacaccttctcagtccctgtatcctgagatggagtcacctgagaatccacagcaagtcctaaccagggatgggtctgggtgattaaggaaggttggcttcagaactgggccaggggcactgctttgcttttgctgttttgatcagctctctgcctgaaggagacaagaaaaaccaacgggaacagcccagtaaaggcgccattccccattttacagctggggaaactgagttacagagcttgtctgcactgagtcatcaggagcaaatgctagatcagatagggtctctctctctgccacccaggcccgagtgcagttgacgcagggcaggggagccccgaagtggagcatagtgtgtccggaactggtgggttcttggtctcactgacttcaagaaagaagccgcggaccctcgcgaaactcctggagggcagaggcatgcctgccatcttcatcattgcattaccagcacccaacactatcaggggacctgccctgataactcagtctacaggtgtatccagcagctccagagagacagcgaccagcgagaaggggccatgatgatggaggtggttattgtcaaaacgaaaatggggatatgtagggaacaagaaagagagatcagactgttactgtgtctacctcagacaggggaagacataagagaactccatttcgacaaaacgactgtacttgtaaccaattgctttgctgagatgtcgttaatctgtacctttgccccagcactttgcccaagcaatttgaccaatctggagctcataaaaacctgtgttgtatgaaat

SEQ ID NO: 200880 - DNA, 968 bp, Homo sapiens
cggggcaggtcctgggtagagtccaggttggcggttcctggggcagggccaggatagggcgatcctggaagctgggcttcggaagcgtccagctgttgttccccaccagaaccaaatgagcgcaagatctgacaaagaaaaaaaaaggttcatcttttattcctccaaacactttcatttaaatcaagaggatgggatgtggttattgctgtgtatttagacagaatcaacggtttctgggtctgagatgttgcatacaccttctcagtccctgtatcctgagatggagtcacctgagaatccacagcaagtcctaaccagggatgggtctgggtgattaaggaaggttggcttcagaactgggccaggggcactgctttgcttttgctgttttgatcagctctctgcctgaaggagacaagaaaaaccaacgggaacagatagggtctctctctctgccacccaggcccgagtgcagttgacgcagggcaggggagccccgaagtggagcatagtgtgtccggaactggtgggttcttggtctcactgacttcaagaaagaagccgcggaccctcgcgaaactcctggagggcagaggcatgcctgccatcttcatcattgcattaccagcacccaacactatcaggggacctgccctgataactcagtctacaggtgtatccagcagctccagagagacagcgaccagcgagaaggggccatgatgatggaggtggttattgtcaaaacgaaaatggggatatgtagggaacaagaaagagagatcagactgttactgtgtctacctcagacaggggaagacataagagaactccatttcgacaaaacgactgtacttgtaaccaattgctttgctgagatgtcgttaatctgtacctttgccccagcactttgcccaagcaatttgaccaatctggagctcataaaaacctgtgttgtatgaaat

SEQ ID NO: 200881 - DNA, 198 bp, Homo sapiens
gggatcctgtgacggcgggggaaggcagcatgagtcttaggagcaattaggagacaaaggttctgctttccaccaaaccttcttcggtctgggccctcccttagcaaccctggggctttagactctctctccaccaatccctgatgaccccggtggtgcctcacaatggacattccaagtagtgcccgcatcatccca

SEQ ID NO: 200882 - DNA, 470 bp, Homo sapiens
agataatctgtaagacttggtgactgattaagtaagagggaggaatatggactaatgcctggatgtcccacttaggtgagagtaatgataatcctcaagataaaggaaacacctctgtcctttcttctcccattgaaacaccacagtttcagtcttcattcatcctcttccacatactatgggatcctgggagtgaagggtaatttgtgattgctcctaacccatgggtaacccattccgcaggaagccataatttaggactggtcctatcaaaatttaacattgttttgccatcatgactttgcaaagtaatgcatgcatgaatatgccaaaactgattttcatttttcttttattttctccccagaatatgtttcaaaaatgcttctgagtgtttaatgaagaagtgcaataccatcctcaacatgtagatatctatactactatgcttaatatatgtattgaagctg

SEQ ID NO: 200883 - DNA, 589 bp, Homo sapiens
gggaaacagagcaagtaaagtgttaagttatatgtgaaataacatcctcttcacccttggcgctaccagtgagagagtcaagcacatgaaaactaaatttgacagggccaagtttgctgcttttaaagggcagcgtaagcgcctgatcaaagccactctttgaatttccgacagggagaatgttggttaaaatttctaaagtttactacacaagatagtgctaaaacatttaagagggggttggagtgccttaaagtgctgggtaggtgggtctcagtcccaaactgcaaattcctctgccctccaaatgtaggtgctaacggaattaatagagtgtttaacagaaagtttccctaggtcttaaagctcatccacctaggaggttttatctgcctcctgctgctctgccagtgggtgggaagggcagaaaggaaattactttgattatcctctgttttcatggtgccgtgtggcctcaacctaacttaggctttgatttgctttgtttcttctctagattttgttgttgttgttgttgttgtgtgtcctttttttttttattatcgttcctgtttgaatatgcaatttt

SEQ ID NO: 200884 - DNA, 698 bp, Homo sapiens
ctcctgacaggtggatgatttatgctcatagtcagaagaatcggagggcctgcggaggagacagcatgagcaaggtggtggcgagacagatgctctcagtgggcttgcaggggctggcaggctccaactagttcaggtgcaacctggacactttcagtgctgaactcctattgcctagattccaatactctgatgtgtcatttgcaatattatatgcaatgtacacaatgaataaactgtcaaatccgagcaagcattgtacatatgctgcatatacctcttacatatgtcaaatgatgattatgatacagatgtaaatattctataccttcaggatcctcagttctgaaaatatttagcccaggtatggtgagtggagagtgacaagatttcctaacaattggatcaatattaaagattgcacagtgggattaggagaaacacacctcaccagaaaactgacattcctgtcaattattttaattatttttcagatacatgacatgctttcatgacattttattctgagaaagcatttgaatatttcagaagaaaattattaagagatggataaaaggaagaatccctacagagttgaactgctttgagatcaatcttcaaaatagttttccagaatttctctcaatagctctaaacaataacaatttggtaaagattatggtattggttaaaagggt

SEQ ID NO: 200885 - DNA, 485 bp, Homo sapiens
ccacagtggagaagcatggacgtgaggagaaaggttggaaggattgactctgaaaaggagacattctttctctgaaccttgatggaaagaacctgtgtagaattgttacgtgtgatctgtttccagaaaaataaggaagttagacactctttcttcacttctgttcctatagacttgaaatatgatttctcacatagtagttattaaagtaaaaatttaatatactaaaaatgatgggtattttgcttcactcttgaaatgggcatgtcctgtacattagtcctatacattagttatgaatagattatttttctcttagcatgatgtaatttcataccaaacatgcagagaagaaatgggctcctgccattttttttttttgccatccaagaaggtatttcttatgcacctttttgtacataaagtagaaatcaacacccaacgtttcttatatatatcaagcttaagcttctggtgaaaatact

SEQ ID NO: 200886 - DNA, 328 bp, Homo sapiens
aagatgactgaagcccgacacggacctgagcgtccagaaatggtgctcaccatgcttccagctcacaggtctagaaaaccagcttgcgaataacagtccccgtggccatccctgtgagggtgacgttagcattacccccaaactcattatagttgcctaagcattgcctggccttcctgtctagtctctcctgatatgccattcttgctgcagcaagaatggcatatcagtgcaaaatgagcacatgggaccccttgttgaaaaagtaagaagaaaatgcccatgaaaagcactgaaatccagagccttccacttcttcccagtctct

SEQ ID NO: 200887 - DNA, 547 bp, Homo sapiens
aattattgataacattattgtaatatttaaaaataaatgaaaaattaataggcacacatttaaacacatggaaaatggacatttggaactctagagttttctgccataaaacatggctacaataatttaagtctagaaaaatgtggaagggggaataactatccaataaagggggaataattatccaataaaatcctcccaaacacccataaatattacttcctgcaaaatcattcaagaagtatttgctacacaatgtaacagaaaacaagtgatttgattctacttaatatatctttgacaataaattgattaagtcttgggtgaaatttatggaaaataatttttttttaggagaattgctgttcagccattcttactgataatagtcaacagggccatctatctgataagctcatttctagttcacagcattgacccatccacagagtggagaattgtgccctttcattctctagagtggttaatgatgtcaggagttgtatttttgactcaataaagtgaaaatatttacttttaaaataaa

SEQ ID NO: 200888 - DNA, 403 bp, Homo sapiens
tgaggtatacaccggtgtaacggatcaggttttcgaccctgatgaagatttttatgattgttaactgggaatcttttttattactttacccctcttactctctagattctgaaggatcttttgtcttctaatcaaaaaaactgacagattgagagggagggctgccttcttttttttccttgtaagtaattaggaaagaggtttaaaaaaaaacagaaaaatagaaaaaaaaagaaactattttctttctcagaaatttattttttattattttggtttttttttgagacagggtttcaccatgttggccaggatggtctcgaactcctgacttcaggtgatccacccacctcagcctcccaaagtgctgggattccaggtgtgagccaccgcgcctggctga

SEQ ID NO: 200889 - DNA, 299 bp, Homo sapiens
caggctaatcctaaaattcacatgaaaatttaaaggtagccaaaacaatcttgaaaaaggagaacaaagttaaaggagtttcactttttcatttcaagacttatttcaaagctacagtcatcaagacagtgctgtagtggcataagaatagacaaatacattaatataatctaattaagagtccagatgtaaacccttacaatttgcagccaatttatttcaaacaaggatcccaacacaattcaatggggagaataacagacatttcagcaaaaggtatctacatgcaaaagaatgaa

SEQ ID NO: 200890 - DNA, 386 bp, Homo sapiens
gagctttgcaaagagcattcctcaggaagattcctcagaggtcctctacaattctccaaaaccagcataatgtagttagtaagaatatggattcctgaagtcatatcccagctctctcactcacttctctgtaaaatgaggacaatgatgatgataatgatgatgattagtactcctagaggtatgatgaggataaaataaaataatacatgaaaacaattttgaattgcgctcagcacctgtaaaagcattcaatcaaaggaagtgattatgctacatgttacttttttatttgtataaaagtaccacaaatgtattttatccagatgataaacatttagttgatttccaatttttcactttaataaacaatgtcaagctaaaca

SEQ ID NO: 200891 - DNA, 691 bp, Homo sapiens
tgtaacttcctttgtctgtttgtttgtctgagacggagtctcgctccgtcgccagacgggagtgcagtggtgcgatctccgcccactgcaacatccgcctcccgagatcaagcgattctcctgcctcagccttccgagtagctgggaccacaggcgcgcgccaccacacccagctaatttttgtatttctagtggatttgggtttcaccgtgttggccaggatggtcttgatctcctgacctcgtgatccacctgccttggcctcccaaagtgctgggattacaggcgtgagccactgcacctggccaactctttttcaaaaaaagaatctcctgctataacacctatcatcagttggattggaactgtgcaaaatgtggatgtaaacaatttaggattaactagacataatgtgacaattttggatattttatattttagattccactttttattttggtctactgatttccagtagaaaaaattttaggatttctgtaacacgtaaataattgcaacttcaataacatatgattacttgaaatagcgactctatttttcatttcattgaagtagtaactgcattttgtttcatacctatactcctccctgcttcaatataggtattttgaagtcctaatccctaatgtgataatcgaagatggagaccttggaaggtaattaggttaga

SEQ ID NO: 200892 - DNA, 199 bp, Homo sapiens
gatcttaacccttgacatcatagtatagtggttaagagtagaggaaataaacaactaggtaaatctagaatacaggttattctacaaagaactaccctgaacttgtctccccctaaaaagaaacaagagctagggcactgttctagactaaaagacactagcaagatgtgatgaccaagtgtaatacatgaacctaaat

SEQ ID NO: 200893 - DNA, 436 bp, Homo sapiens
gtttgggagtgttaagtgcattcacaatattgtgtaaccaatctccagaacacttttcatcttgcaaaactgaagctatatacccattaaacaactacttgttcctcccaaccccgattccctggcaaccaccattttaccacccatctctatgaatttggctgcttgaatcatatagtatgtgtctttttgtgactgtcttatttcacctagcataatgtcttcaaggttcatccttgtagtggcgtcagaattttcttctttaaaaatgtctttaaaaattagccaggtgtggtggtgggcgcctgtaatcctggctacttgtggggctgaggcaggagaatcgcttgaacccaggaagcagagattgcaatgagctgagaccgcaccattgcatgccacctttggcaacaagaacaaaactccgtctcaaaaa

SEQ ID NO: 200894 - DNA, 171 bp, Homo sapiens
cgataactttgaagttaaaaattaaaagataggctgggtgccgttgcttaggcctgtaattccagcactctgggacgctgaagtgggaggatggcttgatcccagagatgcgagaccagcctgggcaacatagcaagtcccccgcccccaccataacaacaaaagtaccaa

SEQ ID NO: 200895 - DNA, 240 bp, Homo sapiens
aggtttgatctcatctacaattaatgtggttccctcttagttactttgtaggtatgtgtggtgatggagccaatgactgtgggggaaggacgtgcagctctcgttacctccttttgcatgtttaagtacatggctctgtacagcatgattcagtatgttggtgttctgctgctctactgggagacaaacagcctttcaaattaccagtttctgttccaggatctggccattacaactctt

SEQ ID NO: 200896 - DNA, 446 bp, Homo sapiens
cgacgttaatcgataaagcttgattaccattctggaaccagcaccatctgaacaatttagctttgctggacaaaaatagacttgagagggagaattgtacattgaaacaagaagaacttacactcttacaatttttcaacactctcttccttttaaggaatacttctcattaaagggaccatacattaaattatatccaaacttgagtagttttaatttcttttctgtctgaaatccctgttagaacaatctctaaaactactccatagacacagaacttgagtagatttattgagcgccatctgctggctttgttttaatggaccaaataggtggtgcctggacatctttaagaattatcctgtatcttagtgttgcaaaattatgaagctggaagacagtatgaatttgggctatgactggtagtagtatttaaaataatagtt

SEQ ID NO: 200897 - DNA, 410 bp, Homo sapiens
ggctttcttcccttttcccatggagtgccacggaaaggtcatactctgccgttttgtctcttaatgcatttgcctgggaagttgcatctccctggcatctgcattcaattaacactttagtgcaataggtgtggaccatcaggaaatggcgtctccctgaccctaggtgccaatgtatgacttttagagaggcaatgtgataactgctgagccatcacccaacattcctggtgggtgggagaagagccctttcctgccctgctcatgctgtctaatggcctgtgacagcatgactttagtaggctttgggaaatcaagagttttgaagattattggtaaaataaagacatttggttgaaattaggtcagacattaggtttgctaaatgctttaaggtaataaactgcttc

SEQ ID NO: 200898 - DNA, 469 bp, Homo sapiens
agtgcttttttcatttccctattttacctgctttgcacatgcctcccgccctcacccgggaggcggcgaagacgcccactgggaccgcgcctggccgttttctgggcgcgtcctgcccccacggcctctgtctcttagggcgactgggcgcggaagaaaagctggagagcccctgcggggtggcaggaggagggtgcctgagtcccgcgagaggcccgggcgaggaagatgcgcagcctgctgatccgcgtcccgcccggcgccagggaccctcagagggaggagagctcaaagacctcgccccgcgccttcgcgaggaccaacccagtccccgcgcctgccccagagcggcttagaaactcagggcacagtgagagcgcagggcgcctcccgaggcttcacaccgccggccgggccagcggaggctgtgaccggagcgccccctctgtgccgcgcacgccgcggccgc

SEQ ID NO: 200899 - DNA, 475 bp, Homo sapiens
agggctggagggagagtggaatgtagtgtcccctccgagcgtgagggggacctagtagggtgtccagggtttgggttttagcctcaggagcacttggcaaggggctacgtgggggcggttatgttcaccctgagagacaggtggcccttataaaagggggtcatctatactatctagtcctgtctttggactttctttgcggagatgattaggttttggcgtagggccgtgaaggcctgtacatatggtatttctgaccatttgccctgccaggaaacagctgctgcaagactgaaaagaaaaggactcaggtccctcacccaaaccgggtggtggtgatcaggcgcttccacacggaaccctttcagtttccctggagagtggccccaaccacaaacctgcggttgcctccatgcctaggcactgtccaccgagagtcccgagttggaaaggaaaagagagagaaagaggacaa

SEQ ID NO: 200900 - DNA, 189 bp, Homo sapiens
aattctaaatccagctttgctattagatactggtagatcagaatgttaggtcacccacacagttttctttgaacaaaattcaattcaccataattaacaccaacacccagctcagtcataatgttgagctgtgtttagggatttctgaaagcaaaagggaaccaagtaccctaggctctaaatggcaca

SEQ ID NO: 200901 - DNA, 615 bp, Homo sapiens
gtttcgtatctttgcaattgcaaattgtgctgctataaatgtgtatgcaagtgtctttttcatataatgacttattttgcggggggggggggaggtggttacccagtgtgggattgctggatcaaatgatagttctacttttagttctttaaggaatctccatactgttttccatagtggttgtactaacttatattcccaccagcagtgtaaaagtgttcacttttcaccacatccatgccatggctgctttttattgagcacatattatatacgagccattgtgctcaacactttacatctgttatttactcttagggttattctaaggattaagtatttctgtccttttacagatgaggaaactgagacttacaggggttaagtcactcactcaaggccacacagccagtaaggtggcagagccctagagcagcctctcaagcttcaatgtgcgtttgaatcacctggggctcttgttaaactgctgctacagattcagcaggtgggagagtggaactgaggtactctgtttctgacgtgccccctgggtggccctactcctggtccctggagcactttgagcagcgagagtttctctgcctgtatggccca

SEQ ID NO: 200902 - DNA, 501 bp, Homo sapiens
tccagcctgggtggcagagcaagaccctgtctctaaaaaaaaaaaaaaagtgtattgaggatacatctgaaattgataaaatcatttctgtatcggaaagaaagccactgcaagaaggtctagaaaacgcactaaattgtagttgtggtcttaggcgacgcgcacttcagtcttcctgcccctcccctccctgaaggggcgaagggctgagcgtcatcatggacactttgctcatggatggccgattggggtggcccatgggctcctctggctggccctgtcctggagctgccttgtggagcgtgcaattcagtgtctagtggaaaggacgggatgatctgggtggggcacagaccaagggcgtggaactttgtcagcagcaagagatgcaggccctgctggccatcttgtctttgtcctgtctggccagagactgggatgccccagagactcaggtcaagccaggggtcatttgttttcagcttagtgacctttgacatg

SEQ ID NO: 200903 - DNA, 178 bp, Homo sapiens
gtgagccaccgcaaccggcccaacgctgtttttactgttgtttccttttttaacctaaggtatcttagaagtcaccctacattagtgcatattaaacattgttcgtcttaatggctgcacagtattccactgtatggattattttttaatttggttgccggtactgttatcagccagg

SEQ ID NO: 200904 - DNA, 781 bp, Homo sapiens
gtactactctttaccaatgaataatcaggttaaatttacactaaattattcagtaaaagttaagaacagctgaatggataaaaaacaagattcagctatatgcggcccacaagaaagtggctatacctgtgaagatatgcatagattaaaaataaaggaatagaaatggttattccatggaaatcagaatcaaataacactaggagtagtgcacttatatcaggtaaaatagatttcaagacaaaaactacacaaagagacaaagaagatcattacatgatgataaagtggtcaaatcaggaagagaatataaccgttgtatggaaccccgatatataaagaaaatactattaaaaaagagagagacaatggtagcaggtgacctaaacacctcattttaatcattgcacagatcaaccagacagaaactcaacaaagaaaggttcaacttaatcgtcactctagatcaggtgaacctaatatacatttatagaacatttcatgcaacagctgcagaatacacatacttctcatcagcacatggaatattctccaggatagaccaaatattactccacaaagcaagtctcaaaaaattcaaaaaaattctgagcaagcagcctgactagatgcagctgagaagtcctgctcccacggaaagaaaatatgatttcaactacaccaacataaattgaacagatctttggacagaaaatgccaaatgtggacggagaagagaagcagatgctgaggctgtaaagggaggaaactgggaacacgg

SEQ ID NO: 200905 - DNA, 598 bp, Homo sapiens
gagccctgaggctctttggggttgataatattctctaaagctggggaggggagagctgataaaaagtgcttgttcacacttagcagcatgaaaggtgactgagaattagcctaagcctctgtgcctagcctctttataatgtactgaaagtttcatagctctatgcagggcagagactgggcagggtacaattctttacaagactaaatcttcagggctctaaggaaagggaaaagaatgaatgagaggcacactagcagggttgggataaatgggtgcaggaggagaaaagctgcttcttcctcttctctggagagatcaaggatgagtggatggagggctgtgtgagcacatacacttcagaacctgatgatgggtagtggctgaggccactcatacaaacatgaaaaccactgctgagttgatgcacattcatttctgatagctcagcaatcttactataaatagggaacagcagatgccattcattgttctggaattggaggcacgggctcattgtcttgcttgggatatttggaccggcatcatttattaatctaaatattcagtaaaagtggaaagtcaaggattctcaggt

SEQ ID NO: 200906 - DNA, 122 bp, Homo sapiens
tgtaagacaataaaaaatggtggctccacatgaaccttattccataagctatttctatatggttagttaatttctattctttttcttaaaaataaaccaaaaaggagtttttttaaagtcac

SEQ ID NO: 200907 - DNA, 669 bp, Homo sapiens
ccggcagtcacagaatgggtcatttcaaggcaggccctggtgctttgggataggtgtgtgctgacctctctagtaactgagatatctttgagcaccctaacatggagatgtaagggttaactctgaatcagggtgactggcaaggaccactatcagaatcagccaggtatttattgagcatctaggcacaatgctacttggtgacctgcttcttaggaactacaacgtgagcctttattttgcctcgtctgcaactccatccttagcctttgcgttgtcagcctgccttcctttgccacacttgagtcttcctaaccttaccccttaatagcaatcacttcatcatcatgcgctttcccactatcccttctccctgtctcttcccacccatgaaaacaaatttagaaaatgaagggaaataaacaaacaaacaaaaagtcaccattatgatgggattgaggcataatatctgagtaagaagggaataaattagttttccttgacagtatatactgcctgtttctgtccatcctcttatttgcttctttttctttgctcttccactccagtccttaagcgagtttagttttattcgttcctcttgtcccttttcatgataacaatgtgtcatagtctgctttaaagtttttcatacttaccgatgttagt

SEQ ID NO: 200908 - DNA, 438 bp, Homo sapiens
taataataagaaagggccatgagcccttgaagttcaagagagaaattcattcaggctccaaatcaagacaggatttacctcatgtgttatatctcatacttgatttaagaaatcaaatttaataaaaggcatttataaaatgtaagaataacccaaattgcacaaggttctgaaaatatcattacaggaaagaatgaggacttcagaggtagaagaaaggttgtgataagatcaatctgaagggcaggcttgccaataaaagaggaattaatctgattcaggcagctctacaaggcggaggaataagaagagacagaagtaaaagaaacaggcttcagctcaatataaagaattaacatgtctctaaaagaatcatgtagtgagctgaccgctgcactctagcgagggagacaaagtgaaatttttgtctcagaaaaa

SEQ ID NO: 200909 - DNA, 364 bp, Homo sapiens
tgtcagtaccttttttgtcattaagataaccatcatttcctagttaaagcctaaactgccccatatgaattagctaatttctgatactatgctggcccaagagtagcacttttataagctaaaaacgaaagctcagagcatacaacttagagactattcacacaattactcatgtaatcaaacccagaagaagggcaacaccaaccaagtcttttactggtctgttgctgctctacagctaccaggatggtacctaaaattatcttttgaggttcagtgaggcctcataattcccttaaacagtcaagtcatagaatactttgaaatcccagaagtcaagttaatagtattactcggctagcta

SEQ ID NO: 200910 - DNA, 944 bp, Homo sapiens
ttgggttgcttctaccttttggctattgtgaatgtggttgctatgagcaacactagtgtatgaacatctgtttgggtcccagctttcactttttttgggtataggctcagaagcagaattgctggatcagatgataattctatgtttaattttttgaagaatggccataatgttttccatagcggttgcacaatttgcattttcatgagcagtgcataagggttgcagtttctccacatcctcaccaacacttgttattttctgttgttgtttatagtcacgttaatggacgtgaagtggtatcttattgtggttttgacttccatttccccaatgattagtgatgtggagcatctttttgtgtccttattggccattggtataccttctctggagaggtgtctattcaagtcctttgcccattttttaatggaggtgtttgtttgttgagttgaaagcacgttttaattgccactgtgctggcctgacagccaagccccaccctcgtactgccgcatgctcagttcccaggcagcagtgtctcacatcctccacccaaccccatctcagcactggtcacacccagcacaggaataagggcctgatgggcaactgcctcccattttcctgggaccaaggagactatacttggcccaggtgtctatttgagctatcaaaaaatgtttccggagaccaggcattcgggaaggtataccaggaataaaaacagcagacagttacagctgtcaaattgtgacttcacagtcagtgagtgaccaccccacccctgctgcctcccccagaggtcctccttaacaaaaacgcattattgtggtatctgcagaatcaagctttaaattttaaaacctgagcagggccgtagctctgaaaagccctgctcactcagtgatgtgagggagagcctgtggggaggggcaagggcc

SEQ ID NO: 200911 - DNA, 535 bp, Homo sapiens
caacattctatgtgagggtctccaaagaagctctccaaaagctccccatgagaaaaagtgcggctttgtgtatttgtcacatccagagagacccatcaccagatgagatccataaccaccatgtgatgctgtatcctttctctcatctctcctccccctgaacccaaccttggagaagtgagaaattaagactggtgagtgcagaggaggagcaaggaacatgccagggaggattgacgagtgcagaggaggagcaaggaacaggccagggaggaccagcgagtgcagaggaggagcgaggaacaggccagggaggaccagcgagtgcagaggaggagcgaggaacaggccagggaggactggcgagtgcagaggaggagcgaggaacatgccaaggaggactggagagtgcagaggaggagcaaggaacatagcaggaagggggccaagagaagggcctcctgtcttcccttccccagtgcaggtttccagacccacagccgctcaagctcacagagaggaaaagtttctctct

SEQ ID NO: 200912 - DNA, 402 bp, Homo sapiens
cttatacctcagttttcctacctgtaaactaagatgatagtgagcttaaatgagataaagcatgcaatatgcctagtacataagcattaaaaatgtttagctattatgggggagagactagaggaagtaggtggttacagcttgagtcacattgcttctttaaagagtttttgtttaattttctaaaatttcttaaacattgttgcaaatttgttgaggtgaatctcatagcctctggctccattttccaacctcaagtattcaaaataagcttgtgatctttgaagtacagaagtgcagtcccaattaccacaggttaacactcacctgcagctcatatctatttctttgaaaaaggaaattaaaaagttgaactctgagttttaatgttggttcactcca

SEQ ID NO: 200913 - DNA, 279 bp, Homo sapiens
gcagcatcatcccagctccctgccaaatcaggcgcagcctgtgcaaccccaccttcaactcctaggtgctcactggagaactgagacaaacgttcatggcagcatgaccccaacagccaaaaagtggaaacggcccgagtgtccgcacggctgcttgtggctgggctcacgtggccggtcacacagggcgtgagctggtcctgggcacgcacgatgggccacgcagcaggaggaacatgacaacgtggcccctgagacagcccggggagcgcagccctg

SEQ ID NO: 200914 - DNA, 292 bp, Homo sapiens
tgtcttccgaggtccccaaagctttccctgggttggactgctacgggtgagtctatgcatagccagtgaagattctcagcaccagaagctcttttcattctcacaggagtttctttcctcactttccttcttccacccgactgttcccaagcatagccttcatgtctgcttgctcaacaagtgttagtaattggtagtctacaatcccaacaaattcttgagtaattattagaatttaagtgtaactaactcaatgaataggaaggttggtttctcagcatagcatccgtta

SEQ ID NO: 200915 - DNA, 681 bp, Homo sapiens
tttattccatgattacaagctctttaacttattttcccagcatcccactatatcctcaacagttattctgcaatcatagtcccaagttttaaagtaatgagtgaaatgttcattcctaattatttccgccttaaaatcctctcagctatgtgtgcctatatgaactacaaaatactaggcattaggtaatataatggtatgtagaaggaagatgacagagaacaagccctatctactctttatggtgttgcctccattctccccaatctatcagtccctcttagcctctctgactctcaattcccttatatactctgtccttccaccaccaggaaaactaaacaaataataactaaaatgaaaatttcaccagaggggctcaacagcagaagaaagaatcagaaaacttaaagacagacaattaagagtatccagtctgaccaacaaaaagaatgatgaaaaatgaacagagccttggagagagatccatgggacaccatgaagcctataaacatatgtataatgagagctgcaataagagaagagagaaaggaaaggaaagaaagattatgtgaagaaatgatgactgtggtggggtgcagcggttcatacatgtaatcctagcactttgagaggatgaggcaggaggatcacttgagcttaggagtttgagatcagcct

SEQ ID NO: 200916 - DNA, 1173 bp, Homo sapiens
tccagctcattgctcatcaccccatggattgtttgctcatagcaaatctgcgccaaataaattccatgtcctccaaggtttgatacttaatagtaatataactaatcctgtttaagggtttattgtatgccaggcagagtgctaaattctttacattattatctcactgagtccccctaacaaccttgtgagagacatatgcttattaactctatttacagataagaaaattcaggtccagaaggtttacattcggatgccacacagccagtaagcaggagaactgaatgcaaacccaggctatcttattgccagcttggctgttctgaaggaactaattagaactggcttgagatcatacttgaggaagaggtgaagtattacaagtgtattaggacaaacctgggttcctgagacttctgcttccttaaccattggacttttctcttttttttgagacggagtctcgctctgtcacccaggctggagtgcagtggcgcaatctcggctcactgcaagctctgcttcccgtgttcacaccattctcctgccttagcctctcgagtagctgggactacaggcgcccgccaccacacctggctaatttttttgtatttttagtagagatagggtttcaccatattggccaggctggtctcgaactcctgacctcaagtgatccacctgccttggcctcccaaactgctgggactacaggcgtgagccaccatgcccagaaatttttgcatttttagtagagagggggtttcaccatgttggcctggccacttttctactctttaattctcctgggtcaacaggtacttagttacccagggatggtaagggaactatagccagagagatcttcctgagatgcaaatctgctaagtctggtcccgactaataatttttcagtggtttcttgtggtctatcagatgaaggtcagactcctttgcatgacatacaaggccctttgtaatctggacccacctgccttctatgactttctgtcccatgcttgccttcttatgccctgagaagctcatggcagccccagaataatctgccatcctgattcctgcctccacatcttggtcacatcttggtccatactgtttcttatgcctcgaatgccttccttcccccagctatccatctgatgagtttgt

SEQ ID NO: 200917 - DNA, 1015 bp, Homo sapiens
gctaagccagtattaagaaaagcttgaaagctaccatatacaacagaaccctgaaaggtaagggaattaatagtgccaggtacctccagaaatgagagtgaaagtagggctaaaaacaggaagattggttgacaatcttaagatagagttagactctggtccctcccccactccatgctgcactccaggagatgtctggaggtttattctgcagaagggtaaaagaaatggtctctgaactgaaggacaccaggcacagttaaacatgggaataacttactgaaaagggcatttaagtaattgtttacacattgaatgttaagaatctatccatatcacttcattcaactcctggaacataaacattaaggcttattaccccatagacaagacgttgaaaaatccttatttgatcaatctgactagcctaagaggaaaaacagaagtattgacattggaggtgggaaatgctcacccacatcactctgcagtgaagcaaactccacccacttaaaagctcagtgtttccaatcagtgctttagttccttgctcttaaatatgagcatagatctaggatcacaggatacctcagggaaacctcttaatgtgaaaaatagaggtcaaaataaacagaaaaaaagagaaacttacaggaaacagactatataggaagataatttaaataaaatcatgactgtctttagagataagagtttatatttgccaggagtggtagcccatgcctgtaaatcccaacacattaggaggagaagtcaggaggattgcttgagctcaggagttctagaccatcctgggtaacaaggcaagacccagactctaccaaaaaaaaaaattagctgggcatggtggcatgtgcctgtggttccagctgctcaggaggctgaggcaggaggatcgcttgagcccaggaggtagaggctgcagggagctgtgttcgtgccactgcacttcagcctgggtgacagagcaagaccctgtctcaaaagaaaaaaa

SEQ ID NO: 200918 - DNA, 361 bp, Homo sapiens
tcagctctgcagagccttggagctgtctactcaagctggaatctctttgaaggggattttctagaggtagaatagtatttctgacagcctcacaaatatactcatcttttaatattttgccacctttaaaagttgttattcagaataatagatgattccatagcagcctgtagctcagaatattattatgtgttaatttggaaaaaaaatgtgactagtattcagcacttctttgaaccagggtatattacttattagctgtattgcttgatttttcacagactgttacatctccatttaaatcataaatctgaattatgctgtattactgtaaagcctaccagtgttccctagaatagca

SEQ ID NO: 200919 - DNA, 323 bp, Homo sapiens
ctttgacccacttcttcctcccagcatgtgagaaattatgataacacagactgcaagcacagaaagagatcaaaattcaaaatttggagtacagtttctaccgaatgagtattgctttcacaccattgtaaagtcaaaatatcataagttgaacccttgtaagttaggggtcatttttatgctattttaattatgattgcaatgaccaatcaggtctgtggagctgttttttcccaccacaaaatggcttaagagtgctgtattttgctatcttttcttattgatattagaataactttttgactgttgacacttaaatttaa

SEQ ID NO: 200920 - DNA, 787 bp, Homo sapiens
caaactttgttgttcttttctgtccctcatgtgatcccacagccaccaagatagaagagtgttctcgctgctgagctactttaatcccgtggtcagagtggcaagagcttaataaatacttttgtgcaataggatattttgattgtttgttttagggttatgtttgtttctctagttcttttgtacaacaaaatctttgactaagtctgaattgtgtttggtattggcccggcaatcaatgtgacgaattttgtcatgggtgacactcttatctattttagtccctgcagctaccactcagacctctttttccctagacacgagtgctggagagcagccatcctcaactcctctgttcccttctccctctctggggcagtggaataaaccccatttgtcagggctgtattggttgttctgattgcttattacgaggcctggtgttgtgcaaggctctctcatgactattattttatctggtcctcaaaacagcccgtttttacagccagcatgctttggaaagaggcgggaggggaagcaacaacccattttatggttaagaaaacacagaatcagagaaataaggtaacttcctcccaagtacacagctaggaagtaatagaacaaggacttaaatctacagttttttatttgtttgttttctttctaatatatcactccaaaggacatttggattaggaaatcagtttattccaggtgttatattcgttctgaacaagtcctctgtcaggaaatgaactgagcccatcttcctaaacatgtcctt

SEQ ID NO: 200921 - DNA, 220 bp, Homo sapiens
atttcaccatgttggccaggctggtgtggtctcgaactcctcacttcaagtgatccacctgccttggcctcacgaagtgttgggattacaggcgtgagccaccgcacctggccaggacaggcaaatttaatggtagacttaagccaagctgtgtggattcgagtctcagtgctgcaccttcctagctgtgcgactaggcaaatcccttagcctctctgtg

SEQ ID NO: 200922 - DNA, 473 bp, Homo sapiens
ttaagtcatcaaggatacactggtgactaagacaataaatgtgtagtcaaattcaagggtcctgcatcctagatgacattaagttcatttttcctactacctttttcatggattgagaacaggtaatatcttagatggtgggaaaatcatcattcgggaaacatttatatccttcacttttaattggtacagggtaaaaatttaaacatttttaaaatccctttgtctttaaaaataattggaaggctgttgctggactgacagaaacttgaggacagggacgttgctttatctttatagtcccagcattgagcccaatgcaatgcccattctaaatgttcaaaaatgaatgcaggccgggcatggtggctcgtgcctgtaatctgagcactttgggaggccgaggtgggtggatcacttgaggtcaggagttcgagaccagcctggccaacatggtgaaaccccgtctatat

SEQ ID NO: 200923 - DNA, 468 bp, Homo sapiens
tgtcagaggcgcgtgcgaggggctcggaggctgcggacccgggctgccccggtgcccctgacatccgcacgagcgggcgcctcccgggcaattcggcgctcggggagggctgattttcaacccctgagcgaaagcaaattcttttttaggaggtgtcttccctccgactccccatcctgcgcctcttctcttctccaccccctccagccatcagtcccccgacctctgggggtccccacctcttcgctccctcctccgccaggatttcttaggaggagaggagggggtatcggcgagaagctggggaagccgggcggcggggatgggggtggggacgagggctcagcgagctgtttactagaaagtcccggggtgatgtgttcgagccgccccggcctaggcctgggtgcattgtgttggcccgatccccgggctcccgcggcggcccgaggccaggtgcagtgacga

SEQ ID NO: 200924 - DNA, 477 bp, Homo sapiens
aaattttttaaaaataaaatcaagactcagtttagggcttttttctacaaatactggagtatatttttatacaaaacatgctttaaaatgatcacttctaaattaattgtcattttttatactaatttcttcacaaagcaagacctaattgtattgtgtacagcctttctaaatctcacacagagaagacttccaaacttgatgggggttgaagtcattctacactaaaatagactcaagtttcttcattgacttacatcaaaccattaaaaaaagaaatccaattctattctaggaagagttttcctagtgaagctatgttatactggcacctctcttcaaaagattcatgccatgagaatatgctgcaagactccttcatcaagatcagccaagattttgtgactctggacagaagtcatgagttctttctctggcacgtaaggcagaaggcagaagcaacagagaaggaatgct

SEQ ID NO: 200925 - DNA, 348 bp, Homo sapiens
acaagctctttctgcctgccgccatgcacgtaagatgtgacttgcccctccttgccttccgctatgattgtgaggcttccccagccatgtggaactgtaagtccagttaaacccctttattttgtaaattggccagtctcaggtatatctttatcagcagcgtggcaacagactaatacaggcatcaagctatgtgcagagttattaataacttagcatttttgtttttaattaagttattaataacttagcatttagtttcacaagaattagatgatgcttgtctctcaacctcaaacgggctgtttcatagaagtgttgtgatttggagtctgcaggatctttaat

SEQ ID NO: 200926 - DNA, 1882 bp, Homo sapiens
agcggggtgcggaggggcggacggcgttggtttgaagaccttcagcgttgccctggcggagcagagacaggccctcggggtggaggtctttggtttcataagagcctgagagagatttttctaagatatgtgtaacacaccaacgtactgtgacctaggaaaggctgctaaggatgtcttcaacaaaggatatggctttggcatggtcaagatagacctgaaaaccaagtcttgtagtggagtgatggaattttctacttctggtcatgcttacactgatacagggaaagcatcaggcaacctagaaaccaaatataaggtctgtaactatggacttaccttcacccagaaatggaacacagacaatactctagggacagaaatctcttgggagaataagttggctgaagggttgaaactgactcttgataccatatttgtaccgaacacaggaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgaacgatggcactgaatttggaggttctatctaccagaaggtgaatgagaagattgaaacatccattaaaccttgcttggacagctgggagtaacaacacccgttttggcattgctgctaagtacatgctggattgtagaacttctctctctggctaaagtaaataatgccagcctgattgggactgggttatactcagacccttcgaccaggagtcaaattgactttatcagctttaatcgatgggaagaacttcagtgcaggaggtcacaaggttggcttgggatttgaactggaagcttaatgtggtttgaggaaagcatcagatttgtccctggaagtgaagagaaatgaacccactatgttttggccttaaaattcttctgtgaaatttcaaaagtgtgaactttttattcttccaaagaattgtaatcctccccacactgaagtctaggggttgcgaatccctcctgagggagatgcttgaaggcatgcctggaagttgtcatgtttgtgccacgtttcagttcagttctgaagtgttattaaatgtgttcctcagcgacagtgtagcgtcatgttagaggagacgatctgacccaccagtttgtacatcacgtcctgcatgtcccacaccattttttcatgaccttgtaatatactggtctctgtgctatagtggaatctttggttttgcatcatagtaaaataaaataaacccatcacatttggaacataaaaaaaaaaaaaaaaaaaactcgaactagtctctctctctcaatggcgtcagttggtgagtgtccggccccagtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcgttgctgaatcctttcatatcctaataggaattaacctccaaataaaacatgactggtacgtg

SEQ ID NO: 200927 - DNA, 436 bp, Homo sapiens
cagtgagctgagatcacgccactgcactccagcctggggaacagagtgaaactctatctcaaaaaataaaaaaataaaaaaaccaagtttttattttaaaatagttttagatttatagaaaagttgcagagttagcgtatactccacacccagtttccctgttactgtaagaatagtaattatgctattgagacagttcttgctctgtcgcccacgctggagtgcagtggtgcaaccgtggctcactgcagctttgacctcttgggcttaaccagtcctcctgcctcggcttcccaaaacactggggttacaggcatcatctaccgcacccggactccctatggttaacatctacatagtatggaacatttattataattaatgaaacaatattgatacagtgttatcaaataaagctttgttctgatttctagtt

SEQ ID NO: 200928 - DNA, 1177 bp, Homo sapiens
tggtgaggctcaaaccatcattaagagagaatttattggtttattgatttatttaaactatatatatatggttgaggctgcagtgagccatgactgtgccactacactccatcttgagtgactgaacaagaccctggcatcaaggcattggacttttccactccagcagaatgggctttgcaggaaaaggaagaaggtatctggaagcaataggagacaaaagtaaagaaaaggcagatgtgatgggtgctgctttgggtttaacttgagacaccaaagataggtaggtctgaagccgagagaatttatttatttatttatttttcttttgagacagagtcttgctctgacgtccaggctagagtgcagtgacgctatctcggctcactataacctccaccttgcaggttcaagcgattctcctgcctcagcctcctgagtagctgggaccacaagcgcctgccaccatgcccggctagttttttgtatttttaaagtagagacagggtttcaccatgttggccaggctggtctcgaactcctgacctcaggtgatctgcctgccttggcctcccaaagtgctgggattacagacgtgagccaccgtccccggccaagaatgtattttaaaaaggtcgtcttacactgcaaggatgttcattaaacatcacaattaagcatgtcaagagagttttgctcctcttcctttttaaggtacacttctcaggttagcttggccctgacccactgcagtctctttgagctcttggccattattgtctgcatgcaccttttttgacaattatagtctactgccttgtgacgtttggtgttgtcttgtgtaacatttcttgtgtttttgacatattttctcaatggtactggcaactagaaagaactgaaatacaggcatcatccatttaacttccacaagccatccctaaaagcagacattctgcatgcaaactttcagagccttttactcctttatctcccctgatctcagccaaaggccaaaaggcaatactctgttatttcacatagaaaaatgatatgatagctactaaccacaaattcccaaccaatttcccaaaaaagttatttatttatttatttgaaggctagtcaagtgaagcagtgggcgtggaaaaggaacaaagaaatctaactgattgta

SEQ ID NO: 200929 - DNA, 407 bp, Homo sapiens
gcggctgcaggagcgcgcgcggccagcagagggcgcccgcgccacacctcgcggaggcctccccagaggggctggagtggaggcagagccacaaccgggaagcgcacttcagggaaccgcacttagggtccgatgggaaggagaatggagaccatcaggtcggaagacactccccccactaactgagaactgatgcctgaattctccttttccaccaatgagatcgaagaaacaagtttctggacaactagattctggctagggatgacgcacggggagggggtccaccagggctcctcacgtggcaacccgaaataatcgcccaggccagggtttccagaacaacgttcattttccgtaattttctcattttcaataaaggcataatctttaaatgtgaaattgaa

SEQ ID NO: 200930 - DNA, 615 bp, Homo sapiens
gccttggcctcccaaagtgctggaattacaggcatgagccaccgcacctggcctcattgtggggttttaatgtgtatttccatattgactaatgaggttgagcctcttttcatgtgctaattagatatttgtgtgtcttctgtttttgtgtcatctattcaagttttttgcttctgggggaaagttgcatgagacttccgcatgatggtgaccagtttgcagagtccctgatgactctacagacagaaatgatccaggaacatggcttttggggcctgatgtaccacctgcactatagctccaagaatcatgaactcaaagtataaaattgaggcaataaataaatctcaatggatttctaagatataaatggtatagaattggatgtacgtccagactaatagtcatacatgagcagttttatgggacatggttttgatttttatgatgatctggagaaggaattgtttctcacagaagcagtaagagcagtggtttggaacttggactctggaatcagatactgtattatatttctacctctgccatttactatgtcttctttgggtgacttcctaatacctttggacttcagttccctcatcaaaaatagga

SEQ ID NO: 200931 - DNA, 294 bp, Homo sapiens
gaaagaacaaatgagactactaagccaagtcgctctgaaagatgagtgagagaaaacttggcagatcatctggcgcaaaggtaggaagcaggtttaattctcttcttggtcaaatgccacaatagcgtgaactgggctcactatgactttttttttaatttttattttttgattgctccttcagaagaaaaactattaatagcaattacctataaagactggtctgaagagatcagcgaataggaagagacttttgttttgagacacagtctcgcactgtcacccaggctggag

SEQ ID NO: 200932 - DNA, 280 bp, Homo sapiens
gccttatgcgagggaggcaggagcttcagggtcagagcagagatcaacggaacatgattgctggctctgaaggtgaaagaaggggccgccacgagcgaagcaatgtggacctccttaaagaactgggaaaggcagggaaacagatgtcccttggagcctccagagagaaccaactcggtcagcacctcggcttcatcctcatgagacctgggtcagacttctgacctctaaaagtgtgagaaaatacatttgtcttgctttctttttttttttttttttt

SEQ ID NO: 200933 - DNA, 299 bp, Homo sapiens
agcaaggtgaagaggagcatcactgagtgacagaaaagctcagatgagaccctggagtgggtagctcctctctgcaacctggtcatcatgttaagtgtttagccctcagcagataggaggccctggagtgggtagttcctctctgcgggtggtcatcccaacatctgcagctgtcaacagagaggaggccctggaatggctagctcctctctgcagctgatcaccccgatgtctgtagctctcagcagagaggagttcctggagtgggtagttcctctttgcagcttgttgtcctggtg

SEQ ID NO: 200934 - DNA, 341 bp, Homo sapiens
caagtctaaaattcccactgggcaaaacagatgggtccagatggattcccacctacatcaataggctgtattacaggagagaaaacttgagcttagggaacttgaatctgctataatgatcagttagcatgtctaactgcttgttgtcataaacattttgcccatagtactggagggaggcactctatcttctaaggttgttcattatgcaaacatccctgtgtgaacaaagttctttgagaaggaatttggaggaaagagactttattccagtgaacagtttacagactgaggagatgtagccttaggcagccttcagtgtaaaatgaaggtgcgttcta

SEQ ID NO: 200935 - DNA, 1372 bp, Homo sapiens
agatgcttacagttcttcatatcctacttgaaaggaccttctatcttcagtcactgtattttgctaatttcttaaagaggaaataggtggtagtgagtggccgagtttcatttttcatttctgttctccaaagaacagaatggttcatgtaggaatcctttgcagcttcagtctgcaccaagaaaggccaagaggaaagaatagcgagtggcttttctcactctcagcctcaagactgaatttaaacacacttagctttgtgagggcaggacttggtcttcacatagtggaaagtgtgcacttggctactttttcctggggcaagggctctgctttcctgccactgtgagctgtggggtcagactgcatccttaagccagacattccactctcgctcccctggaagacttttaggcgaggttcatcctggaactgttgactcagaacaggtagagctggaggaagaacaagcggccaccctgctcccatgagccctcttccttggtggataggttgtggttctcctgtttgatggggaggccgctgcatctgactctccaactcagtgaaaagaatcacagcacagaccagcctcaattctttctgcaccactgctctgtcgagttgattcagtacctgtagtcccacatagttaaaatctgcttagctttgctctctgttgtgtggacaatgaaatggttgactaatataaccctggcagtgtcagaccttgtcatgactgaaatttgtccaaatagatattgtcatcaaatgtgcttctggtccttgctagtgagactgtagttaggatccctgtccaggtctcaaagggcacgagaaactatgaagaggcttggcatccctgttcagagtacagcctcatctgccaaattcttggggtcactagaactgtttgggtccctgctggaagctcttaacacccctgagcaactcacgttggaactgatgaaaataggtctcctaagacctccatctactgctaagtccattctggagtccaggtgctactaggagtcttttgcccctgggactgagatgtttttctgacttgaatgagggagtgaatggatgactgcccatgccgctgtcactgtaataaaggactaagaagacaagatttaagaggaagagataaccgtaggacttacaggtttctttgttttgtttttttaacttgtgatctagtactaagaactaaacgttaaatagaatagcatttatgaacagtatctggaaaggagccttcattaatgatctcaataagaataaatgaaagtaagttatttttctgccccccaaaatccctaaaacatgaatttgtcttccacacattagtgccagaaaagggaat

SEQ ID NO: 200936 - DNA, 391 bp, Homo sapiens
cagaacaggaaatagaagctgtggaagactcgaaatacacctttgtacttctctgttcttcacctgctctctcactgtctctacacacacacacacacaaacacacacacacctatatttgcattaaaaatgggtagtaaaagcagtgaagggcaaacagaaggtacaatacaatcaagtaagaggttgaatataaactggaacaagtcttaattttttatttcactttcattcggatacgtttactaattttctttgctagctttaagacttttaaaacattctttggccctgggagggagttgtataaccataaaacttgagaatcctggccctagaataaatgttccttttaaaaccccaaggacagaaaattgaatacagctgtgca

SEQ ID NO: 200937 - DNA, 692 bp, Homo sapiens
atgtcagaattctaactacatctctacagactagcctaacaagtgggtcaagtgctaatagttttaagggtgtttcgggtttttgttttaaaagttaattatctgtaaagacaaatcaatggagacagatagtagattagtggctgcctggggtgtgaacagattaactgtgaattgacaggagggatcttactgaagtgccaaaaattttctaaaattggattatggtgatgatttcacaaattacttttttttttttttttttgagacgaagcctcactctgaggcccaggcaggagtgcagttgtgtgatctcagctcactgcagactccgcctcccgagttttcaagcaatcctcacacctcagcctcccaagtagctaagattactaaaggcacatgccatcaagactggttaatttttgtatttttagtagagacagaatttcgcagtgttggccaggctggtctcaaactcctgacctcaggtgatctgcaagcctcggcctcccaaagtgctgggattacaggctagagccaccgcgcccagccacaggtttctttgaaaagggccaaactgaatgaattttaatactctgcccttataaggcatctccttctgtattttttcctacatagactaaagtattctgtgcttatttatagcttgcagccccaaaaaacatgaagcc

SEQ ID NO: 200938 - DNA, 2583 bp, Homo sapiens
gtctcccaggtccatgtctcagccatgctccccacggaggtcccccaatcccacccgggcccctcagcgttgcttctgctgcagctgttgctgccccccacatctgccttcttccccaacatctggagcctgctggctgcccctggctccatcacccaccaagacctaactgaggaggcagcgctcaacgtcaccctgcagctcttcctggagcagccacccccaggccgcccccctcttcgtcttgaggacttcctgggtcgaacactccttgctgatgacctctttgccgcctactttggacctggttcttctcggcggttccgagcagccttaggtgaggtgtctcgtgccaatgcagcccaggacttcctgccaacttccaggaatgaccccgacctgcactttgatgctgagcgactgggtcagggacgcgcgcgcctggtaggggctctgcgggagaccgtggtggcagccagggcccttgaccacaccctggctcgccagcgcctcggggctgcacttcatgccctgcaggatttctacagtcatagcaactgggtggagctgggcgagcagcagccacaccctcacctcctctggccaaggcaggagctccagaacctggcacaagtggccgatcctacctgctccgattgcgaggagttgagctgccccaggaattggctgggcttcacactcctcacctctggctactttggaactcatcccccgaaacctccagggaaatgtagccacgggggccattttgaccggagcagctcccagccaccgaggggaggcatcaacaaggacagcacatccccaggcttctcccctcaccacatgctgcacctccaggctgcaaaactggcccttctagcctccatccaggccttcagccttctgcgaagccgcctgggagacagggatttctccaggctgctggacatcaccccagcctccagcctgagctttgtcctggacaccacgggcagcatgggtgaggagatcaacgctgccaaaatccaggctcgccaccttgtggagcagcggagaggcagccccatggagcctgtccactatgtcctggtgccttttcatgacccagggttcggccctgtctttacaaccagtgaccctgacagcttctggcaacagcttaatgagatccatgccttggggggtggagacgagcctgagatgtgcctgtcagccctgcagctggccctgctgcacacacctccactctcagatatctttgtcttcacggatgcctcccccaaggatgcctttctcaccaaccaggtggaatccctgactcaggagcggcgctgccgggtaacattcctggtgactgaagatacatcaagggttcagggtcgagctcggcgtgagatcttgtcccctctgcgttttgagccatacaaagcagtggccctggcctcaggaggagaggtgatcttcaccaaagaccagcacattcgagacgtggcagccattgttggggagagcatggctgccctggtgactcttcccctggaccctcctgttgtggtgcctgggcagccacttgtgttcagcgtggatgggctgctccagaagatcacagtccggatccacggagacatcagcagcttctggatcaagaaccctgcaggggtctcccagggccaggaggaaggcgggggtcctctaggtcacactcgccgctttgggcagttctggatggtgaccatggatgaccctccacagacaggaacctgggagatccaggtcacagctgaggacacccctggggtgagagtgcaagcccagacctccctggacttcctcttccactttgggatccccatggaggatggaccccaccctggcctctaccccctgactcagccagttgcaggtcttcagacccagctgctggtagaagtgacagggttgggttccagagccaatcctggggatcctcagccgcatttctcccacgtcatccttcgaggggtcccagagggtgccgaactaggccaggtgcccttggagcccgtgggacctccggagcgaggtctcctcgcagcctcgctgtcgcccacgctgctgtccacccctagacccttctccctggagctgattggccaggacgcagcggggcggcgcctgcacagggctgcccctcagcctagcactgtagtccctgtccttctggagcttagtggcccctcgggtttcttggccccgggcagcaaagtcccgctcagtctccgcatcgccagcttctcgggccctcaggatcttgaccttaggactttcgtcaaccccagcttctccctcacctccaacctctccagggctcacctggaactgaatgagtcggcctggggccgcctgtggctggaggtcccagattcagcggccccggattccgtggtgatggtgactgtgactgcagggggacgagaagccaacccagtacccccgactcatgctttcctccggctcctggtatcggccccagccccgcaggtgaggaactactactttccatcacagggaccggcacaccacccctaccggctcatctga

SEQ ID NO: 200939 - DNA, 544 bp, Homo sapiens
gtctcccaggtccatgtctcagccatgctccccacggaggtcccccaatcccacccgggcccctcagcgttgcttctgctgcagctgttgctgccccccacatctgccttcttccccaacatctggagcctgctggctgcccctggctccatcacccaccaagacctaactgaggaggcagcgctcaacgtcaccctgcagctcttcctggagcagccacccccaggccgcccccctcttcgtcttgaggacttcctgacttgtacaagatatggttacatcagacataaccatattataaactggatgttcggctcttgggacacatcgctggtggtgcatacaaaatatgactacttgaggaccaacaattctgcagccaagctacaaaaaagagaaaagtttaaatgagttaagaaggaaaagaccaccagtcttacaaaattacattttgtaacattcaccaattctttaccaaagttgatgaccactgtagagaaatcagcaaatcattacaagaaaaaaataaagaccgatcggccag

SEQ ID NO: 200940 - DNA, 1675 bp, Homo sapiens
gtctcccaggtccatgtctcagccatgctccccacggaggtcccccaatcccacccgggcccctcagcgttgcttctgctgcagctgttgctgccccccacatctgccttcttccccaacatctggagcctgctggctgcccctggctccatcacccaccaagacctaactgaggaggcagcgctcaacgtcaccctgcagctcttcctggagcagccacccccaggccgcccccctcttcgtcttgaggacttcctgggtcgaacactccttgctgatgacctctttgccgcctactttggacctggttcttctcggcggttccgagcagccttaggtgaggtgtctcgtgccaatgcagcccaggacttcctgccaacttccaggaatgaccccgacctgcactttgatgctgagcgactgggtcagggacgcgcgcgcctggtaggggctctgcgggagaccgtggtggcagccagggcccttgaccacaccctggctcgccagcgcctcggggctgcacttcatgccctgcaggatttctacagtcatagcaactgggtggagctgggcgagcagcagccacaccctcacctcctctggccaaggcaggagctccagaacctggcacaagtggccgatcctacctgctccgattgcgaggagttgagctgccccaggaattggctgggcttcacactcctcacctctggctactttggaactcatcccccgaaacctccagggaaatgtagccacgggggccattttgaccggagcagctcccagccaccgaggggaggcatcaacaaggacagcacatccccaggcttctcccctcaccacatgctgcacctccaggctgcaaaactggcccttctagcctccatccaggccttcagccttctgcgaagccgcctgggagacagggatttctccaggctgctggacatcaccccagcctccagcctgagctttgtcctggacaccacgggcagcatgggtgaggagatcaacgctgccaaaatccaggctcgccaccttgtggagcagcggagaggcagccccatggagcctgtccactatgtcctggtgccttttcatgacccagagacggagtttcaccgtgttaaccaggatggtctccatctcctgacctcgtgatccgcccgcctcggcctcccaaagtgctgggattacaggtgtgagccaccgtgcccggccgccattttcaattctctccatttcctatagacagagattggtatcaagatggggttgttggggccaggcttctgggaagcatctgagataactagctacattgtattccttttccattgattagaagttagactctctggcttgagtctgactgtgtgtctttaggctggtcatgtaaactttctttgcctcgatttcatcatctgtaaaatgggtatcagttatcacatcagggtggggcaggatgttggaatgtcatcagttaaggctattttcacttcttttgtggatcttcagttgcttcaggccatctggatgtataagtgccagtcacaggggatatgattggttagcttgggctcagaggcctgacacctccctcatcctgcctaactcccagagttgaaatgatgatcaaataaaatgcctactggactgagagttgcctaaa

SEQ ID NO: 200941 - DNA, 2661 bp, Homo sapiens
gtctcccaggtccatgtctcagccatgctccccacggaggtcccccaatcccacccgggcccctcagcgttgcttctgctgcagctgttgctgccccccacatctgccttcttccccaacatctggagcctgctggctgcccctggctccatcacccaccaagacctaactgaggaggcagcgctcaacgtcaccctgcagctcttcctggagcagccacccccaggccgcccccctcttcgtcttgaggacttcctgggtcgaacactccttgctgatgacctctttgccgcctactttggacctggttcttctcggcggttccgagcagccttaggtgaggtgtctcgtgccaatgcagcccaggacttcctgccaacttccaggaatgaccccgacctgcactttgatgctgagcgactgggtcagggacgcgcgcgcctggtaggggctctgcgggagaccgtggtggcagccagggcccttgaccacaccctggctcgccagcgcctcggggctgcacttcatgccctgcaggatttctacagtcatagcaactgggtggagctgggcgagcagcagccacaccctcacctcctctggccaaggcaggagctccagaacctggcacaagtggccgatcctacctgctccgattgcgaggagttgagctgccccaggaattggctgggcttcacactcctcacctctggctactttggaactcatcccccgaaacctccagggaaatgtagccacgggggccattttgaccggagcagctcccagccaccgaggggaggcatcaacaaggacagcacatccccaggcttctcccctcaccacatgctgcacctccaggctgcaaaactggcccttctagcctccatccaggccttcagccttctgcgaagccgcctgggagacagggatttctccaggctgctggacatcaccccagcctccagcctgagctttgtcctggacaccacgggcagcatgggtgaggagatcaacgctgccaaaatccaggctcgccaccttgtggagcagcggagaggcagccccatggagcctgtccactatgtcctggtgccttttcatgacccagggttcggccctgtctttacaaccagtgaccctgacagcttctggcaacagcttaatgagatccatgccttggggggtggagacgagcctgagatgtgcctgtcagccctgcagctggccctgctgcacacacctccactctcagatatctttgtcttcacggatgcctcccccaaggatgcctttctcaccaaccaggtggaatccctgactcaggagcggcgctgccgggtaacattcctggtgactgaagatacatcaagggttcagggtcgagctcggcgtgagatcttgtcccctctgcgttttgagccatacaaagcagtggccctggcctcaggaggagaggtgatcttcaccaaagaccagcacattcgagacgtggcagccattgttggggagagcatggctgccctggtgactcttcccctggaccctcctgttgtggtgcctgggcagccacttgtgttcagcgtggatgggctgctccagaagatcacagtccggatccacggagacatcagcagcttctggatcaagaaccctgcaggggtctcccagggccaggaggaaggcgggggtcctctaggtcacactcgccgctttgggcagttctggatggtgaccatggatgaccctccacagacaggaacctgggagatccaggtcacagctgaggacacccctggggtgagagtgcaagcccagacctccctggacttcctcttccactttgggatccccatggaggatggaccccaccctggcctctaccccctgactcagccagttgcaggtcttcagacccagctgctggtagaagtgacagggttgggttccagagccaatcctggggatcctcagccgcatttctcccacgtcatccttcgaggggtcccagagggtgccgaactaggccaggtgcccttggagcccgtgggacctccggagcgaggtctcctcgcagcctcgctgtcgcccacgctgctgtccacccctagacccttctccctggagctgattggccaggacgcagcggggcggcgcctgcacagggctgcccctcagcctagcactgtagtccctgtccttctggaggtgagacgccaggggaaagtgcggctggggctggagagagttagagcggccccttccctgaagaacccttctctgcagcttagtggcccctcgggtttcttggccccgggcagcaaagtcccgctcagtctccgcatcgccagcttctcgggccctcaggatcttgaccttaggactttcgtcaaccccagcttctccctcacctccaacctctccagggctcacctggaactgaatgagtcggcctggggccgcctgtggctggaggtcccagattcagcggccccggattccgtggtgatggtgactgtgactgcagggggacgagaagccaacccagtacccccgactcatgctttcctccggctcctggtatcggccccagccccgcaggtgaggaactactactttccatcacagggaccggcacaccacccctaccggctcatctga

SEQ ID NO: 200942 - DNA, 441 bp, Homo sapiens
caatagacgggaaaactagttgggcagaagttggcaaacaatgtagcacattgctaaaacagatgtacaagtacactttgtatgttttcagttgtgtgatttgaggaggccctttgggttgccatccatctaagtaccagtaaggtgagatcaccagggtaaccaataaatgcaattgtattttcatagtttgttgaatttgcatcttagatgagttccacagctgactagtaattcattttaagtatttttttaattagaccaaagttagttgtaatagtaggcttcttgctttagaaattactttattttatgcaataggtatataattttccatgcaatagatacatacatttgggtgccatggcattctatttgataagaagaaaaatacgtgcaacgactagggaatggtaaaaagaagttgaagccataataagc

SEQ ID NO: 200943 - DNA, 473 bp, Homo sapiens
tggccttgtcattataatagtacctacctctaatgagttttgaggattagatgaatcagtacctgaaaaatgcctgacacacagtgagtgctcaataaatgttaactactgtaattattacattacagaggttgtgggggggccttttctgagtcctccaaaaggatgactttattagggccacattaagactgtggaaacagaagagtattcaacagataaatgaagtctatgagttgggggtacaatttatggagttttagattaaaactgcatccaataagttggtctgacacatctttcaaacctatagaggaataatcacaagtgactagtattcctttgggtccaatagaggtctctgatcttcatacagattgaatgtacccagaaccgtaacctagcattttacttatatagcaaccttaactctgacacaaaagtgtttcttttgttttgaggccaagtctcac

SEQ ID NO: 200944 - DNA, 264 bp, Homo sapiens
aactctaaacgctttaagcttctgggaaatatctttcagctgtcagcctctgctctaccagggtcctggttccagatgtgggtaggcagctgctgcagctcatgaacagctctgacttaattctctatttattcacacttttcttcctgattcttgtaacattcttttcttccttgcttagcagacacacgtggcttgaagttgtcactctccatcgtaaaggagctagagaaaaagctgcactgttgcctggggttccatagc

SEQ ID NO: 200945 - DNA, 470 bp, Homo sapiens
gaagaaattgatggttagacatgttcagaatcagatcatgaggacactaattcttccggaaatcccttaacactaaattgatgtttcgatgggttaaatgctttggctgagatcacatagccaaggtagaaccaaagccctccaaatcaatgctgccctcctgaaacacagatctcataatacacccattgtgcatctcctcagcttaaaaaggaggaccgctgatgtgcatcacggaagatttccatcacatcatggtgactggagatttatatagtgcttgcagtatactttggttacttttacgttgagatctgctaccatggaatacagtccagataaccacagtgccaaagtaggttaaagagggtctggaattgccgcttgaactagtgaggcagaaaagttgggaatctggagtgcatggtagaaggaagaccacttcaacagaagaggagaacaattgctgt

SEQ ID NO: 200946 - DNA, 306 bp, Homo sapiens
tatgaggatccctcatcgaaacctattgtgaagcagaattcaccaagcgttggattgtcacccactaataggagggtttgatgacagggtttcgatcatcaaacccttaggaaagaagacagtagggagggggaagagaaggaacaggagagaattagcaccccatagggtttcgatgaggtcatcgaaacccttttgtagtcaatcacctgctactgctgtagttaacaattgtttatattaatttttctattttggaataaccagtgtggtttgtgtctcctgactgatagatagggtttgtct

SEQ ID NO: 200947 - DNA, 425 bp, Homo sapiens
ggaaggaaggaaggaaggaaggaaggaattagacagagattcacttttccactgttcctccaatgtctctgcccaccctttcttcttatattaattcataaagtatcatctctcctcacttctgctcacttcatcaagccccattccacaaggtgaccagtgttggctttagctttggatggctccttttggctcactgcttgattcaagcatcatcccagatctctgcatagctgtatcttcctatccctcaagttgaagcattatcgaaaggtccatattgcttgatctgagcatactgcaaagtgtcctaaaagccatatgggagatagacttcttcgcagctgcaaaggaaacatttgcagaacagaaaacaccagaaatcacaatacattcttagtcatagtaaaatggaacgcacgcga

SEQ ID NO: 200948 - DNA, 233 bp, Homo sapiens
tgcagtttatgtgtttagatcaatattccagtaaggtccatatgttaaaattggtctctgctagtctataacattttcttcttcgtttttattttatttttttccttcgtatttatctatggaaggaactgggtcgttggtactatagaattgtctgcattctagatttggctgattatgtccccttgatgttactgaacatgttttttctattccttgtatttcctataaac

SEQ ID NO: 200949 - DNA, 463 bp, Homo sapiens
cacaccgctgcactccagcctgggcgacagagcaagactatatctcaaaaaataaataaacaaataaatacatctggtgcaggtaaagtgttcaggaagtaatttcctggaagagggaactctgcagttgcaaatgcggccttcttacaagtcgcttgtagggtgttgaaactctctcgcgatcccagtgacttgagatgctctgttttctggataactaagcttttccaccttcactacggggtaccagggtctttgtagcagagaggcagctgtcttgatggtggaaccactcccgccagtgtgtggtggggtgcccccggggatttagggagagagaaggccagtggcagggactggctggaggaagagggtgcgaggaaaaacactggctgacatttgaaggaacgtgcttcagtatcagggaaggccagcgtgggataatcggtgtcttggcagatgg

SEQ ID NO: 200950 - DNA, 521 bp, Homo sapiens
ttgttgaattgtttgctttgtctctggtgcttatatcccagctttttttaaattcctttttccttttgtcttctttttttgtttaaatttaagattactctggaacagaggttcctaaacgtattttacactcattagtatggctataataaaaaagatggacaataccaagtgtttgggaagatgtgaagaaattgaaaccttcttgaattgctagtagagatgtaaaatagtaaagctacttaggaaaaactgcttggcagttgctcagaaatgtaaagagagttctcatgtggcctagccattccattcctacctatatacctagaagaactgaatacatatatttgtgcataaacttatatatgaaagttcacagcagtattgttcataaataaaacaactcgtatctccttaaactgatgattggataagcaaaatgtgttatatccaaacaatgtaatattgtttagctgtgaaaaataatgaattaataatacatgctaagacaaagggaaaca

SEQ ID NO: 200951 - DNA, 623 bp, Homo sapiens
aagttgggttgatcacttgagctcaggagttcaagaccggccgggggcaccatggatgaaatcccatctctactaaaaatacaaaaagtagccgggcgtggtttggtgtgcacctgtagtctcagctactcgagaggctgaggcactaaaattgcttgagctcgggaggtggaggttgcagtgagtggagattgcaccattgcactccagcctgggccatgaagctagactttgtctcataaaaaacaaaaaaataatggacccccaaagaaggaaactggagttagggtgaccgggacttaaaatttttcaaggtttaccaaagacccatggtttagaaaagctggagttgggtcgggggccccacacggggagtagtctctggcgttgctgggccatgaggactagtggtccttggctctatttggcctcggagtgcccccgatgggggtgtgcctttcgtgtgggcagtaaaattagggctgccatgatcttctgaatgctcagattcctccctcttattctgactgtggggtgggctccatctccctttttttgctccccctctccctgaagcttgcttaattccatggctctcagttgggtctattcccagagctgtc

SEQ ID NO: 200952 - DNA, 739 bp, Homo sapiens
ttcctgcgtgtgtcacacagtgagggccttggagcctacatatgtaaagagtgccaacaaatcaataagaaaaaaaaagccgggtgcagtggctgacatctgtaatcccagcactttgggagaccgaggtgggtggatcacttgaggtcaggagttcgagatcagcctgggcaacatggtgaaactccatctctactaaaaatacaacaaattagccgggcgtggcagcgcacccctgtagtcccagctacttgggaggctgaggcaggagaatcacatgaactgggagatggaggttgcagtgacccgagataacgccactgcactccagcctgggcaacaatagcaaaactccatctcaaaaaataaaaaataataaagtaaactggctgggcaccgtggctcatgcctataatcccagcactttgggaggctgaaatgggaggattgcttgagcccaggaatttgagatcagcctgagcaacacagtgagatgccatctctacaaaagttagctgggcgtggtgacacgctcctgtagccccagctactcgggaggctgagatgggaggatcacttgagcccaggaagtcgaggctgcagtgagccatgattgcaccactgcattccagcctgggtgacagagcaagacctggtctcaaaaacaaggtaaaaaaaaacaaagtggagtatggacaaatacacttattcaacaaataaatattgagcacctactgtg

SEQ ID NO: 200953 - DNA, 223 bp, Homo sapiens
tatctttcccaaccaaattaataattcttaattatctaattgatggtctgtgttcagttttttccagattatttaaatatactattttaccctgttaaaaaaaaatcagatccaaataaggttcacacatggcagaccagaatgagattatttagacattagtattccctaaagttaactgaactatactgcaaaggagtcttaattcttacgttacaccctt

SEQ ID NO: 200954 - DNA, 590 bp, Homo sapiens
atgttgtgttgttttaaattgcagaatgagtatttagaaatcaagatttggatgccaggtgtattcgtgctgttgagctgttagctgcatccaggtcctcatagttagcagacctatgcacatatatacacacacatttatgtctatatttatttttgtatttatctatatatattgaaaactgtttataccaatacctccaattttagtgtaacaccataggtctcatgctaattttctatcttttcatatttataactgccttttctgacgcaaggaaacctgctgtcagtatccttcatgtatttatttattggaccagaatgccctgtatataagcaatctcctgtcatcattgctgccctagttggacgcccttctcacgctgctcaggctccagaagatcccatttagtccactgacagcacaaaaccttatgccagactgcagctactgcctcatagatgctatctgtctcacttgggttccaaccacacacaggctgccgccacggctttgtccatgtagacaccctcgtcaccatgctgaggctccagcaccctttgccaggctattgcctcccttccact

SEQ ID NO: 200955 - DNA, 216 bp, Homo sapiens
tatatacaggcattctggtccaataaataaatacatgaaggatactgacagcacaaaaccttatgccagactgcagctactgcctcatagatgctatctgtctcacttgggttccaaccacacacaggctgccgccacggctttgtccatgtagacaccctcgtcaccatgctgaggctccagcaccctttgccaggctattgcctcccttccact

SEQ ID NO: 200956 - DNA, 594 bp, Homo sapiens
agaaacagacatctggaaagactaattaaagcctacctggttttgacaatatattacttatctctggttgcgtaacaaattaccccaaagtatagaggcctaaaacatttattatctcactgtttctttgggtcaggaatctgggtgtggcttagctgaaccctatgcgcagggctgcaattgagggttggatgtgctcatatgaagaggttagggctgggcagacatcccaaatggctttgatcacagccacaaaccaaatataaaaatgtctaaggccgggcacggtggctcacgcctgtaatcccagcaccccgggagcccaagggaggcagatcgcgaggtcaggagttcaagaccagcctgaccaacatggcgaaaccccatctccactaaaaatacaaagattagccgggcgtggtggcgcacgcatgcaatcccagccattcgggaggctgaggcaggagaattgcccgaacccggaggcagaggttgcagtgagtcaagattgcgccactacactccagcctgggtgacagagcgagactccatcacataaaaaacaaacaaacaaacaaaaaaacaaaaaacgtc

SEQ ID NO: 200957 - DNA, 423 bp, Homo sapiens
aacataaaatattttaaaatgtgtggaagttaaacagagcatgtcttctttttaaggggactcttcttttctccagcatttcatgtgttacaacattggcttggcaattgtcatgccatagaaacaaaagtactaattttcacacttaataaataaatggagggcccaggctttatggaatggatccatagataccctgagagttgaaagagtgttccaaaaaaggtttaatcaaacaccccctgcgtgcaaacacgcatctagaaaacaggcccaggcatggtagctcacacctgtaatcacggccctttgagattacctctcctggcattcccctctcccgcctccaactcctccatttcccctgtccaaaatcttgatcatcctttaagacacatacaaatctatcaagaaatggacagg

SEQ ID NO: 200958 - DNA, 702 bp, Homo sapiens
  misc_feature (252)..(252): n is a, c, g, or t
gcgcttgcaattatttataaatgctgctgaacaggtttacatgcagaactatgcataaaatataaatagggtagtagggccatttgagatcagagttgtttagcatgactaaacactctgctttaaatgtcaagagtcctatgggaaaagtagaggtattgtgactaatattggagtaaggccatgggtggaataggttaaacatatacatcttatatgctgaaaatctgcctcttaaacctctggttcccncatgtcacttgctgagcctgaccagagaggtatatttcttcagtcttatatctcttctctatacttttctgaaagttacatggcctctttaattcccatattacttttttgtgtgtctttcttaagataatttcattttcacttttattgtaataatttatgcacatttctttaataccttttttgtgaactctcttgaaggcattgaaagtacttaatcatttttatataccatataacacatatagttttcctttgcatagagttgttttttaaaaaattcagtgaaatgggggatgtattcataagacctggaagagatgtaattgagaatatttaggaactccttggacatgcatcagagttgattctaaaatcaatttaaacacctcattgtgaggaaaagtatgcactgatcactgtagtcattaatagagtttaggtggagtc

SEQ ID NO: 200959 - DNA, 614 bp, Homo sapiens
cctgtgtgatattttgcttgtttcttcaatgtctgtctctccatagatcacaagcaccacaggaggcaaaaccacgtctctctgtggctttgcggctgtgcgggcactgacctgggacacaagtgtccttgcagggcagaggctgatatttaccactggggcagtgcttgctctgctcaaggtatggttctgagcttaaatgttatagtgactctcagttaatgcacaagacctcgatggcggcaggactgaaacaatattcatttcagaggctcagacaacttaggtaacttgctagaagtcacacgggttactagtcaggattcacattcagcacatcctaacttcacagtctggggttgttaccactacgccctgctggtattttatcctgcagcctgaaattggtagattttgtgaacttctacaagccttcttgagataagcaaaaaatacattaaatagtgactcaaagcttcagtaagcctatgtgtgtgcataatatacacacatataaacatatcagaatttttctttcctcagaatgaacatacaatgtggacagaaagaccttatcatcctcatttttcccctgaggttacgaaggtgaagtg

SEQ ID NO: 200960 - DNA, 847 bp, Homo sapiens
gagtgtggttgagggggagtgtggttggtggggggagtgtggttggtgggaagagtgtggttggtgggggagtgtggttgttgctgtgtgccatcggaaggctatgcaagtttgagcgcttgcttcaccttgacaaacatttcacttgttagagccctggctttctcatctgtgctctgagctagtcattcctgccaagcttccctgcaggtttaagtgcagatgcagtcatgactgtgaaagcaccctgtgaactgtaaagtctgggcagttgggtggtggtaggagaggcagcaactgtgagaggatgaacttgattctgctgatctcggacggaaactgattcttgggagagagacagaatcaaacggctctgacatttgaaaagccatggcctcgcttacctacagtgagacttgagaagaagtgctggggaggtaaaggctgagataccacctccgctgcctgaaagactttgcaagatactccagctggggataggagatggctagaatgacctccaactatcttcacacccgaggctggggctgcccttccaggcctgcagttctgtattttcccttagaaggttctggaggcagacggaacctcagaagcaaacggtttattttttaggtttttcagtttatttttaaatttctgactgtgatggtgtttattttttccttttccctttccccacttccccggctcagcatcagaaagggaccatctgtccgttgccttgctgtggccattttagaaccagcgcaaggctgcttgaatctggtcccctcttctccctcactccctcccccaccacctggctttctctactctgcactgc

SEQ ID NO: 200961 - DNA, 471 bp, Homo sapiens
ggtcagggctgcagtaagccttgatcgcaccactgcactccagcctggctgacagagtgagatgctgtctccaaaaaaaaggaacaaacttctgatgtatgcatcaatatggatgaatctcctatatgtgaaagaagctagattcaagtggctacatgttatatgattctacttatataatgttctggaaaatgcaaaactatggggatagaaaacagacaaatagttgccagaaattggtagtggtaggtagatcgacttgacaggggaacaagggaattttcttgggggcgataggactattttctgtgtcttcattgtgacagtagttataaaactgtatgcatttgtcaaaacccacacctgtacactaaaatggtacatttttctttatgtaaattaaacctcaaaaagactggatttaaaaaatcaaaataaaattacttctaaattaaaaagtaatcccatttt

SEQ ID NO: 200962 - DNA, 533 bp, Homo sapiens
atttgacaaagatattaatattatgtatcttctaaaatatagcatttattagaatatcattactccagatgaactgttagtgtaataaaggactttaaagattattagctatgttccataagaactaatctaaacctttgaagtaaaatgtctcaaagttgtttgtttgtttatgtatttatttatttttgagacacagtctcactctatcaccctggctggagtgcagtggtgtgatctcgggtcactgcaacctctgcctcctgggttcaagcgattctcctgcctccaccttgtgagtaacttggattacaggcatgtgccaccatgcctggctaatttttgtgtttttagtggagacagggtttcaccatgttgggccaggctggtctcgagctcctgacctcaagtgatccacttgcctcggcttccccaagtgctgggattacaggcatgagtcaaagttgtttttaacagagttttcaaagacagtttcataattactgaagaacaaaattttattccatgaaatg

SEQ ID NO: 200963 - DNA, 377 bp, Homo sapiens
tgaaggtttaattaagagtgttagaaatggcaggtaactactaaccaagtagtaaaacatagtattcccaaaataacagggatcaaggatgatagtgagcacagaggtaagcaggccaggaaggaataaagagaagtaatatcaaattagcaaaagcgaggagaggaaaaagatgaaatgagttaacaaatagtaaacaaaatcaagtggaaacagtaaagccaaatgagcagccccacagtaaatactcatcagctaaactcacctattaaaaaacaaaggtccagaatattagtgtcagagcaagatgcaagaacaaaagcattgaacaggactaagaggtactatatattggtagaaaccaaaaatataaagta

SEQ ID NO: 200964 - DNA, 263 bp, Homo sapiens
aacaagagtgagactccatcttaaaaaaaaagaaagaaaaaaagaaaaagaaaaagaaactgacctcagtgatagattagcctctctttatagcacagaacccctgagagcgtaagccctgttgtgaactgcgtatttgaggaatctagcttgtacgccccttatgagaatctaatacttgatgttccaaggtggaacactttcatcctgaaactatccctccccacccccatctgtggaaaaattgtcttccatgaaaccgg

SEQ ID NO: 200965 - DNA, 520 bp, Homo sapiens
caggacgtgtaatcagcagcaggtgattgtgtagtgtgtctaaacacagttgagtaagatgtgccccaccagttatgatgggaatcaatttaaatagactttcttgatcccagaagttcaactacgtggacagtggtaacacttgacaggatgatttgttatagcacaacttatatattttaaatggacaaaaaattagtatcatttacagtatcttaagataaatttcctttgaatgggagcttcctttccagtactttgaggtctacaagacgtatctagaaaatttactactgtggaaaatgaagactgattaaatcgaatggaggggaaggggaagggcctgtgttttttttttttgattagttgctgtaacactgtccttcgggcggctgagggagtttcatattttctttagacatcgttaggcgccgaagctcttgcaggacaactttgatgctatatgaattctgccattttgctagcactgatatgctcttgggtccaccactccattaga

SEQ ID NO: 200966 - DNA, 522 bp, Homo sapiens
tatatatatatatatatatatatatatatatatatgcacccattggtgttacattggtattgaaacacttttattttctattatactagttacgtgactcctcttatctgagtcaattaatgtattgaaggatttatatgaaattctatctttgagagtagtaatttataccatagttttctttagtagctttagcagattatgcaagagacaagtcagttgcagttataaatttctacctgggaaaatagacctaggagacatggctgttgataaaggagatgctggcagatcactgggttgtttgtttctaaatccagtggatttttctatattttgatgtcatatataattcattcatatatagagattgaatgaaaggtctcctcctaaaagtatttcttaataaagaaaagtttaaacgggccggacgcggtggctcatgcctgtaatcccagcactttgggaggccgaggcgggcggatcacgaggtcaggagatcgggaccatgctggctaaaat

SEQ ID NO: 200967 - DNA, 575 bp, Homo sapiens
agtcgaaacatttatgtacatgtggggatcagtataatattgcccagtttttattttgctaagtcactgctctgtcaccgttttttgttacctctttcattaaagaaagaacattttaacatgaaaaaagcaggaaagacataacatcacaacaaagaacagccacttaaaattagtttcgttttatgaaaaccccgcttacattgtccttatttttttggttttggcactagtgaaaatgtcatcacagactgacgtttgggaaacactggcttgagtgaggcttcactgacaaaatgcctggcctggaccctgaatgtaggttagggcccagcaaggagagagggattgtctgatgggttaagaagcaagaataaactctgggaggtagctggggtgggtaaaaggggctaatccaagctataccatgaggaataatggggaataaatgtgttgttagggaatgggaaatcttaatacccagggagaaactcaggattcacagtaaaatacagagtcattagagatttttgttgttgttgtttgttgttgttgatgtttttgcataagaacat

SEQ ID NO: 200968 - DNA, 254 bp, Homo sapiens
ttctatgaggatcccagttccatttcacctgctgatgggttaagaagcaagaataaactctgggaggtagctggggtgggtaaaaggggctaatccaagctataccatgaggaataatggggaataaatgtgttgttagggaatgggaaatcttaatacccagggagaaactcaggattcacagtaaaatacagagtcattagagatttttgttgttgttgtttgttgttgttgatgtttttgcataagaacat

SEQ ID NO: 200969 - DNA, 134 bp, Homo sapiens
gggcggctatgcatgcgtcagggcagggagttcataggttatcactgtgctttcaattttgcagtgaacctaaaactgctcttaaaaaaacaaaaacaaaaacagaaaaaacaggctaggcacggtggctcacg

SEQ ID NO: 200970 - DNA, 1262 bp, Homo sapiens
  misc_feature (52)..(53): n is a, c, g, or t
agggaaagggcctggtatccaactggagaaggaagtgtccaaaggacacccnnagcattcctgacataagaaccaggggaacaaaagtgtggcccacttaagagggaatagaaaagaaaaaaaataggcaaaagtgaggaaacagggaagaccatcagaggctgtagtgaaatgctcgtggtggtctgatatgaatgacaagtcctgggttcaaaagggttctgggatggatatgaatgacaggtcctggactcaaaagggttctgggctggagatacttggaagtttaggtggagacaggaggcaatgcagttaccagtggatgagatgagaacaaggaaagtgaaaagagagcccaggacagaactccagccatgctatgatctgaatgtttatgtcccctcaaaattcttatgttgaaacctaatccccagtatgatggctctgggaggtgattaggccatgagggtggagccctcacaaatgggattagtgcccttataaaaaagacgccagaaaaaaaatccctcgccccttccaacatgtgaagacagtgaaaaggtgcttctgtgaaccagagtgtgggccctccccagacagttaatctggtaagcaccttgaacttggacttccagcctccagaactgtgagcagtatttctgttgtgtgtaagccactcagggtatgggattttgttacagcagcctgaatggactatgtcaggagaccaccgttaaaagccagactgagggaagggagacagagaagcggcacctgtgggggtaggaagagactcataagagggtggcgttggaagacaaggaagaagaatcaaccacaccacatgtcagggggtgccacacaactatgttcttactgaaaggaaaccactgtacacagttctttaagggtcaatcgctctttaggaatgactcaaaaatgtataaaatccactcctaaatccaaaaagaaccgagaaatacagaagtgtgcagagaacccacagagggatcacgtccatagagggagtagagtctactacgctgccagacactgcagagtcacggcacagaaggagtttaaaggacagtgccaagtgaaaaccgcgcaacagcacgacaaaatcgagtaggctcaacgatttcacacacacccttgacatgtttctccagatgttctccgtagttctacagccagccaacagaagattacctgaatgggattcttctgtgcttaatgttttcgaatggccatcttaatgc

SEQ ID NO: 200971 - DNA, 691 bp, Homo sapiens
  misc_feature (52)..(53): n is a, c, g, or t
agggaaagggcctggtatccaactggagaaggaagtgtccaaaggacacccnnagcattcctgacataagaaccaggggaacaaaagtgtggcccacttaagagggaatagaaaagaaaaaaaataggcaaaagtgaggaaacagggaagaccatcagaggctgtagtgaaatgctcgtggtggtctgatatgaatgacaagtcctgggttcaaaagggttctgggatggatatgaatgacaggtcctggactcaaaagggttctgggctggagatacttggaagtttaggtggagacaggaggcaatgcagttaccagtggatgagatgagaacaaggaaagtgaaaagagagcccaggacagaactccagccatgctatgatctgaatgtttatgtcccctcaaaattcttatgttgaaacctaatccccagtatgatggctctgggaggtgattaggccatgagggtggagccctcacaaatgggattagtgcccttataaaaaagacgccagaaaaaaaatccctcgccccttccaacatgtgaagacagtgaaaaggtgcttctgtgaaccagagtgtgggccctccccagacagttaatctggtaagcaccttgaacttggacttccagcctccagaacgaatcctacaccacacagcaccagcacgatcccttgggatcctcta

SEQ ID NO: 200972 - DNA, 381 bp, Homo sapiens
tgggagaagcaagggcaggccggactcgggggaggcgccaggtggacactgatagagaggacaggtccctgcaaacctcatctggaatatggaaacatttattgctgtgaagggctttggaaggatgactgttattaaagcagccaaaacatctccactgagggagcttcctaggggccagggaccttctcacagcctccctgtagtgggtggctcaaggttgtgggaccagcctgcttgcagagcgagtcccggctctgcacatccacaccagtgagcacacacccagctccagtagccgtgagcccgttccaggttgggctcagtgctgctctcctcagcctggggtctcagggactgtgggcacagcgcagggcactg

SEQ ID NO: 200973 - DNA, 775 bp, Homo sapiens
ttctgagacactattttgcctctagagatggtttgttaacaatttttcttttaaagagtgaatgtaatatgtggtggtacagggggaaattgcagggctgagagttaggaggtgtggattttaatccagattctgaaaatacctttacctttctgatagggtaatgctgggaattctcagaggtcttgtacagctctagaattttacaattccataatctcataaatttaataacttttattcaaccctgaaaaaggccacaactagaattataactgctattttgcaaatgattaaaactaaggcagaggacaattaagtgtttctttctgaggtcacaaagccagtaaatgttaaaactaaatgtagaactcatatctcctgactcttagttgaatgctgtttccattaggccacactgtttaggtgtttaagatacctgttgtttcttcatagctcagattttttactagctcagcattttcttaaaccatgattatggagacactgatcttgatggatgaccgtggaaaaacggttccacagtgaaataactttggacaccattgcgtatcagttgttccctcttagaaattcagattgtactttggaatgttaaagactctgaaaaaagaaaaagctgatttaacttttttagcctacgacaccccaaaatcacattaggcacagaaggctttttgtaaagagcgtcattagcttctgagaaactagttttctgtaggacactgggaaatgtttctggttatttaaagga

SEQ ID NO: 200974 - DNA, 233 bp, Homo sapiens
gagtgtaaattccaaaggtagaatatgagtctgttttggtcaccgatgtaactcagtcacctagaactgtgcccagtgttcaattattggttgaatgaatgaaggagtgagtttcaaaacattgttcatgtcttcgttctgtctaccctgataaaatgagagaagtgcacaactaagcccaaagacaaaacagtgatgggaattaacctggcctagctcaaatgccacctgct

SEQ ID NO: 200975 - DNA, 352 bp, Homo sapiens
ccgaacatgacatttaggcaggtttcatcatattgccagactattctcaaactactggcctctagcgatccaccacctcggctcccaaagtgatgggattacaggcgtgaggcaccgcctcctgcttttaataccaatgcaaaaattctacagatgaagaaatggggactcagagagattaagtagtttgcttaaggtcacacaactaggaaatgaccaaattggcatttaaatgagacaggctggctgaagcctggactgcctctgccttttttttttttttttttttttttgaatcagggtctcactctgtcacccaggtgatcacggctcactgcaggctcgaactccc

SEQ ID NO: 200976 - DNA, 226 bp, Homo sapiens
aggcaccaaggaggacctgcatctgccgtccaccaactactatgtttactatgacacggacatggaccaggcgtaaggtgcacgtgtgtgtgtggcccgtgcctccctgcttgactcagagaacgagcagaagttatggaatgggaggaagtaggcaatttccaatttgcacctggaagtttgtcacaccaaggctgtggctcagcttcacccctgtggggagtcc

SEQ ID NO: 200977 - DNA, 386 bp, Homo sapiens
cttggtatcctaatctttctttcttgccatattttggcttggttgatttctctttcttatttgtttttcatacataattatatattctattgctattctttttaaggatactatacagtttaatgtgattatctgatttaacaggagtcaaccagactaccatggctgctcacatctcagatacattttcctacatattttgtggttgtgtgattttgagtatataacttaaactcgcagggctcagtagtcctagtggtaaagtggggacaatcaatgtagcaatgtcataggctgttgtgtaaagtaaattagctaatacatgtaaagtgttacaataatttcatggaacataatggtatcaaataaattcctagaacatgaaa

SEQ ID NO: 200978 - DNA, 473 bp, Homo sapiens
  misc_feature (31)..(31): n is a, c, g, or t
ggaggactggtaggttggactggggttgggnttggcgttggcgctggggcaggggccggcacagaggtgagggctggggctgcgggccgggccattcgagtccagcgttccaacaggcttctgtcattgtcactgagcactagtccagccaaggggtcagtggaggggcccccagaggccccagccccccgttcctttcgctcccgctcctgccgccgtttctcccgctccttggctcgttcttgccgcctccacaacctctacaagttgtggcaggattcattaaaaaaaaagaaagaaagaaaaagaaaaaagcactgtcactatcactgggcctttgcacctgccctttgcctgaaattctcagacccaggttctctgcacgtctaggtttcaggtcaaatttcacgtaataagaggcccttcctaaactccataaaaaagtagcacctccccaacccttggagcgtctc

SEQ ID NO: 200979 - DNA, 598 bp, Homo sapiens
ctttctcctccattcttagcatcaagtctatctccaaatatatctcgcattgtccactgtactctatccccatgaatgttgtgtggtttgggccattgtcatttcttgcctggatttcattgcaggtaaagagcctcccacctgatctccctgcttccactccttgcagcttccctgcagctcacatatacacacacacatacacactccagtcaccagacaggagcccaaatcatcatcgttaaatataaattagacccttcaatagctttctgttactcttagtaacaaatttcttgccgtgcctatgagccatagtttgcctcctgtgtctgtcactgccctgtctgtaccattcttctccaagtgcactgccttttagccccactagattctattcccattcattaaaaaaaaagaaagaaagaaaaagaaaaaagcactgtcactatcactgggcctttgcacctgccctttgcctgaaattctcagacccaggttctctgcacgtctaggtttcaggtcaaatttcacgtaataagaggcccttcctaaactccataaaaaagtagcacctccccaacccttggagcgtctc

SEQ ID NO: 200980 - DNA, 480 bp, Homo sapiens
cttacataactgtagtacagtgccaaagccagcagttgacatttgtcacaaaccatcaaccttacctttccccagttttacacacactcattcgagtgtgtgtgtctgtgtgtgtgtttcgttcaatgcagttttattgtatgcgtagatttgtgtaaccaccagtcaagacacaacagtcccatcacaagaacatctcattctacccttttctaactgtatccacccccttacccatgaaaccactaatctcttctccatttctataatattgttattttaagcatgttatagaaatggagtcatacactatctagccttttgaaattggcttttttcacttaacgtaattctctgaagatgtctccacgttgctgtaggtgtcagtagttcattccttcttgttgctgcgtagtgttccaaggtatgaatgcaccatggttagtttaaccattcacctgttgagggacatctggattg

SEQ ID NO: 200981 - DNA, 507 bp, Homo sapiens
gaatgaatatgggctttgacgcacaggctggagcgcagtggcatgttctcctagcccacagtggggctgggagggagtcattgaagtgagctgccctcttcctgttcacctgcctggtgtttatgtcacaagactgccctagtggaggactctccaggttgaggttaggggttggaaaccacagctgaccctcaccacggagagtgggtctccatggaggccttggccactggtgcagcatcagcgtgggacacgtggtggtcagcatttggtctccagctgtggtagctgttcccgacctccttcctgcagagtcagtgacatggagttacctctgggagtcgagatgttcactgtaattgcatgctgcgggtagggcagcagggccttagcccatcatcagctcctgggtctactttgttcctcgggggacttgctcatctctggtgtcctcaagcctgagttttaatggccatgcaagcagagaacaagagacaaagggaacct

SEQ ID NO: 200982 - DNA, 162 bp, Homo sapiens
cccctccagtggtgtgtctgtcccatggcaagcatttaacatgcaatatgatgctaatgtacatgctggagtgaagcaaatgcctaacaaggcttccaggagtcctggtgggcaagtacaggagccagttaggaaaacagaaaataggattaaagacttgag

SEQ ID NO: 200983 - DNA, 326 bp, Homo sapiens
aaaaagaacatctttttatatctattagagaaataatctgagacttgggtttcctaaggatttgtccttcctaagctaagttatttggtccaaagtacgtttctctaaatatctctatagccaaggtagttatgttccccagttacccaaagtaaattaacatatatgatctctcttaaattggaatccactgcacttttttatcagtcccatctttatctgggtaacttctcatctcctcaggtctcagtttaaagtcgctcctctcacctcccaggctatgttagttaggtagatatagaagagtgcacttttgggatcctcaa

SEQ ID NO: 200984 - DNA, 419 bp, Homo sapiens
aaaaagaacatctttttatatctattagagaaataatctgagacttgggtttcctaaggatttgtccttcctaagctaagttatttggtccaaagtacgtttctctaaatatctctatagccaaggtagttatgttccccagttacccaaagtaaattaacatatatgatctctcttaaattggaatccactgcacttttttatcagtcccatctttatctgggtaacttctcatctcctcaggtctcagtttaaagtcgctcctctcacctcccaggctatgttagttaggtacttgttttatttacatgttaacaactttgtacttcctaactcttttgttttttttgttttttttttttttttggaaagggtgtttggttttgtggccaatttggacgcgaggggcggaaaacagg

SEQ ID NO: 200985 - DNA, 563 bp, Homo sapiens
tgttgttgggaggttcacagatcacttcacctgaacaggagacaagaattccactgcttaaggtccagtctacagcctaaccacaagacaataaaacaaagagaaaatgagctgagcgaagaggatgcaagggcaagggcccatccatatgctgctgggaggagtgtgagctgatgcaactcttcaggaaaataatgaagcaggccgggcgcggcagctcatgcctgtaatcccagcactttgggaggctaaggtaggagaatcgcttgaaaccggaaggtggaggtagcagtgagccaagatcacgccactgcactctagcctgggcaacgagcgaaactgtgtctcaaaaaacaatgaaacaaacaaacaaacaaaaaagttttggaagaaggtcaaaagaatgtatccggtattctaaaattgctttctaagtgttacagctcttttagaattggtctagcaggttttccagttttcactggaacccctccccctcaaaaagaaaaaaatgcattctaaaacaaacctaaagaatgctttaggaagtatggactatcaga

SEQ ID NO: 200986 - DNA, 334 bp, Homo sapiens
caggcaaaagctctgtggtcctgagccccttaggaattttatgtatttgaaatgaaaaccagaaagagtgggaaaaaaataaagacaggactaaaagaaaaaatttcttgtttctaattctttgtatgttaatttttattttattttattttattttattttattttattttattttatatttttttggagacaaggtctcgctctgttaccctggctggagggcagtgatcatagctccctgcagccttgacctgctgggctcaagtgatcctcccaccttagcctcctgaatagttgggactacagacatgaaccatcatacccagctaatt

SEQ ID NO: 200987 - DNA, 341 bp, Homo sapiens
ccacagactgggagaaaatatttgcaaaacacatactcgggatacagtatgtatccagagtgtgtatatgtgtgtgtatacatatatttcaattcttttttttccccccgagacggagtctagctctgttgcccaggttggagagcagtggcacgatctcagctcactgcaacctccacctcccaggttcaagcaattcttgtgcctcagccttctgagtagctggaattacaggtaccctccaccacacccagctaatttttctgtatttttagtagagatggggtttcaccatgttgaccaggctaatctcaaactcctaaaccaaagtgatccacctg

SEQ ID NO: 200988 - DNA, 214 bp, Homo sapiens
aaaggagggagaggagaataaagagaagaaaaagaagaaagactcacaaaaaaatactaaaaatggaaagtctatgagaagaggataaaaggcagtggcttatgtctgtattcttagcattttgggaagggaagcaggaggatcacctgagcccaggagtttgagaccagcctgggcaacatagtgagagaccctgcctctacaaatcagtttt

SEQ ID NO: 200989 - DNA, 739 bp, Homo sapiens
aagagtgtcttcctctctgccccttacaaacatgcacattttcagacagcttacccggagatgactaacccttgatatgtgttttaattaggtaattggctttgggaaatagtagatagtgggtaccactcacagaactaagaaacacagaaaggaagatttgaggggtgaagaccatgagttgacttggtggcactgaatttgatttgccaactgaatggctaggtgaaaggatgcaacaggtgaaggaacccagagatgcaggggagggctgaagctcagggggactgttgggaatatgtttgaggtgaccaatttatcgggtaagcacaatggacatatatgagatgagcctagaggaggaggattaccagggcacgaggctattcttctggagaagtccatctctcagaggacaaataaagaaacaggaagaagaagcagagaaacagatattgaccaatcagaactcagctgcatcaaccaatcaaaactaagaaaatttcggtccttccattgtatacacagacctgactgagagtctcagaggtattgtggaagaaaatggaggcgagagtttcaagaaggaaaggctggaaattgcagcagaatctttaatacggtggttttgagagaggtgtggaaggcaagggcaggccaaagccatacgaaagggtcacaccaagagtcaagttctgccaataaactgaagagtgcatgaggaaaactgatgtagcaa

SEQ ID NO: 200990 - DNA, 548 bp, Homo sapiens
caggattgataagctgggtggttcttgttcagaatctttcaagaggttgcagtcctctgaaagtgtagtgggttggggtatccacttccaaggtggcttgctcatatggctggcaagttggtgctggctgttggcaggaggcctcagctcacaatgcaggctttcataggactacgtgagtgtcctttcaacatggcagcaggccttccctagagctagtgaaggatgagaaaacgacaaatcgcaatgtcttttatgacctaggctgggaagttatactccatcatttatgcaatatcctgttatcacacaggtcatccctattcagtgtaggttggtactacacaaggacatgaatatcaggaggaagagaatctctggaggccatcttggagcccatagtccgccttctgccccctaatgattcacgtcttcgtctgttcctgctctctaagagccaggaggcagacttcccttgagctttcttgcagctaaagtagagcatcattagcagtaaaaattaagatatcatcacaaaggccaggcac

SEQ ID NO: 200991 - DNA, 386 bp, Homo sapiens
gtggttctttatataatagaatattatacagcaataaaaatgaggcttcatgtaccgattgtactgatagagaatggtctccaagatgtatcattaattacaaaagacaaggttcagaacattgtttgtaatatatgctgccatttgagggatcaaaagagagtgcacatttgtatttgtttgggtatgttatcacatatccctcgaagtatacacaagaaactgtcaacaatggttgtcttgagggaggggagctgggaggttgggagaagggcctacccttcctgtataccctttagaaacttgcatggtttgagctatgtgaaccacttgccaattcaagaaacttataaaaattttaaaggacgtagacagagaaaggattt

SEQ ID NO: 200992 - DNA, 559 bp, Homo sapiens
tatagaggcagctttattgccaataaaagctatagcttagatgtgaggtcacagtggtatttataatatttcacccctgaattaagctcacacacccatcatagacaaagttcaacaacccagaagcttactgatcaaggccagagcctttccccagcaagcttaccacctggctggcagcagtccagaggtaccctattcatacacaagtcaccaggtgtgcacctatactgtcccaaagatatttggagaggtgagaggaggggttggtggaggagaggccagggcctctattgaatctatagtgacatgatgtttatacaatattaaatgtctgtctggaaacaaactaggaaaggtaagtaattattttcctatttggaaagttttgagtttatacagattaactgtgttatattttactaagtttattttcagtcatgaattgctgcttccaatccactaaatggtcctctagggacaaacatccttcaaaacttactacatttcctttttataatattcacctctaagtgaatttgtgttttacacagaattg

SEQ ID NO: 200993 - DNA, 185 bp, Homo sapiens
attagtcagggcgctactactgattattccaaagtctaatcaatagtgagaacaaataactttattctgtactgccttcccactccgatttagtaaagccacatttgttggccttgaagaagagtacagaatgcttgaagaatagtacaaaatgctatgtttggttggcccaacatgtattttaa

SEQ ID NO: 200994 - DNA, 322 bp, Homo sapiens
gtcctcaccaagggacagatgtgaaagttctggaaattttgaagctaaaggaagtataggcagtatatggaaaaatggaagtataggcagtatatggaaaaatggaagcaatgtaatttttaagcatcttatttttttttcaatttttaaacttaaaataggaaacatctcccagctctaaatgctcttaaaacaattacatttgttatattttgagatgagaagtcttcctgaaaacaacagaagaatttgtcggcaaaacccactgtttttaaatattggcatcctcatttgtagtgctaatgagcatttctgtttcttc

SEQ ID NO: 200995 - DNA, 342 bp, Homo sapiens
agggcagtttgtaagaacactgctaaacataattattgtggtttcacacggtgtattttgccattggtagccaatttgttggtaaaattactaatgtaaaaataatttttagtgtatataaacatatcatttctgaccttgattcttttctctgcttatgtataagcatgcttatctttactgcaatatatttgctcttacaactattaccaattcgtagtatggagggttattgtttaaacttaatttaagaaagtaacaagaaggaaagccaccttttgtccagcaaccaaacttcccttccctccctttctaccatccaaccaatttaccagccaagca

SEQ ID NO: 200996 - DNA, 225 bp, Homo sapiens
aatgctgccattgctaacattattatagattgtttcggctgttgatgaggttatgtaattaaaattcctcctttcacagaagactaactgaagtctatgacagttaagcaatttttccaaagtcatgccaccaactggcggtaacgctgggtccccatgttcattacaccacattgcttcctgagaaatcagctcaatttaacaacttccaccataaatagaaag

SEQ ID NO: 200997 - DNA, 509 bp, Homo sapiens
ttgggaggctgaggcaggagaatcgcttgagcctgggaggcagaggttgcagtgagctgagattgtgccactgcatttcagcctgggtgacaaagtgagaccacttctcaaaacaaacaaacaaaaacaaagaaaaaaaacagatcttaacactgacaaaacagattctttgtagcaataagataccaaagtccaacctgactctagtataacttcacatgataaaaatggaaataaaaatattttaccccaaagtatgttttttggccctattttgaaatggacctgcagagccattgagaaacatttgcatctgtaaagcatctcattaacataactagatctttcctcttccaggccttccgaaacctgaagagattaactgagaatctagcaccttttaaaagtctaaatagaaaacatttgctatctattatctctaagggcagccacttatgagacttcatctatgtaataaaaaccttggtctccacaaccccttatgttaa

SEQ ID NO: 200998 - DNA, 174 bp, Homo sapiens
acaaagacggcaacgcgcttatcagcgctatgagaaattattcttctgctgttcagaaattttcccagacgctgcagtcatttcagtttgatttcattggagacactctgactgatgatgaaattaacatcgctgaatccttcaaggaatttgctgaattgctcaacgaggtag

SEQ ID NO: 200999 - DNA, 182 bp, Homo sapiens
catgcagatcacgaggtcagcttcccaagtagctgggactacagattattcttctgctgttcagaaattttcccagacgctgcagtcatttcagtttgatttcattggagacactctgactgatgatgaaattaacatcgctgaatccttcaaggaatttgctgaattgctcaacgaggtag

SEQ ID NO: 201000 - DNA, 478 bp, Homo sapiens
ttcccttgtctgtctttttggttcttctctccattttcatttctgccacccacattttagttttcaggatcactttctttttctctgaatgcttctgtttttgtttgtttttcaccttattcctgtttcaaagttgcacatcttcttatatttctctgagaaaattatgattttgcttaacacttgatttctgcttcctgctttttatctgtctcctccaagttccttgtttcagtgtgtttgtcatggtctttgtgtctcatgctagaggctttcctcactatctcatgattattggctgtctgttcatatttaaaagagaagcattcaaatttgattggaagttaaggactgtatggagacaaggtatagaaaatattttcattgttttattagtcagggttctgtaggggaacagaataggagatagatatagataatagagatagagacatagacatatagataaaggggagtt

SEQ ID NO: 201001 - DNA, 233 bp, Homo sapiens
agtccagccatcacatcatacatcatagcagaaaggaggaggaaagggaagggagctgtgccagcagatttccactgttctctacccgtggccacctagtaagggagttttcccctctgtagtagttgcaggcaagggaaaacgctagggcataggggtgcatgtgctcctgcctatgcccatggcaggcattaccaatcgatcactgcactgtttcctgcagaccccaaatg

SEQ ID NO: 201002 - DNA, 413 bp, Homo sapiens
ggatccccggacagcacgcgctaacaatatactgattggggttagaaatgagaacagttttatatagcatcgtcctctggtggtgcctagaatcctgaaatgtaacattgccaccataaccaaaaaaaaagctgctaccaagagtgaatagcatttaattcagtaaactttatttctactcactaaacacaatacagattacaaatccatgcaaatcacttgacacttttctaacaatttctcctctgaacaagtatgctaatattcctcccatcttcaagatactaattttaaccaaaagctaaaattttgttaacctaattcacaaagttctaagacccttaaacagctaacaagaaactaaattgaagaacatgaatgttttttttttagtttctgttagcgcgtgctgt

SEQ ID NO: 201003 - DNA, 598 bp, Homo sapiens
cgaggccctggttctgtggtctgaggtggactcaggtttacacctggagctgcccgggtgacacgtctggtctgggactgcacttggacaagccacttccctgcgtctgcagcacctctggcctcgtgtgctgtggagcaaggaaaacgcagccagcacagtgttcggtgtggttaagtttaaaaaccactaacttggttcagtcagtggaaaacaggtacgttaggaacctgggtgtgtgaactgtgaatctgcagatcaggtgttctaatgaaaaaatgtttttaatttttaaagtcttgagaaacaaagttctgataatttaatgtccaaactgagatgtatccagccgggcccagtggcttatgcccgtaatcgcagtaccttgggaggctgatgtgggcggattgcttgagcccagatgtttgagataggactgggcaatgtagtaagacgttgtctctcaaaaaaaataaatagccagacagatggtgcatgcatgtggtcccagttactcaggagacgtcaaggctgcagtgagctgtgatcacaccactgcactccagcctgggtcacagagagcaagactgtctcatta

SEQ ID NO: 201004 - DNA, 361 bp, Homo sapiens
aaggtgcctttcagtgttgctccgtggtgctctgttgtatgtgtattcgaactaatgcccaatttcccccgcctcccttgaatatttggctgctttaagggaagttttttgcggagaacgctgggtggttggtctgggccaggctgctccgaggtgagctaggggacctgctgtgcccgctttgagccgcagtagactggagtgcaagactccagggatggggtgtggtggagaaaacgagtaccacaccctcttcttttcctcttcacctgctggtgaagtctccccattcagcattttgctgatttccttttccgagggattggctcagagaactgaggaaagctgctgaaatacttgg

SEQ ID NO: 201005 - DNA, 354 bp, Homo sapiens
tcttccccactacaatataagacccttgaaggtggagatcttgccagtcttgttcactgctgagtccctgttgctgaaaatggtgcttggcatatgggagtagctcattagacactttcagtctaaccaattttgatgtcctgccacaagcaaggagagttgacatgtccaggagaagccacttcacacagtccagggctgcacacagaaacacatcactattgtattctgagtgtgtacaagacagtgtctatactctatactgtgctctgggtgaggtaggggttggctgagagcctctgttcagtacccagcaccaatcccaggaaataggataacatggcttaaattgac

SEQ ID NO: 201006 - DNA, 519 bp, Homo sapiens
aggaagagaggaacagaacaagcggcaaccaagcccacgaggaagcacagcacaaaacaggcttcagaaacaggcttagcaagtgagcggcaagcggactgggagagcgaacatagacaaattcggccaaccacgttcttcagggcagatgagaattgattcccaaaatccccaatttctgggtaataacatttgtcagccatccacaagcgtctgcactgcttgggaggaggatgaagaggcactgcattgtttgaccagtgctgaagtgacagaatttgaagatattaaatcaggttacagaataggtttttattttgacgaaaatccttacttcaaaaataaagctctctcaaagaatttcatctgaatgagagtcatgatccatcttcaaagtccacggaaatcaaatggaaatctggaaaggaaactcttcaagtcaaatgcagaataaagccagtaggaagaggcatcctgaggaaccagacaggttcttcacctggtttactggccattctg

SEQ ID NO: 201007 - DNA, 255 bp, Homo sapiens
aaaaatgagtttgtgttacctgaggtggtggctgaccaccaaggacaggaagaaaacctctgagcttggcagcctcccacatcagggtaatggagtcaggtgtgcgtgtagttgtgtgtgcctagcaacctgtctgagacgattggcttctgaagtccagggcctaggaaagcccaagggagccccgcaagctgattgtgcatagctcatttgtttaactgggaatcatcatcatacctaccttctgggctcacg

SEQ ID NO: 201008 - DNA, 652 bp, Homo sapiens
ctcctttctttttgaagagctctcattctgttgacctgcactgctgctggattgttcctcgggctttgcatgttccctgcatttgttttgtaactgagcatggtgcatggcagacctctctatgcagtatgctggggcagtgagcaggtggcacagtagccacaccctggcaacagtgagtgagagctggtgggcaggcttggaaactagctcctttttgttctgctcatgtgtttttatgggggatttgtcttatgcctttattaatattgtttttcttttttccctttctctgataaattcctttaacttttcctcaccttccgttcgacaatagccatggagggtaagcacatcgtgtctttgtgtgtctgtccagctctctctatcacacccggctctctgcatgtaactttggactggaaagcaggaagcccaagtgggagggcacttcggcctgctttgtcacctctcatgactgacagatgccaaaagcagtgtttatatatgcaaaagaatgagacatgtacatctttgcagtaaatgaattattcttgtgcttttctatctcatacccagacttttggaacaaccaagaattaatctgttccagattacttaggcaaaagcacccaagggttcagaaatggga

SEQ ID NO: 201009 - DNA, 444 bp, Homo sapiens
ttttcccattatctgcagtgcttgggttttcaccctgccgtttgtctggcctgtggacactcacttatggtggaggattccttacacattttatgatttgaattgtgaatctatgctcagtggactctcgtgtgcctggatggtaggtgtcttccccacagcaattttgtacttgtttctgtcagatgtcctagggttgtggccagctgtaggctactttttatgttaaaactttgacttgaaagtttggggatatgagagttgaattttgaaccccaaatccacgtgagattcatgtcctgatgatgaattctcaggagagatcttttatgtttctttcccaagtgaggccaggcagcaacaaataagaagctgtggtgttgcgggttgatgtgcttttctgtgttactctgaactaagggtgtgactttggagggtcctagt

SEQ ID NO: 201010 - DNA, 791 bp, Homo sapiens
aagcacgagagggcagtggcactgttagttgcctcctaatatccatttccacccttcccccttctcatgagacccaattttgtttaccccatcccacccaggaggggccagtgacagttcccatgactgagtggatgcccaacctaagctggcacattcaagcacttctcattctacctggaggaggagcctgctctctgtcccttggctggatatgaatgatggagcagagccaccttgtgatggctgggaaacctgcctgaggaagaagctaacactcaggatggcagagcagaaagatgaaatgcaccagagtccctaacatcagcaagccaccgcaggcctgtctctcgcctgccccactgcacataggtgaggtaatcaatgtcttcactattcacgccagagtctaagtcaagtcttttgttgcttgcttccaaaagtagactgaccaatacaggagactgtcagatcaatcttcttaaatgaaaacagaggttatcacggagaatattttaaaagttagggtctacaatggttttatgacaaagcattttttttttagaagcttattcattagtcttcttacctccagtcttgttcatctcaaatccatcctcttctgggctgctaggagtctaccttacaggcaagtctgagcacatgattcctaccttaaaggctccctcagcaattacaaagtacgcagttggaagtatgctgaacttgaaaacacaaagtctgataattcatcaaagttcaacattttttttttttttttgagacggagt

SEQ ID NO: 201011 - DNA, 712 bp, Homo sapiens
tgaatgtgccagcttaggtgggctccactcagtcatgggaactgtcactggcccctcctgggtgggatggggtaaacaaaatggggtctcatgagaaaggagaggaggagcctgctctctgtcccttggctggatatgaatgatggagcagagccaccttgtgatggctgggaaacctgcctgaggaagaagctaacactcaggatggcagagcagaaagatgaaatgcaccagagtccctaacatcagcaagccaccgcaggcctgtctctcgcctgccccactgcacataggtgaggtaatcaatgtcttcactattcacgccagagtctaagtcaagtcttttgttgcttgcttccaaaagtagactgaccaatacaggagactgtcagatcaatcttcttaaatgaaaacagaggttatcacggagaatattttaaaagttagggtctacaatggttttatgacaaagcattttttttttagaagcttattcattagtcttcttacctccagtcttgttcatctcaaatccatcctcttctgggctgctaggagtctaccttacaggcaagtctgagcacatgattcctaccttaaaggctccctcagcaattacaaagtacgcagttggaagtatgctgaacttgaaaacacaaagtctgataattcatcaaagttcaacattttttttttttttttgagacggagt

SEQ ID NO: 201012 - DNA, 1044 bp, Homo sapiens
cctctctgttcttgctgggaggaacttgccaccataatcagatttcctggaaaacagacttccaattcacctgaaatgcttcaaagaagttagaagaaggaatgagctcataacacttttctttcaagtttcaggagactcgtggcatggattttgcagaaaggcgaatctgtattcaaatgctggctctgccacttaccagctgcatacttttggccagcttaacttctctgggcctcaccttcttcatctgcagtgtgggataattactatgccacagggttctccgaggattaactaaaagagtgagcgtgacttggcatctgttatattagcctatccagtatctggtaatttgaccctagtcttccttgagaaactgtcccctttatgtcgttggtcctggagggtcacatgggctgactcctaggctggctccagggctgaatgggtgacccagaactggcggatcagagaactgcattccctgggcaaagcaacaggcttaggactgggcatggagactcaattcccagatgtctactagaaatgttaaaaagtaaatctgggcttattgagatattaggatgtaatctgattttggcatcttgctaggtcctgagaatagaagtttccagaagaaagcagagatggaaagaataagacctaattctgatgagtcatttgagcccttatgtccaacttggcaacgccaaggcctccccggccttttggagacatgggccataaattaatcttcttgatttaaacccactgggtttccaatcactcgaaacttagagtcctcactaataaaatatgcaaaaggttcagtccactgtctggtaattagtgcacaaggagccgggtgggcacttaggagacggctcagcttcctgcagagactaaccagtttcgtttccccttggcacctgagaagagagggctgactgacaatgccaggagatcaggttcatggcacggtaaagaaagcagctgctgtgtgaataggaacaacaggaaccctgagcccaatttactcat

SEQ ID NO: 201013 - DNA, 550 bp, Homo sapiens
cacttcacacctagtagatgggttaaaaatgttaaaactgaccataccaagtgttggtaaggatgttgaacaactggaactcttacacactgttcacaggaatgtgaaatagaataaccactttggaaaacagtaagttaaacatttaccaactgtgatggtttatacagagtgtcaacttgattggattgaaggattcaaagtattgatcctgggtgtgtctgtgagggtgttgccaaaggagattaacatttgagtcagtgggctgggaaaggcagactcacccttaatctgagtgggcgcaatctattcggctgccagcacggctagaatgtaagcaggcagaaaaatgtgaaaagagagactggcctagcttcgcagcctacagctttctcctatgctggatgcttcctgccctcgaacatcagactccaagttcttcggttttgaatttggactggctctcctctctcctcagcctgcagatggcctattgtgggaccctgtgattgtgtgagttatacttaataaactcccctttatattccat

SEQ ID NO: 201014 - DNA, 357 bp, Homo sapiens
ctttaaaacatcattttttcactctaaggtcataagatattccccaatatttttctttagtttttttaaagttttatttttttacaatcttcaagtcttttatgtgccaggaattaacttgtgtgtagtgtgaggtcaggagctagttttatttttttctacatcgacaagcaattgtttagaaaccattaattgaatattacatttcttccccacagttgggtaatggcactttcatcatatatcctggactctctatcagtcaggttattattcctgtgccttattataccatattaactactatatctttatggtaagtctcaatatctggaaagcccctatttgtcaagtgga

SEQ ID NO: 201015 - DNA, 537 bp, Homo sapiens
acatttcctctatggagacaggagcacaagagtgggggcaaatggagtaaaatccataggtggtattatagttagtgaggggaatggatttgcagatgatgtcacagatagtcttgattgttttcagtgaagtaggaattgggttttaacagctgaaagtgaagtatgtcttagagcaggaggtctgaggaccaaagtgagagtacagaattgctgctgagttcagaagatcaagctaattcagtccacagaaagaaagattgctaggtaactaagtatccagcagaggttggggcctgaatttgtagtggctgtaattggttattctctgcagtcctattcaacagtctttcatgtagaactgataaagccaaatggtagggctaatcctagactgaggttttgttaagacagggggacctggggacagagagtcaagagacttgaggtaattgcaagagggtgattggagcaatgggccaaaggatatagactgtaagacaaaaagtcaagccagccccacaagagaatgtaggt

SEQ ID NO: 201016 - DNA, 601 bp, Homo sapiens
gataatttatgttagtgtaaaccatcagggaccacacttctattacttggagcattccaaggatttagaagaaccagggataaaacccagccaaattctttattatatgacttccttcccctccactccttactcttcatttctctggccctgtttactttgaccacccagccccttgtcaccatgcctgtagagctttgcagaagacaagtcaggggagctggtgtattagtccattttcacactgctgataaagacatacctgagactgggcagtgtacaaaagaaagaggtttaatggacagttccatgtggctggggaggcctcacaatcctggcagaagggaaagacacatctcacatggtggcagacaagagaacttgtgtagggaaactccactttataaaaccagcagatctcgtgagacctattcactatcatgggaatagcatgggaaagaactgcctccatgattcagttgcctcccaccgaggccctctcacaacacgggggaactgtgggagctacaattcaagatgagatttgctgggattacaggcgtgagccactgggcctgggaattctaggtaatttcagagt

SEQ ID NO: 201017 - DNA, 271 bp, Homo sapiens
tggcatgtcttggtcaatccaggagacacagactctaattctaattttgccactgtgtgacctggacagatcaccacttcttctgcatcttagtttcttatctgcaaattgtggggactggattagatgatcttgagaatctattccagctcaaaatgctgtgatataactgcttgggtaatttttatcatcaacaatcatatctcatgatcttttaaaactctctggcaattggccatggagtatatagccttatggggggaagtaaggg

SEQ ID NO: 201018 - DNA, 533 bp, Homo sapiens
agctctagggaacaagtttctcaaagataaggcaggagaagcaaagcacactggcctgggagttaggagaccgcgtgctaagtctgctctgtggccttaggtgagtcacttaaccttggggctgcttcttcagggttacaggtgataacctttgctctctctactctacagagctggagctgaggggagcagcagatcagataatgggttgcaagggttctgtaatgtgtatggtataataaaaatgcaagtaacagtaaaatcaccattatcgtcatcatcatcctgactctttaatgaaaccacacttctgtttcacctcctagggaacaaaaaacaagcttttcttcctcactgatgaaggaaaaatgaaattgtttataatagcctttgcttattagacttagaaattagtccctccccttgggcactgaaagactaaatggaaaatctatgagggaatggtatttcagaaaccacccacagggagttaaattagccagacaattttatttacaactgttttggcttta

SEQ ID NO: 201019 - DNA, 500 bp, Homo sapiens
cctgaccttcataataaggactcacatgtgtcggtcccaaggatccccaagggatactcatggttgaaggtgtctatgtgttctccttggtgtccagcgaatgcctcttgacaatctgtggtcatactcacaacctatgaccacatacgaggaagcgaggtgtcccttttgcagttgttcagaaggtcccgtgggcaggagcagccagaggaacatgaaaccagctcgtaggtggtacttgtggcaacagcagttatagccaaggagaagttaaattctaaagacttgggcagtctccagggaatatactaactgagaaataacatccataaaaataattcaatactagtatgtaaaactaaaaacaataaccaagtgtgactggctgtctaagaattaagcaaagtaagatgaagtgtcttttgctagcaggcgctctcagcaaaggagataaggctgcagtaattctcttcccaccttcgatgggcaggtgcaacctt

SEQ ID NO: 201020 - DNA, 681 bp, Homo sapiens
ctgaaattgaactttgatgcaaatgtgttcagataacccatctttcgaaataagacaaataagaatccataatctgaggtgggattgaaaactcaggagccaaggaacaaagactgaagtgggtgactccaggcttcactgatcttttgggcttggctgggcaaatcacttatcctaagcttcagtgtccttatctgcaaaatggacataatatctccctctagagacttgttgtaaggcccaaatgaaacataacaaagagcctgccacaaagcaggacctcaatacatggcaactatttagatcatcttccatggagaacttcctagcaggagtgaatgtgatgattagctgatctaagtattttaagagagggctggaagaaaaagaggtagttgacagttttctcactgtaaatttccaaaccaggcagagtgacaacaaccaggtttcagggccatcagagctacacctgggccgtgaatagtgcctacaccaaggtgactaccccactctatgatgacacccctaggacaggcctcagtcttctcactccctccaactgcaacaagctcctggggggacaaccacatggttttgttttgctttgttttgcttggatacagagtctcgctttgtcacccaggctggagtgcactggcacaatctaggctcactgca

SEQ ID NO: 201021 - DNA, 422 bp, Homo sapiens
  misc_feature (63)..(63): n is a, c, g, or t
  misc_feature (68)..(69): n is a, c, g, or t
  misc_feature (74)..(74): n is a, c, g, or t
catgcatgcgattcaccacagacagttgatcctgtgagaatctaatggtgttgctgatgcagntcagnntggtnatgctcactcaccctccactcactccctgctgtgcagcccacatggacacacgccaacacagggcacgctcacacagtaacactcggacgctggtgcaaggcgtgtgcacactcacagttccatccgcttcacacacacacactcatgcaatgagaacagacatcctcatacacacacacacctcacactcacacacatactacatgccaccgcacacatgcctaacactgaccatatgcacgcacagacacgcacacccgcacacacccattcccacacttggtgcacacaccctcacaggaacacacaaggctgcacaatccacactcgcacgcacccgagtatgg

SEQ ID NO: 201022 - DNA, 163 bp, Homo sapiens
cagctgtactccgtttcctttatttggttttcttttctcttgttttccatcacaatagcaacttttactttccaaagtcttctgtgaaaggtaagggacccaaaaatgccttttgcttccatcaagattctctcaaacagttgagatttttcatgtaaatttt

SEQ ID NO: 201023 - DNA, 397 bp, Homo sapiens
aggagaacagggacacctcccacacatacagacagccctacacagacttactacatgcccagttctctgggaggttctgtgagggacataaaataaggggcatgatccccaactttaaagagctcagaatctagttggaagaaagcagactgcacaacactggctacggaagcatttgataccaagagcttctgctgtgaggaggcaacgtgatgatgtcacatgaggaggcacccgcctgcagctcagatggcaagaaggacatgattttaccctcaagagagggtgaataactttgacagacatctagttcactgcactataaaagaaagaaatgaaataaatagtactgaaatgagataaaattatttttatttggagatgctatgactagaga

SEQ ID NO: 201024 - DNA, 493 bp, Homo sapiens
  misc_feature (482)..(482): n is a, c, g, or t
  misc_feature (486)..(486): n is a, c, g, or t
taaagggggggttctctgtttgtttgcttcttgtagcccccttgacctcaccagtaaggcagctaagggggaaacggagcagggcattgaagccacacggggctgagtctgaccctaggttttgtgccttgtctgagccccatttcccccacctgtaaaatgagtatgtatgtgcctcatgaaattattgcaaggattgagtgagaacatgcagcgcttcctagcaggtccttggtctatgcagctttacggtgaaggtgatgacttggacactcccagcctagaacttggcccacagaaaggtttacatcagccctcgttgtctgggagtggaaatgctctcaacgtttcaaccaaagatctgagagtagaatacattctgtctttaaggtgctagctgttcattttccagacaaacccacaaataagtaaaaagagaaacggagggagggagggagagtattctctgggaaaacaggganaaanaaaagat

SEQ ID NO: 201025 - DNA, 457 bp, Homo sapiens
tcaatgtctgtgaataaagacagtgttcctctttcctcttcagtctgactttcgtgctgcctggagtctgcaggacgatgctgactgcagtggagatggccagtgtttctttgtctgttctcaattttaggtggaaagaattcagtctttgacattaaatatgatgtcagttgcaggttttcacagatgctctctgtcaggttgaggaaattcctctctattcctagtttgcagaattttttttaaaataatgaatgtgtgttgacttttgtcaaatgtttttgctgcattagttggtatgatcacatggtgttttcagtcttataacaacttgaactgattgatattggaggttcaaccttgaattcttggaatcaaccctacttggttggtcatggtacattattcattttattttataagctgatgaattcaatttgctaaaattctttttaaa

SEQ ID NO: 201026 - DNA, 566 bp, Homo sapiens
agcaactgggaagatgaacttctgctgagatggagaagcctcaaaaatgaagataactaacctataaaaatttctgatatgctgtatatattgcaaggttataatgattatatgggtgccactgacatcttgtcatcacttctttgccttttttttcagccatttcatttgcttgtctctgtctttgcagaaattttatgtttagaattacagggacaggaagaataagaataatttttatgacttggggtcaaagaaccattgggatgtgcttttctgggaagaacacctttctcgtgtcttcatggttatcaaatcaatatttaagataagaaatacaattcttgtggtcccttgataagagggttgcctcaataacagtaaattagattaccttggggggatttattttttaataagccatattgatttttacccaaaattcattatctaggagtttacaaagaaattcttcagtatgtttcaggattttcccatttttgaagttgaagtaatatattttttcttttctagattttaagtttgttttaaagctgggctattct

SEQ ID NO: 201027 - DNA, 276 bp, Homo sapiens
gattacaggtgcacaccaccatgcctggctaattttttttttttttttgtatttttagtagagacagggtttcactgtgctggccaggctggtctcgaactcctgacctcgtgatccacctgcctcggcctcccaaagtgctgggattacaggcatgagccaccgtgcccgtcccttgacgatcttttaaaaaggccaatttgaccatgttggttccctccttcgaaccatctactggctccccattgctcttcagataaagacacaaacccttga

SEQ ID NO: 201028 - DNA, 510 bp, Homo sapiens
gaaaaggggaactagatgtgcagggtcgtagaattgtggccagtgggtggaggctacagggaggcagattttagcacagaatgagtaataaacagtgtgtgtctgtctcttctaaaattcactggttgacaactgacaccccacccccaccttccatcttaagaagggtggtatcccgttgtggagtagaatgtaactatgaccttctgggatttgggcaccagatttatcttactgcaacaggagccatggtgggagccacccccataactcttatagagctggtgggccaccaggactgccagatatatatatatattttttgaaacagggtcttgctatgttgcccagactggcctcaaactcctggactcaaaggatcctccctcagcctcctgagtagctgggattataggcacataccaccacgactagctgccagatcatcttatcttggaccaggcttctaccattaattcacatgctttaaaaaaattaaaaattaaaaaa

SEQ ID NO: 201029 - DNA, 696 bp, Homo sapiens
atttattgtaatatgtgtcccaatttcaaggatcttaaaatgtaaacaaagtacaacttagaattgatgaaatagaaaaaaagaaacgcatgcaaattatatgaataggtaatttgtagaaaaagaaatcccaatggctagtatgaagagacgctttactcctctagtaatcaaagaaggaaaagtttaaacaatcaaaaaataagaatttttactcaaaaaaagtacaaacaggcttggcgtggtggctcacacctgtaattccaacactttgggaggccgagacaggtggatcacttgaggtcaggagtttgccaccagcctgaccaacatggtgagaaaccctgtctctactaaaaatacaaaaatgagccaggcgtggtggcgtgcacctatagtcccagctacctgggaggctgaggcaggagaactgcttgaacccaggaggcagaggttgcagtgagccgagatcaccctattgcactccagcctgggcaacagagtgagattccatttcaaaaaacaaaaaaaaaaccccaaacaattagaaacctagatagtggtaaatattggcaagaacacaggggaaatgagacctccttgtatactactagagggagtatagatttgtgtagcattctggttgaatagtaaatttaagttagtatatatcattttattcaacaattcttatcc

SEQ ID NO: 201030 - DNA, 611 bp, Homo sapiens
ttccttgctttctgctgcttcttagtacttctcaccacctgagcatattatatatttattagttgtttggtttagtatctgtctctccccaggaaaataaagaaattttgttttgttcatagctgtaaccccagaactgacaacagtgcctggcatttagtaggcactcaatatagttgttgaaggaatgaagatatctccctacccgcttccctccacactgatcccccaagaaggaagcacataatgtcacttaatgatttaatgcagtctatggtgcagccccttagctcaagttctgggccaagatgttctgcagagttaaataatgccgcgccaaatataactaagagcagggaggaaaagaaatgacaagatatgcacaagggagaagagaatctgtttttagccaaagcctaaaatgagagcatggtgatgaggcgaagaggtgggaacaggtgggtctgtctccctgcagactaatcagctccctcctcagctgcagagcaaagaggaaaagacagagatgaccctcgggatacctgagaggatatggggacctaccagctggggacagatggatcattaacaactatagacaaatgcccact

SEQ ID NO: 201031 - DNA, 709 bp, Homo sapiens
cccctacctcaaaaaggaaaagggtaaaatttaccaccttcaccgccgtctcctcagacgacgagtaccccaccaggaactccatcgtgatgagtagcgaggatgacattaagtgggtctgccaggatctggaccctggggactgcaaagagctgcacaactacatggagaggttacatgaaaatgtgtaagccagacacacacagacattggttctcactcacctttcagcctttaattccaggatgtgtagcaacggtgcccccggaagagaaacaaagcagcaggacaaaataaggatgacactatccatacagcctcagccaatgaccccggctcggcggcgaggcctggagtccgcatcgacgcacacattccagagtacagtgtcttgcttaagaggtttatcatgcatggcaagatttttaagacttgaaacaaaaacgagttctgaatcactgagcgtctgagagcgtccaggaaagaacagcctctctctctcgaatcaaagcaatttggatattgtaaaatccacatggctccaatattcaatattgcagactatggaagaaaagtacaactcaggtggagcatccatggatcgcatccatggatcaatgggaggaagcgtgtcatcgaaactggagcagcacatcttgctgtgagcgcgatcacaggcagtccagtgccgccgtcagctgtgggaggc

SEQ ID NO: 201032 - DNA, 506 bp, Homo sapiens
cgaaacaatgacgattatagttgagcaaattgtatgaaataaaatttgacaaaattagatgggactggattgtaggaaaaagtgataggctgacaaaaagtgcactcctgcctgggtgacagagcaggagtcaccctctcaaaaaaaaagtgtattttttcccctttaggactgaaaaaattgggtgttacaagattacctcaaggactggtctgagaactggggatggtaaggaagaaactcaagtggccagcctctggtttgtgggggtaggtgggcaatttctgtttcaaccaaagcagttctacttcataaattaatatattggaattgtgcttgggatttcatttggaggggaaaaaagtcttctaaacaataacactgttaattgaagagacaaagcatgcatatggcagcacgtgattaaccaccaaagtggataacagatcaagaagacatgggaagttgttatgggctagtgaggtcttgatggaagttaaggttta

SEQ ID NO: 201033 - DNA, 629 bp, Homo sapiens
gtcagtgaagtgtagggattagggaaaataattgagaaaaatgaggagaaagaaagaaaaatagatgttttggtaatctttgtcaaatgttttctcaaagaccaggctcagatttaaaatattatgcagatgtagtctttggcctctggtagtttctgataggaattcagccttgagttgaactttgagatgggttgttttcttttcgtttttttcttttttaattactaagtgaccaatctgttgtagtttgttgatctattttttcctcttgccatccttctgttgctttctccatgagctgctgtttattctggaatgttgaacatccacatttagaattaggatttgtgtggctctatcttaaccaggaatggaaaaaatccaacccagtctttcaattcatgggtttaagtggattcagagaggttctcatccacagtgacaggttcagaattcccacttctaaagcccccgtttcattaggtaatgaatatacaagctgagcccttccaggttcacactgtggaggcttctccactcctctgtcttggttggctttcttccttggggtgtttgggaagagtctgattacagccaacttctttccttgtcagttgattttataa

SEQ ID NO: 201034 - DNA, 405 bp, Homo sapiens
taagcacagaagtgagggcatgaaaggagaggagctgcgaaaacactaggattaatggattgtaggtcttcatgaggtctaaggattgttggcatcaaggacctataaggagtatgctagaaaaaagataggagaaagtagtgagagaataggatgcttgaaactgagattaagggtttttgttatcagtaatgacaaaggagtgagtggctgaggctgatcttgctactccagatcattagcagagaggtcaaaggactgagaagtatcatttggagagtgacggtgaggtagagactaaaatctctgagaacaagagtgaaccaggaatggtaaatgacaatgggtggtatagtctgatgatcacgaaaaattttaagacggaagtttttagggaggagggag

SEQ ID NO: 201035 - DNA, 533 bp, Homo sapiens
ccctgtttcttttttccattccatttttttctcaacatctattctcaaaacagaaaccagagctatcctttttaaatgaaaggcaggtcatatcattcctctgtgaaaaaccccttggtcaattcctaatttcacttagagtaaaagccaaaatcctgacatgacctcaaggcccttcataatctaggagcttattaacctctctgatggcattccctagaattgccctgctcacttaccctgatgggccacaatgacctgtttccttttctccagcacgtcagggacactggtgccttagaggcttttcacttttgttccctctgcctggaatgctcttttccaggtatcatgtaactcactccttttcctccctcaagttcttgcagaagtaaggcctcctctgaccaccctatttaaaattgcaaactgacccattcccagccctcttgctttcgcattgttcattgtctatctccctaataaaatgtaagctcctttagaccagtgatccttgtctgttttgttcagta

SEQ ID NO: 201036 - DNA, 598 bp, Homo sapiens
cgtgtacttgacggcagtgtaaaacgacggcagtgttcagcgcagtgattaacaccgagggtcgagtgtaaagcgaggtcatgtgtaaaaggatgtttgttggtaaactgagagatggagtctcactctgtcgcccaggctggagtgtagtagcacgatctcggctcactgcaacctccacctcctgggttcaagcgattcccctgcctcagcctcctgggtagctgggattacaggcatgcgccaccattcccggctaatttttttttgtattgtagcggagatagggtttcaccatgttggccaggctggtctcgaactcctgacctcaggtgatctgcccgccttggcctcccaaagtgctgggattacaggcgtgagccaccacacctggccttcagtcccaggtatcttttatagcagcgtgaaaacaagtaatacaccaggaaaactgtttcttatgaatattttgtttcaaactagtcatgtgcactgacttgtcactgattgtatttgtctctttgcttttgctattctctaggtcctagccaaatttgtgggtcactttctaccactgtacacagattgtacactccat

SEQ ID NO: 201037 - DNA, 285 bp, Homo sapiens
gggaagtgcccagacatcagtgacacacgcccaggggagacaggcagagtctgagccggaaggtggaggaactccaggcctgtgttgagacagtcccgccaggaacagcatgaggcccaggcccaggttgcatgagctagagttgcagctgcgtgctctgagcagcaataaagctatttaaaggtggggagagggagcaaaggaagagggagcaggaaggagggacagtcccgggttcaaattctagaaatgtctctttctagctgggcagccttgtgctcatca

SEQ ID NO: 201038 - DNA, 608 bp, Homo sapiens
aaaaaacaaaaaaaagaaaaaaaaaagaaaaatctgctacagagatggaaagaactgtttagacaaagacaagctatttttctaaaattgtgcgatggagaccaagacagttcaaaaaagaagttgactcactggttcaccttccagtagtcgcatcgtcagcatctagctctgccatgcagtctgagaacacaattcatcttgttgatgctattcctgctcttaaacttgtgcttgtgctttgagatgagccttattggtgagatagcaattcagttaaatgaattcaatttgttactcactctgcaagctttacctaatttcattctccacagggagagacttctggtagggatacttttgcagcttctccaagatgtttggcaggagaaatttccatccatagactgaggaaaaaggtcaacaggacaaaggtcagttatgttcagaagagattaatggctatgtacttgctttcctggggaacaaattgcatcagagtgcatagcaagattagagggagagcagagcctgtctttttctctgtatacctggagtaagaatttagacatcatgtctcttcttcaataaagatagattttcaagta

SEQ ID NO: 201039 - DNA, 297 bp, Homo sapiens
cctgacaaagaattcaaaataatcactttaaagaatctcagcgagctacaagaaaactcatagagacaactaaatgaattcaggaaaatgatacacaaacaaaatgagaagtacaacaaagagatacaaacaattaaataaaagagaaaggaaaagaaattctagaggtgcagaatacaataaagagatagaaaaatatattccatgcaaattgcagcatcaaaaagtaacagaggtggctatacttaggcaagatatagttgaagtaaaaaataaggcccacaagagacaaaggag

SEQ ID NO: 201040 - DNA, 746 bp, Homo sapiens
tgagtcaggatcgcaccatcgcactccagcctgggcaacaagagcaaaactccgtctcaaaaaaaaaaaattctagtttgttgtatgtacagaaaatatccttgagaaacaacaacagcagaagtaggaacttctagctcacagtttccaggctgtgaattgcgtcaccagaagtccacagcctgctttttgcctttgaaggttttggtgaattgattcctgctgctcagactcaaaagagtaatatacaagccaaagtgccacatgtatttataattggggatatatcgttctagtgacttgttaaaatgttggtctctacccacaagttaattcagcagccctctatgggtcacagctgacagttctaaaacactggtaatggagcttagttctttctagtacctgggctgtgaatcccttcaaagtggggggatggggagcctggaatcttaatgaagagattaaatagttttgttgtgtatttgatgtagattgctataaaacccagagaactttctcagttcatctttctaaagattagtacaactgtcatattgcataagcactaacaaattcttttactccatgaagaccaccatctctacataaaaatgtcaactttcttcaaaattacaactgtttgttggggattgtgtgttcacaaagaaattgaggaggcacttttatctgggcaacacatctggaatcacaaaaggggcagcttctgcatctgtaggtgtatg

SEQ ID NO: 201041 - DNA, 142 bp, Homo sapiens
gacaaagcaggcttggaaaattggatttgataaaagaagcaggtacctaattggtttgatgactttttgatggggggagtcaattatacagtattgttaattaatcggtcttatttttgagacacaccaaccaacttgcagg

SEQ ID NO: 201042 - DNA, 405 bp, Homo sapiens
cgagctgccaaggacgctggcctggcccagggttggccctgcagtgggtgcagagaagcagagaagaccaaaacccttggagaaggagtagggctcgggagccagtgggagctgcagcgagtgagagcatgctagtgcttacagaataggaaaacaaactgtttctcccatacactctcaaccctcaacacagaacacttctgcaaccagatgtctagggtttttccctgcaccaagcaattctccaattgtctgtggacatcgactgggtgtctacagttcatttcaattctgacactacccagagctactgcagactccacccgttaagggcttagttctgcaatgctaccccccagttcagatgccaatcacaagtcccaggttttcacctgtacctctttt

SEQ ID NO: 201043 - DNA, 254 bp, Homo sapiens
tacagtcaacatttcactaataattctgggttaaaactctcctgagagccaggaggttgcagatgagcagtagctacctgtttctttggggtttctagctattaaggcttctctacagaggctttttctctaaggcaaacgtaaacctttggtagatttccttactaaggagtacctgtttcttgctggttgcaatggatggagaaggagatgggtcctaatggacctggcacactttaattcaggtgtagtac

SEQ ID NO: 201044 - DNA, 713 bp, Homo sapiens
tgatgagttatatatagtagacaataatggagagatgccactgtttgacatcactgggcaagactttgaaaataagcttcgagttcctcttcttgaaatactgaaatatccttacttgcttctacatgaacgtgttaacgagttatgtgttgaagcactttgtcggatggaacaagccaattgctcctttcaggtgtttgataaacatccagggatctatttgtttttagtccatcccaatgaaatggttcggcgttgggctatcttgactgcaagaaacttggggaaagtggacagagatgattattatgacttacaagaagttttactttgcctttttaaagtcattgagttggggcttttagagagtccagacatttatacttcttctgtcctagagaagggtaaactgattcttctgccctcacacatgtatgatactaccaactacaaaagctattggttaggtatttgcatgttgctgaccattcttgaggaacaagccatggattccctgttgttgggctcagacaaacaaaatgattttatgcaatcgatacttcacactatggagagggaagcagatgatgatagtgtggatcctttctggccagcgttacactgttttatggtgattctggatcgccttggatctaaggtctggggtcaacttatggatcctattgtggcatttcaaaccattatcaacaacg

SEQ ID NO: 201045 - DNA, 349 bp, Homo sapiens
cagacgtatcatagtattgcttgcaaaaaatcttgaaaatgtggctgcttttgaaaccctctgtgtgtctgaggactggtggcggcactgctttaaattatttgctccttggcttttagttgggttgctactcaccagataaagaatatgcttaattctcaatatattgtagtatgtttttctaactgtttagtaattcaacgattgtgccattgtatttcagatgatagtgtggatcctttctggccagcgttacactgttttatggtgattctggatcgccttggatctaaggtctggggtcaacttatggatcctattgtggcatttcaaaccattatcaacaacg

SEQ ID NO: 201046 - DNA, 204 bp, Homo sapiens
ttttatttatttacagaatagcccaaggagcctaatttagggaatcttgataaggtgataagatttatgtattttacttatttttttctttttagacgagttatgtgttgaagcactttgtcggatggaacaagccaattgctcctttcaggtgtttgataaacatccagggatctatttgtttttagtccatcccaatgaaat

SEQ ID NO: 201047 - DNA, 659 bp, Homo sapiens
tgatgagttatatatagtagacaataatggagagatgccactgtttgacatcactgggcaagactttgaaaataagcttcgagttcctcttcttgaaatactgaaatatccttacttgcttctacatgaacgtgttaacgagttatgtgttgaagcactttgtcggatggaacaagccaattgctcctttcaggtgtttgataaacatccagggatctatttgtttttagtccatcccaatgaaatggttcggcgttgggctatcttgactgcaagaaacttggggaaagtggacagagatgattattatgacttacaagaagttttactttgcctttttaaagtcattgagttggggcttttagagagtccagacatttatacttcttctgtcctagagaagggtaaactgattcttctgccctcacacatgtatgatactaccaactacaaaagctattggttaggtatttgcatgttgctgaccattcttgaggaacaagccatggattccctgttgttgggctcagacaaacaaaatgattttatgcaatcgatacttcacactatggagagggaagcagatggtaataaactttacttgctgaatgttgttgaatatagtgatgatgatgcactttaaaaatgatagtgtcact

SEQ ID NO: 201048 - DNA, 520 bp, Homo sapiens
gcagtatagcattgatacaaaactgtatttacaagaaaaccaattaaaaattaagggtagtgtgcaaaagtagacaggagagtcaagacatatcaatgcagggattgctatgcttctttctagtcatcttttgcttcaccattcaatttttccaaaacttaacagccttggtgccaggaaaactttgtttacagtcatcaccatcataaatggacattcacaatcttctgatacactgcaaccaatcatatagttttttctttttttgttattgttttgtttctgtttcctgttgttttgccttctgttaaaactgtgaagaaacttttggtttcattgttttcaaaagtttgaaggtaccacacacctgatttgaaggcaaagacactcctctagggtgtaaataacacagagtgaggaaatgtggattctactctcatttctgacattaactatctgtgagacttggagcaaaacactctcactatctctttgggatcacaaatttacctcagtagta

SEQ ID NO: 201049 - DNA, 215 bp, Homo sapiens
ctgctcccaaggacacataaagggagtattttcaccacccaggacagtagggacatggtcaaaacttaactaactattgaggctgccacattggctggaatatgccagctggattccacagaggccccagactgaggcactgcctatcaagtggctgcaactcctgcttggaattgtagaaatcccatgctgacatcagaggtgcacagagtatg

SEQ ID NO: 201050 - DNA, 313 bp, Homo sapiens
actcattgtatcttctccaaaaatattttatttccaagcctggaaacttgtactccatattctgttttataacttcctgtaccagtacatcagccagagtcttgaagtccactgcaaacttcttttcttttctttctctctcttttccttccttccttctttccttccctctctctctctctctttctttctttcactgggattacaggcacgtgccaccatgcctggctaatttttgtatttttagtagagacggggtttcaccatgttgcccaggctggtctcgaacacctgggctgaagggatctgccca

SEQ ID NO: 201051 - DNA, 2219 bp, Homo sapiens
  misc_feature (587)..(587): n is a, c, g, or t
  misc_feature (1427)..(1427): n is a, c, g, or t
  misc_feature (1479)..(1479): n is a, c, g, or t
  misc_feature (1529)..(1529): n is a, c, g, or t
gaaaaatatttataaaatattttggacaaactcaagtgattcacagatggccttttcacttctgtctagcccatgggttggaaaactttttctgtaaagggtcagatagtaaatgtttgaggttttctggtctctgagacaactactcaactctcccattatagtgtaaaacagccatggaaattatgtaaatgagaggccgtgctgtgttctgacctcactttataaaataggcggtaggtcctggccttagtttgctgtccccactctgccctgtttacatgttcagttgaattgagtcttctgtttcatggtagttaagagggctgtttatttggctgttatatgaggcatcccatcctgtccccattttcccaccacccatgaagttatattgtcctgcttgctggtaaatatttaacaactagtgctctgggggaaattatttatagatattgacatatcacataagttcattataaattttactgatataaaggatgttagccaacaatttacaaataataaaatatacattgcttgtattataaattccatttagccagttgattctcagagactgcttncattgatttttgccgaattctggttccataaccagccgatggctgccatgcatgaacagttgtctttccagcgtaaatattgggtaatatttttgccacagaaacaacaaagacatatgtcagaacttcattcactcaccagggatgggaacaacttccttgctaaattggaaaataattttcaaatactgaaagaatatctcttcagttttgtatgctgttcacagtgtaatacctacagacacgaaacacttttaagttatacctgcagtattaatgctttctccatcactttcttaagcccagaaaatcaacagtaaacccagcccttgtttgtagcatttgtcgatttccatatgggaatatcccgccatggccaatttcaagctgctcacgtgacgtcactgaagacgggttggtaaaagaggggtccagtagccaccatgagatagtgcttcccctgtgtagatagaacagatgtgagtaaccctgaagcacagataatgacaaaatatagtgagatcatgaggaaggggcaatttgtgaatattcattacctttgtttttagtataatttattcaattgtaagcttctataatttaatgtttaataaagactgtgtttaacaaccagctcacaaaggttctgaaaatgttcacaatcagttccgttaagccagtgctggtcggctgcagcgcaccactgcatattgggaattgaacgggtagagggttgtctttctcttgggacaagcacactttaaggggagcgtattcattgcaggaccaaggctcaacgtgcactgctccccacccgtcccagctcctctttatgcttgngggggccagccactctccagtcctccccaggaatatacgtcgcaaccaggcnttcttttttcattggcctcattcttcccagggccggctcagaggcccccnggtctaattgccattggtttaactgctgtttaataaatcaaactatttttctgactaaatcttgctaatcagtaaatagtgatcatctgaattctccatatgctaaaaagtcatttttccaaggggtaaaattaaagtaatatttggcataaaaaaattctaatacacaggcagacacctttatgtctaatatctcaactgtagaggttagataatcacagagtgctatactgtgttatagccttaatatgtagagtgcttacagatcactaagaaatatttaaataatatcactaaataggccaaaatcctgaaaagcaattcgtaaagaaaacatacaaataaccagtaaacacaagatattcaacatttgtagtatccaaataaaatataaactaaaggccaggtgcgttgtctcacgcctataatcccagcactttgagaggccaaggcaggtggatcacgaggtcaggagttggagaccagtctggccaacgtggtgaaaccctatctctataaaaatacaaaaattagccgggcatggtggcgtgcacctgtagtctcagctactcgggaggctgaggcaggagaattgcttgaaccagggaggcggaggttgcagtgagccgagattgtgccactgcactccagcctgggcaacagagactccgtctcagaaaaaataaaaat

SEQ ID NO: 201052 - DNA, 321 bp, Homo sapiens
tcttcaatttcttagaaatagtttgagtaagattggcaccagctcttcttcatacacctggtaaaattcagctgtgaatctatctggtcctgggcattttttgttgggagatttttctactactgattcaatgttcttcttcattattggtttgttcagggtttctattaatatttccacctggttcaattttgggagtttgtgtgtttccagaaatttatccattttccctaagttttctagtttgtgtgaatagagatgttcatagtagtctctgatgatgtttcatatttctttggtatcagttgtcatgtcacctta

SEQ ID NO: 201053 - DNA, 773 bp, Homo sapiens
agtaattttcctggggagttttgttttcagtgaaaatcagcaaataatcattgcacactttctcgtagaaaagcaacggtgagtgatgattgcagttccctggtgattggtgaaggctctcagggctgcctgaggatgccagggctcgggagggtgcattctgggaggtgtcactggagaaatggcatctgagctggactctgaaatagggggtgattcccagggccagggccaggggaccaggtgggaaggcgggctggagggtgggagtggcctcggtggatgcaggctcggccgggcctgtggggaggtgtgcctgtcggcgagtacagcaccgtggacgggagcctcccatgaatgaggaggagcaggaatgggggaggcccaaagagcagaagcaggaagggcctctgagccagggctggcaccttaaaagcgaccctgggggcaggggagaggggaagggtttgtctattcatgggttctgtctgtcccacctgttcccaagaggactaaaggcagccagcaaggtctgtgtcccttcccgctggaaggccagggtcctggtggagcatgcgggaagccttaactacactgtccaaagcaaaacacacccagcccgataacagagtagaaattcagactcccaccaccttcaccacctcctgcacgtcccctcaatagaaaatggaaaagtgaaagtcggggctggaatctccgcaagccggtctgtccatgacgtgagaagattctgcctttcgaagccacccccg

SEQ ID NO: 201054 - DNA, 330 bp, Homo sapiens
caagtggtagctgcaaataagcccacgtgagttgcactgaaaggatcagggcactggttctcgaggactgggaatgcaatgataaaacgaaatctcaccagcactcagtaaagccagatccaatggcagccttgggctggtcacccctaaaccgccatgtgtcagtcgggttccgcctcccagaagcgggttaccctgatttgtgagctgattattctagaagactccagggtctgaaagtatctcaacaggttggctatgtaaaaacacagtcaatcaagcagccagacactttgcagagagactccactccacgaagaattacaggag

SEQ ID NO: 201055 - DNA, 731 bp, Homo sapiens
ccttattcttttgttaggaaggtcaggagttgacactttgccatctccacattcaaagagaggtgccatgttgtattccatttcagctcttctgttctgtggttgtgtctctctctgcatactcccatcccaccccagtgttctatttactccagatgatttcttgagaatgtgctcatccttaggttttgtagtattttgcagagaatcttttcatgacaaaaggagaactctccatgtagcccactgagaaactgttagtgaagaaaaaacatctttatctcacaacacagaagatgcaggagagcagcagcctggtggtgaaagtgatgaatcagctcagatttacagattcttggccccaaaatagttcattttcaaaatatattattcagagcaaggcctgagcaagagaaagaattagagctgattttcagctggagattttgtgcccgagaagaaagcctgcactgatttgtaggcataactgaccttggtaggaatgtttgattttcaaatgcagagaaggccatctgttggttcttgagggtaggggaaagaggcataatgatcatctttacagcatgctgtactttatccttggtcagaaacttttgcaggccttgtgccaattcttcagacactatctttacatcggggagtcaaaacttggaggttaaagtaatggctcaaggttacccaaggaattcatggaagaagatagactaaaa

SEQ ID NO: 201056 - DNA, 479 bp, Homo sapiens
ggaacgggtagggtgaaatgggggataagatgcaggtctgctcagcttgggtaaattgcttttcctctttcctccaccctgctgacataaattacagccttttggtattctccagggcagaattttctgaccatttccctggcttgcaaacttcaaagtaaacttctacctaacttaggggaccaatgctctaaataaaactttaattttaatgtgcatccgaattaccaggaattctgtaaggagaataaaactttaacgtgtatacagacccccgggaatcatgttctattagagattctgtttcagtgagtctgggtggggcctgagatcctgcatttctaacaagctccgaggtgaagcccttacaggccaaaggaccacagattgagtaccaaggctataatgaatagcttcgccgtcactgcagaagttggaccaagtttaggcccctctctaagcagcagtacttaaaggaa

SEQ ID NO: 201057 - DNA, 475 bp, Homo sapiens
taggcttctgcatgtagctcttctcttcttggctcccaggagctacagggggaggactctagtctgtcactgggtggaggagaggaggtcaccacagtcagcaaagctcttggctgctccttaccctgagtcccagccgcagcctccttggggctgagcctgtgtccctgggcatactctgtcttgcacatacaaatgcacatatactgttcacagctcaagctcagagacacacagccacttgcacacatctcacagacccatccagtgactcgctggtgttggatgctttcagaagcacgcctccagacagattagagaggatactcactcagagaagtgcacaaacccatgcagccacacaactcccattctatcacacgcacacatcaccaaacagacacaacggaggctcagaccctgctgcaacccccacgtcagaaacacattctcatatacacatcttacccctaga

SEQ ID NO: 201058 - DNA, 393 bp, Homo sapiens
gggggtctggagttcaaaatatctggtttgatcacacatctacagcataattgctttggacctagggttgtttcttaccctttctgggcctcagtttctttatctgtaaaatcgagaggtaataatagcctctacctcatgggttgatcagataatataaaaataacaccgggtaagtgtctaacatagtaggtactcacacagcagtaactcctcctaacgcattgatccaatcctgtttttcttctcccagattctttctttgtagacccctgagcaccccatggatgtattttctcacgtcttggctgggaaagtgcacacactcatttcattactgcagctttttgcatttcattaaaaaacttgacaggccatttcataataatttat

SEQ ID NO: 201059 - DNA, 458 bp, Homo sapiens
gtcatctcggattagggctcaccctaatgacctcattttaacttaattaatccaataaagatccgatctccaagtaaggtcacattctgacatactggagtttaggacttcacatatttttttgtcgggagaggggaacacaattcagttcataatagatgggcagctgggcacggtggctcatgcctgtaatcccagcacttcgggaggtcatggcaggagaattgcttgagctcaggagttcaagcctgagcaacaaagtgagatcccatctctgtttaaaacaaaaattgaaaattatcttgttgtggtggcacatgcctgtggtcccagctacttgggaggctaaggcaggaggatcccctgagccaaggaggtcaaggctgcagggctgcagtgagctgtgtttgtgccactgcactctaacctcagtgatagaataagaccccatctccaaa

SEQ ID NO: 201060 - DNA, 594 bp, Homo sapiens
gaacactaagaatgacaagacaggcaaaactgattggatctgttaaatgattaggtgtgtgggaggggagttaaaatacaaactatgtttaaggtctcacagttagatgacaggtagaatgagtgctaataaaaaccaaacttatatgtgggccacacacagttctaaagactttctgtatattaaatcattaaaacctcacaacaaccctatgaggtaggtacttttattaactgtattttacagatgaggaacagaggcccaaggtcacacaaccagtaagtgctggaggcaggaattaaacataggcactatggctacaaagtccagactcttaactactatgctcatctgtccctataatgacaacaaacgaaacaaacaaggggaaaaagtctagcggagaagagattcaagagagagaggtaaggattcaggacacatctgagagggacacataaggtggatgggaacagacactttcactcaataacaccttggtctttggaggtttaatttctatcattaaaaaagtgattctaacatttgcctgagcaatgattgtcagggctgtggataagatgcatgtgttta

SEQ ID NO: 201061 - DNA, 161 bp, Homo sapiens
cacctgcatacaaatgatatccttattggaaaaactcagggaggccatgaacaaagaagcctagcatggagacagggccagtgtcaggggacacaaaaaatagaaactttgggagcaggtatctccttggtggtgagccagcggctctgccctcctccttc

SEQ ID NO: 201062 - DNA, 435 bp, Homo sapiens
gtttgtccctttgctcagactggactgcagcatagctcccaacacttggttggagcagttgaggagggtgaatcacaatttagtgatttaaaaaaaaaagtgaccattttttttggaggcggggccaagatggccgactggaagctgcgtgttcagaggctcccactggaaaaaaaatctaagcatgtgaatccttcatcagcaaccaaggtattcaggttctctcgccaaaattgacaagaaggctggcctgaccacagagagaaggaagagcagtgtagtgagaaggcccacctgagagccacacggggaaggggaagccccttccccaagccaaaggaggcggtggtgagtgagtgcgctagggaaactgctttttccacagaaccctgccacccatggattggaagatcccactcgtgaacccacgccacc

SEQ ID NO: 201063 - DNA, 424 bp, Homo sapiens
tgagatggagtcttgctctgtcacccaggctggagtgcagtggcacgatctcggctcactgcaacctccacctcccaggttcaagcgattctcctgcctcagccccctgagtagctgggattataggcgcatgccaccacgcccagctaatttttgtatttttagtagaaacagggtttcaccatgttggtcaggctggtctcgaactcctgacctcaggtgatccacctgcctcggactcccaaagtgctgggattacaggcatgagccaccacgcctggcccaaaaaaaaaaaagatatattattaattcctcttaggatcagctttggactcccaaggttaacccaacaatgtctataactgttgctcattattttaataattttaaagatttattatttttctggaatgcaacgagacag

SEQ ID NO: 201064 - DNA, 892 bp, Homo sapiens
  misc_feature (35)..(35): n is a, c, g, or t
ctatagctttcatcagattctccaagggaggtctntgcaccataaagagctccaccgagactcaccaccgacatacttggaggaagatattataattatagaggacacaacccatttactgaataatctctcagataagctgatcatcatctaacagagaagagcctactgagggagctgaacatagtgctgctatgggaaaatgacttgattctttcacccattcgattaataaatctttattgagcactgtttagattctaggatatggtactgcacaaaaaagagaaaaacaattcctgccaagtagattgaagctttcattccagtgaggggagtctagctaggaacaaaacaaatgagtgaaatatttagcatgttagaagaggttatgtgccaaggagcaaagcgaggcagaactgaggggtaaggaaggggtccaacgttaaacagaatcatagaggaaggcctactaaggtgatgtttgatcaaagacctgaagacggtaagggaccaagccatgcagctacctggggaaagaggattcccagcgaaggaaacagcaagtgcaagggcctggaggcaggaacacgggtaggatgtttgaggaggctggtgaagctagagtgaaatgagcacgggagaaggtcagaagggaaatgcgggaggggaggcggtgggcagactgtgcactgtaagatcattataaagccttgacttttactctgagtgagaaaggaagctatcagagaatgttgagctgagaagaatcttgataagacaggtttaacaggctcactctggccgctctgtcgaaaacagactgtaagaaggcaggggtgaacctgttaaacctgatccgttacaccggggatactcaggatcagctatg

SEQ ID NO: 201065 - DNA, 200 bp, Homo sapiens
tctaaaagataggaatgctaattcagtttttggaaaaggctatatgaaaaatgaaacctttcctgtattctttgttttatatttcatgctatctcacatgtatacaattctcacttcagtatactactttaggcataataaagatttaagaaagatttattaaataggtctcctgaagttgtttaaatcaaacacgaatt

SEQ ID NO: 201066 - DNA, 711 bp, Homo sapiens
aatttcagggaaattaatgaagtacatataagtgcttgatttaaatgtgtattttattcaatagtttgagtatcttgccatggaagatactagcccagcctagcagaaaagtgcaatatgtataatatactttcgcattttaaaagttatattccctatccattttgaaatgctagccaaactacatgaagttatttgcaattaattgtaagctaatcaggaattttgaaagcttgattggattaacaaactataatgttgaaatttggtaaaatcataatgttaatttttactgtgaaacgttttcttgtaagatagatatacacatcctagtttaattttgtgtcttagtgtggatttacaaatttactacagttattctgagcccaggaacccaatcagatttcaggccagtttgatactggctgttcttaattctaacaggagagtaggacatcatactaaatgttatgtcagtgggactgtgttgtctttggagcttagtaaattaatcattttcttcagactttaaggagagtgataaataaaatttggagtcataggatatagatgtacaatttaaagattaaactttttttttttttttgagatggagttttgctcttgttgcccaggctggaatgcagtggcatgacctggactcactgcaaactccacctcccgggttaaagcaattctcctgcctcagcc

SEQ ID NO: 201067 - DNA, 444 bp, Homo sapiens
agctgagggaggtcaaatacacagaggcatatttcttggcttgaactgcaaatcttaaaagttaataagactatcataattactgaactgacacgtactactgtccttgtctggtctgcaaatcttacctcaaaaagatccaaatggatattttgtcagaaggaagagaagttgcataattcacctaaacatacaaagaaagctggcattcaaactgagaggttctgtgtctaccttccttaaggtatattatattaggaatgttagggtaaaatgaaacaatcagaaatccctccttatggaaatattacagcaaatgctgtaagaacgcagaaagaacacaaacctacttttgcttaattttatattaaaaaaatcatttcattaatacacggtgtatgtcaattgtcattactacttttttgtcagtgggtgaggaaagca

SEQ ID NO: 201068 - DNA, 350 bp, Homo sapiens
caaaagcagttcctgcacggtcatccggagcttaaaattgggtggtggtataataaaaagttacctctatacctctagtttcacaccaagtgagataaagtttagaagaaatctgaactacatccagaaaataaatgttcttctgggtgaggaagaaaaaaattatttccagaaaaaagtttggaagtcttggtctcaaagactgctgttatcaatatcaaaatatcaattcatggaaatgaaaatataaacaaaaactatcaccatttcttgaacagccactgtgtgctcctggtgtacatcctcgcaccgtcttcacaatccattcaaacatctgatcagtgtctcaa

SEQ ID NO: 201069 - DNA, 499 bp, Homo sapiens
cacgcaccccccgcaggcactgaaacacccctctcctgggccctcattgggtatgcaacgtataggtttgtgggtagagtgtggttcccactgagctatccttcaaggcaggggattctcggcctgggctcttgggaaaactcgaagtaggagggccaagttgtttgggaaaagtaacccgagtttcaaagggctgacaggacttccgtcctcttttttttttttttttttttttgggacggagtctcgctctgtctcccaggctgcagtgcagtggcgcgatctcggctgactgcaacctccgcctcccgggttcaggcgattctcctgcctcagcctcccaagtggttgggactgcaggggcccgccgccacgccgggctagttttggtacttttagcggagtacgggatttcaccgtgttggccaggctggtctcgaactcctgactttgtgatttgcctgcttcggcctcccaaagtgctgggattacaggagtg

SEQ ID NO: 201070 - DNA, 573 bp, Homo sapiens
agtgaaaacagtacttgaatttaatcagacacaggaagaatgtgtggtcaagcttgtgagaacacactatgagtgtaaacagaaaactagtaccttgagcagggaagtacatggcttttagtaacagcatgggaacttttctggttacatggaataattcagacacattaagaaaagccaagtgtacagaatcaagttatactggaggaaaacattgcttttgtaggccatcaagacaaacattttagagttagactttaacagcagagttataatcagaggaaaaaagtgacaggagctgatgaaaaagttaaaagagagagttatcacctcaatcaagattaaaggtgtactttctcaaggggagaaagagttgaaagcagtgatgtatgacatgcagtaagatgcagcaaacattaaacttctgagatataagtctgagaagctttaagaggaaaactctacctcaagaaatgaaattaccatcctaagtgaagaagacagctttactaacgtgaaactagaaaattaaatgaagactgtgaaacagaaaaaaaaaacaacaaaaaaaac

SEQ ID NO: 201071 - DNA, 741 bp, Homo sapiens
gtgaaagatatttttaacaggatgaaaagacaagctatagcctgggagaaaatatttgcaaatcacatatgtgacaaaggacttgtatccataatgtgtaaaattaaaaaaaaaaaaagccaaacaactcaatagttaaaaaaactgaacaaagcaatttaaaaatgggcaaaagacctgaacagaagatatacagatggcaaataagcatatgaaaagaagccaaagaagatatacagatgacaaataagcacatgaaaagatagtcatctgggcgtggtggctcaagcctgtaatcccagcactttgggaggccaaggcaggaggatcacttgaggtcaggagtttgagaccagcctggccaacatggcaaaaccctgtctctactaaaaatacaaaaattagctgggcgtggtagcacacctgtagtcccagttactcgggaagctgagacaggacaattgcttgcacctgggaggtggaggttgcggtgagccaacatcataccactgtactccaacctggatgacagagtgagactctatctgaaaaacaaaaccaacctacccacagaagaaagaaataggatcgtgaaagtgtgattaccaaggatgaggcatgtcttaggtaagacctgtttgcgaagtgatgacagattagctctattaaataaagaaggcaagaacctatggagaactctttacagagcatgtattctaagcgtaacactaggatttccat

SEQ ID NO: 201072 - DNA, 698 bp, Homo sapiens
tctaccgatctcacatctgctccatcagcaccccttttaagtgtacagactgatgagtttggagcaaatgtatatgcctatgtaaccatcgcttcaatcaacacctcaaagaacattccctcacccaaagagctccctcatgcccttttgcagtcaactctaaccctgatgcctctgatttctatcactaccatctggttttacctgttctaggactttgtattaatggaatcatacagaatatgctcttttcttttatggctccattcacctcaatatgatgtttctgagtttcagccatgttgttgctaatatcagtggtcccttcttttttgctgctgagtagcattttgttgtataaatgcaccacaatttatctgttcaccagctgatgaacatttgagttgtttccagtttttacttgttacaatcaagctgctattaacatttgtattacaggcctttctcttgggtaaatacaaagaagcagtacgacgggccagagggtaagcgtgtttagctttagaaattgcgcaaactgctctccaaagtagctgcacctctttatactcccaccagccatgtctgacagctctagttgctccacatcctagccaacatttgctattgtcagtcttttacattttagtcatgctgatgggtgtgcaggtgtgcctcactgtagtttaatttagaag

SEQ ID NO: 201073 - DNA, 322 bp, Homo sapiens
tttaatataatcagtttacacaaatgtgaaataaaactaagtagagctggtattcatttacacataattatcttataccatttggaataagaatttggggcacgttagcaaaccaaaaggctcagaaagaagttgtgatatttagttcttgtctccctctacaaatgtgaagcactcttctatccagcattcctagtggagttcctattttcaaatttgcaaatcattctggtcctaagcaatctcaaaaaaacatttctaaaaaccaaagaggaaaaaaatccttttttttgtgtaaactgattgggatccttagagtcga

SEQ ID NO: 201074 - DNA, 232 bp, Homo sapiens
agatcacaatcaaaatcttcatgatctgttctgtaacagcttccaatcacctcctttttaaattttttttttttagatttttaattttcatgggtatatagtaagggtaggtgttattattgtccctcctatcttacagatgttaaggtccctaaagtgacacaggcagtaggtggcagacctaggactgaaactcaagcagattggttccagagtccatgaaaattaaaaa

SEQ ID NO: 201075 - DNA, 468 bp, Homo sapiens
agtgaccacagccccaccccaagtacagatgacagtattcactgatgtggatggttgtcatcttttgtgtgatgtgtgaacagaagtattgtagacagctctgcctttcaaatccccccgcggagctgaaccagcttctgttgggccagaaacttagacaatttagggggccctctttaagaaaatacaaactttgccagatgtggtggctgaagcctgtaatcccagcactttgggaggctgaggcttgtggatcacctgaggtcgggaatttgagaccaatatagtgaaaccccatctctataaaaaatacaaaaaattagccgggcgtggtggcgggcgcctgtagtcccagctactcaggaggctgaggcaggagaatggcgtgaacccgggaggcggagtttgcagtgagtagagatcgtgccactgcactccagcctgagcgacagagcaagactccgtctc

SEQ ID NO: 201076 - DNA, 261 bp, Homo sapiens
atgacgtcacccaatcaacacttacagggtggatttttagaaaagagctgatctccgttaccattatgacctagaaagcatcaaaacaactttactgaaatgtccaggcatatgatagaaaataccaaaacccacctgaagctttcagaatgagggaacatctctagcccatattttaggtctgacaacaggtatctaagagcattttgttttttcttttagagataaggtctcactatgttgattgggttgacgtcagac

SEQ ID NO: 201077 - DNA, 477 bp, Homo sapiens
tgtatttcaattggaaataaacaatgaattattttttagtatacatatgtcccacatgttgcatggcacctatatatactagaaaattatttgttgttgatctgaaattcgaatttaactgggcctcctgtgttttatttgatagtcctaaaacctagaggacctgtgtttaaaaatctgtctgccctatcgcaaggacagaaaaccaaacaccgcatgttctcactcataggtgggaattgaacaatgagagaacacttggacacagggtagggaacaccacacaccggggcctgtcgtggggttgggggaggagggagggatagcattaggagatatacctaatgtaaatgacgagttaacgggtgcagcacaccaacatggcacatgtatacatatgcaacaaacctgcacgttgtgcacatgtaccctagaacttaaagtataataataaaaagaaaataaaaataaataaat

SEQ ID NO: 201078 - DNA, 534 bp, Homo sapiens
aggttctgctttaatagatctggggtggggcccaggcattgctattgtttcaaaggtcccaaaggtgattccaatatgaagtcagggctgagaaccactgatataaatgtttaagacctgaacacctggaccacattctttgcgctccagtaaaataaggaacaccagggcaaatgtggcaactttatttactataaaaatgttgctcattgtattccacaatgaaagaaatttctttctagtatcagagacatgaagagttatacaactcctgaaaaaaaaaatgggtttttgttgcacagacactctgccttgctcctaaaatctttacaggcaaattcatggctaatgtttagcaaatgtggcatttattttgtggacaaacctcatgccattttttatcttttattgcctagctttgttttaccctgtcaccaaaatcctcattttttttcatgaatcacaagctgtctttttttttttactagtcttcttaaattattttggcagctatttgaaatgcaaaaaaaaaaa

SEQ ID NO: 201079 - DNA, 436 bp, Homo sapiens
gggacaacagaaaacttcccaacactccacctcctcctcgggcgggaccaaggcctccgtctcgcgcaccgcctgcatgaacacccggtccaccatccgctggctcttggccatgacctccgggaacggggagcgcccctcgcggccccgcgccgtcagcacctggcgcccgtcgtccgggtcggcctgggtgcccaccagcacccgcgggacggccccgggttcccacggccggcgcaggcgcttgctcggcggcctcacggcccggaacgaggcctcgctgcacacgcccgggagcaccgcggagccgtcgccgtggcggatgtccaggtcctggagcgtgaccaggtgctcggcgcccgccgcgtccacgacctccagcaacgcgggcgccgcgttcgcctcgatctcctcgcggagccgctcctccgcccac

SEQ ID NO: 201080 - DNA, 824 bp, Homo sapiens
tcagcctcccgagtagctgggattacaggcatgcaccaccaggcctggctaattttgtatttttagtagagacagggtttctccatgttggtcaggcaggtgtcaaactcccgacctcaggtgatctgctcgccccagcctcccaaagtgctgcgattacaggcatgagccaccgtgcccagcctacaggtgaattttttaattagcttcaaattgaccgacattaaatgttagacacaagaacgggctacactccatgccacatgaaatgcaattgagttgacgtgcaggtctgtcagaggcaggaaacaaactatatatgaccttgaaggaagagttgcatttgagcagcgagagcagagggggaggatggagcagtaagttggaagtacgcaagtgagcaaaggaattgagaatcaggggaaatggagaggagtctttctggaatgtgatgaattgaaaggcaatagcttctgataggatctaaaatgtgggttaggaccagatcacagagtttacctggaggactgtgagtttggcagaggcaagggaagccattggagatttagcaggggaatggcagagtctaaattcatttgagaaggagtcccctggcagcagtaaatagggcaagtggttaggaatggggagaatcttgctggcactcatgggaaacatggtggcctcagcatgctggctgcggggcaggaagggcagatccggaggaagctttatagaggaactcagctgcactgtgccatgccgaaggctactggctgcagagggctgcaagcactcgaaatgtgactgggtcaaattctgaa

SEQ ID NO: 201081 - DNA, 197 bp, Homo sapiens
gtagtctagagtatccccaagcttcgacgtgtaagacaactcgagtatagatcgtttaagaattttacgaggccaggcgtggtgacacgcacctatagtcctagctagagtgagatagagtgagaccctgacttaaaaaaataaacaaataaataaaatatactggaatttaatttataggtatgaatgacacagag

SEQ ID NO: 201082 - DNA, 510 bp, Homo sapiens
ttgtcggaggggattggtgaagggattggtctaggtgacctgcagagtcctttgcaattctcagatgccttcattctccgattgcttgttcacatgtaaaaactcataatagtcattttgagccattctgtgtgtgtgtatatctatatatagtgttatatcatgattgttattggatcacattgacgtatgttacaggaagtaccaaggttggaggttacagaaagttagaactaaatttgagctttttaatgattagaacatatctttgcttcttaatcgttatactaattttccaaattcaactggttttattatatgtgataagaaacggttacctattcttagttggctctgccttttcagtcactttttatcaaatatctctggctcaccaggagacgagtagtctagccatatgtaaataagtagaagtttcaggcctccctgagcaggaaggtaaagtccagtgatactgacatatccttcctactcctccccttccccacc

SEQ ID NO: 201083 - DNA, 590 bp, Homo sapiens
agacttgcggaaattatgtttgagaagagcagctggaactggagatagttttgagttccctggaggacacaataagttctgaaggggggttagagtcatgtggtccccatgaactctcaaaaccagtttaagctccattcccagtcaaagccctacaccaaggagacactgctggggatagaatccacattaaacaagatggagataatgagggcaaaggaaaaaatgtcagatgaaagtgggagaagataaaagcacaggagatcttattcatgagtctatattttgggatccttcatgaaaagggaagagaactcttattgaagtcagaaaagctactccagtttccccaaagttttttattttacataaaaacgagcagtggacagggatcatagtcaaaatccccacagagtttttataagagaaaagcataaggagccgaatattattactgcagacaatgaaagcatgccagaaagaaatgtccacaaaataaatgaaactataacttgtttcagaataatcccagagaaatttagaaaatgatacaaacactaaagcacaatgtaaatctgaataaggaaaaa

SEQ ID NO: 201084 - DNA, 614 bp, Homo sapiens
agttgttggcagtgtgatagtaacgggaagtgaagccactcaaaaatgcttttgtcagacttcaactcacaacccagacctttagagcagggggaaggtctgccccttcccctcatcggctccctggcttggctgctgtgcccttggaagggagggccttggtgtgggggagcagaggtggaatatcccccagttcccttatttggccccaaagggtcttattgatgggaggattttctaggcatgtaaaagtgagttcgaacattcagacttcactgtttgatttgatttgtttatgcctgggaatcctttgtggctttttgtcaataggctgggagagggaacctagttggactccagctgtccggggtgggggcttcttagaacagccccgcagccctctcggtgcatctgtgtgatgttgtgtaggactttccccttcagagtcctggggagcattatttccaccctgtgttggatgcaggacaattcatacacattttgattctcagtgattacactcttgagagagagaagacagacttacgatttagatacagctaatttacttaggggccctacctgaatcggttttcatcctgtaaaattctccc

SEQ ID NO: 201085 - DNA, 546 bp, Homo sapiens
agtaagttacagggtatgtctgccttaccagttattcacaaaaacttatatgaaacgcagtcctcctcagagtcattcaggaatacaaactgaactgtgtccgtattatatctttcattaaaagacactgtaaaaacagatacatggggttcaggaaatgtgagggtcacacaggggcacggaggccaaaatccaatggagaagtgaaacagccttttttccaaaatcaaagtagcactcaaaaaaaccgtagtgcataaagaattgacgctgcagtttcattttttatttcctcctgctgtggacagactgtttcgctggcggaatgtcggttacctaggtgacagctccacagccatggcgactgctccaggccccacagacgctcagggccgagccccggcctgtggatgccgatccctggccactctacccaccagagaagttccagggagaaaggaacgctgccaaccaaagaggtcattctaaacctcggcaaactggggctctgctgcaaaatttaaaaaaaataaaaatgaccataaa

SEQ ID NO: 201086 - DNA, 324 bp, Homo sapiens
atcatagtgattaacagtaagtcttgtttgtttgtcaaggatctctacttcttgacacaaatgaaccctgtctttaataagataagatatttatttttgtagatgagaagtgtaactaccaccttggacctcagggccctaactaattacagctgttactggacgactcagactttgtgcctaaagccatcttagagataacagtttatagaagccatgacattagtgtttattgcattgaattaagcccagtgatataactatacaagaaaacaagtaggggtaccttttacaaagagcaatccaataaatcttaaaaataac

SEQ ID NO: 201087 - DNA, 221 bp, Homo sapiens
gatgtgaggtcactccagaggatccgatgagtgtggctggagcctaacaggataagaggagactggaaccagatcatgcagggtctttgtggctcttgataagaaattgggttttattccaagtttaatagaaactctccaaaaggtcctgaataggtgagtgccatgatctgatttgcttccatgcggagaaaggactagatggaataagaaggttgttg

SEQ ID NO: 201088 - DNA, 1991 bp, Homo sapiens
ttcccaggacaagatggatttattctaataaagggagcagagatgggtgcattggtgaagagacgtgggtgtccggtgagactgcacagtgggagggtggacacacaggacagctggcagcaccgggtgcacggtttcctcagaaaaatctactaggttatggtcttgaccactctcctaacctttctcaatgatccatttttagaaaaaacctcatttgatggcggaagatgaaccttcaggggccctcttgaagccgctggtttttcgcgttgacgagaccaccccggctgtggtgcaaagcgtcctcctggagagggggtggaataagtttgataagcaggagcagaacgcggaggactggaacctgtactggaggacatcctctttccgaatgaccgaacacaacagtgttaaaccgtggcagcagctaaaccaccaccctggaaccaccaagcttaccaggaaagactgtttggccaaacacctgaagcacatgaggaggatgtatggcacttccctgtaccagttcatccccctgacgttcgtcatgcccaatgactataccaagttcgtggctgaatactttcaggagaggcagatgctgggcaccaagcatagctattggatttgcaagcctgctgagttatctcgtgggagggggatactaattttcagtgactttaaagacttcatctttgatgatatgtacatagtgcagaaatatatctccaatcctttacttattggcagatataaatgtgatctccgcatctatgtttgtgttactggctttaagcctttgaccatttatgtttatcaggaagggttggttcggtttgccacggaaaagtttgacctcagtaatttgcaaaacaattatgcccatttgaccaacagcagcatcaataaatccggggcctcttatgagaagatcaaagaagtgattggtcatggttgtaaatggacgctcagcagatttttttcctaccttcgtagctgggatgtggacgatctgcttttgtggaagaaaatccaccgcatggttattctcaccattctcgccattgcaccatctgtcccctttgctgccaattgctttgagctctttgggtttgatattttgattaatgacaacttgaaaccatggcttttagaggtcaactacagcccagccttgaccttggattgttcaacagatgtgttggtgaagagaaaacttgtccatgatattatcgacctgatttacttaaatggtctaagaaatgaggggggagaagccagtaatgccacacatggaaattccaacatcgacgctgcaaaaagtgacagaggtgggcttgatgctcctgactgtcttccttatgattctctttcgttcacaagcagaatgtacaacgaggatgactctgtggtggagaaagctgtgagtgtgcgtcctgaagctgcacctgcctcccagctggaaggagagatgagtgggcaggattttcatctgtcaacaagggagatgccacaaagcaagcccaagttacggagcaggcacacgcctcacaagacactcatgccctacgcgtccctcttccagtcgcactcctgcaagaccaagacctccccgtgtgtcctgtcagaccgtggcaaagctccagatccccaagcaggcaactttgttcttgtttttcctttcaatgaagcaactctcggagcttccaggaatggattaaatgtcaaaagaataatccaagagctccagaaactaatgaataagcaacattcctaagtggtaaaaaatcaaatcaagaaaaagtgacatggatttttaaaaaccaaggatcctgtcctagagaaagcaatagttcaagtccctacctgtgccaccagcatgttaactatgacattgggactgaagatgtggccatatgtataaatataacagctctgacaaagcacaatatgttcaagtggtgattaaactacattacatcccatgt

SEQ ID NO: 201089 - DNA, 2066 bp, Homo sapiens
agcctccgcgcatttcagctggcgctgcagctgctgcacagagacccacagaggccaccctcggaaccagcgcccaatgagagggcgggacctgtgttcctccacacaaagccaggcgctgggatctttgagaaccaccaccccagcctttacccttaacattccatccgaggcaaaccacactgagcagccgcctgcaggcctgggagcaaggctacaggaagcaggtgtttccatccctcccaggcgaggccgcccaacaccaacactggagaagaagaaaaaacctcatttgatggcggaagatgaaccttcaggggccctcttgaagccgctggtttttcgcgttgacgagaccaccccggctgtggtgcaaagcgtcctcctggagagggggtggaataagtttgataagcaggagcagaacgcggaggactggaacctgtactggaggacatcctctttccgaatgaccgaacacaacagtgttaaaccgtggcagcagctaaaccaccaccctggaaccaccaagcttaccaggaaagactgtttggccaaacacctgaagcacatgaggaggatgtatggcacttccctgtaccagttcatccccctgacgttcgtcatgcccaatgactataccaagttcgtggctgaatactttcaggagaggcagatgctgggcaccaagcatagctattggatttgcaagcctgctgagttatctcgtgggagggggatactaattttcagtgactttaaagacttcatctttgatgatatgtacatagtgcagaaatatatctccaatcctttacttattggcagatataaatgtgatctccgcatctatgtttgtgttactggctttaagcctttgaccatttatgtttatcaggaagggttggttcggtttgccacggaaaagtttgacctcagtaatttgcaaaacaattatgcccatttgaccaacagcagcatcaataaatccggggcctcttatgagaagatcaaagaagtgattggtcatggttgtaaatggacgctcagcagatttttttcctaccttcgtagctgggatgtggacgatctgcttttgtggaagaaaatccaccgcatggttattctcaccattctcgccattgcaccatctgtcccctttgctgccaattgctttgagctctttgggtttgatattttgattaatgacaacttgaaaccatggcttttagaggtcaactacagcccagccttgaccttggattgttcaacagatgtgttggtgaagagaaaacttgtccatgatattatcgacctgatttacttaaatggtctaagaaatgaggggggagaagccagtaatgccacacatggaaattccaacatcgacgctgcaaaaagtgacagaggtgggcttgatgctcctgactgtcttccttatgattctctttcgttcacaagcagaatgtacaacgaggatgactctgtggtggagaaagctgtgagtgtgcgtcctgaagctgcacctgcctcccagctggaaggagagatgagtgggcaggattttcatctgtcaacaagggagatgccacaaagcaagcccaagttacggagcaggcacacgcctcacaagacactcatgccctacgcgtccctcttccagtcgcactcctgcaagaccaagacctccccgtgtgtcctgtcagaccgtggcaaagctccagatccccaagcaggcaactttgttcttgtttttcctttcaatgaagcaactctcggagcttccaggaatggattaaatgtcaaaagaataatccaagagctccagaaactaatgaataagcaacattcctaagtggtaaaaaatcaaatcaagaaaaagtgacatggatttttaaaaaccaaggatcctgtcctagagaaagcaatagttcaagtccctacctgtgccaccagcatgttaactatgacattgggactgaagatgtggccatatgtataaatataacagctctgacaaagcacaatatgttcaagtggtgattaaactacattacatcccatgt

SEQ ID NO: 201090 - DNA, 282 bp, Homo sapiens
ttatgtgtcaaattacccctcaaacactagggatagtactggaaactatctagtaaacatgcagaaaaacatttaaatacattgtagtcagtgctttcttagataaatagggtatttgggtagcacagaagatcacttagtgtaccctgtgttgaaggttgggactaggtgatcagggaaggctttccagaagaaatactaagttgaatcttgacaaactagctgggattaacaggcaaaagtggtttgggcagggaggcatttgagggaatgataacacag

SEQ ID NO: 201091 - DNA, 218 bp, Homo sapiens
catctgtatagttgagaatcagcccaaaactgtacatgaataaactacataaacaagaatattgagataaatactctttggcattagtgaaacttaaacagaacaattagaggattgaatcgttttgtgttaatgcagatgtactcaggaaggaaaaatatctttttctcttttttttttttgagatggagttttgctcttgttgcccaagctggagt

SEQ ID NO: 201092 - DNA, 105 bp, Homo sapiens
taagatgtcaatattactcaaagtgatctacagattcaacataattcctagcaaaattccaatagcttttttatgcagaaataaaaaagctaatgcttacattca

SEQ ID NO: 201093 - DNA, 193 bp, Homo sapiens
aggtattatcatcctcatttacaaatgaggaagttgaggcatggagaggacaggtaactcatccaggatcacacagtaataagtgaaaaggctaggatttactttcaatctggctccagagtctgtgcctttaactactgctctgttattagactcaacaataggtccattacaaagaaggtccagaaaaatc

SEQ ID NO: 201094 - DNA, 959 bp, Homo sapiens
acctgatgtcactcaaagtaagtcacaaaagggcaccaagggcaggtatctctggagatctactctaataactgtctcttggacccctcctggagggccatgcatggtctcaccccctacccagaaaatgacattatttagaggcaggtgatctggatgcagggtcatgggaggggctgtcgatagaactggggggaactttgacctggcagccgatatctgggcacagatatctgaatgaccgtcacaagactgtcacaggagaaagcaaacaagcagcatgtgtgtggcccagggctaagccaggaccaacacagaaacagtgaaaggaatatttgggcttaatatggtaagaagttaattacgagagttacaagagctatataataattgtagaaaacagatctcatacacacagacattaaaactactccaaaatcctacatcccagagagtaaatggtattaaaagccaggggctaccttatgaagtagtgagggtcccagggcaaagatgtgagagggctgcagctccgggcgggagcccctctttagagtgataaaagcgactaagttaggcagttgttacataaatcccaacggtggggcctggtaggacctgtggtggcagtggcgggctccagtgagggcccagactccttttcctctagaggaaggcctaagcttttgtgtttgaactttggctgcccggaggccctttctgctttgttttccagccctgactccagaggacttaggctggggaggtggggcttatgccctattaccttctgaatatttcttataacttgtacatttcttcttttcttttctgccctattttggtgggaagaaatctagaaaaaatgctctccctatacctagtttggcccctcgtctgccttttctgcccctaagcagtgaccactgtcagcagatctcaggggaaccggcagaggc

SEQ ID NO: 201095 - DNA, 477 bp, Homo sapiens
tgaggaaggaacagagaccaaaacatggatgactcatgttagttcttgactggttacagtttttcaccatttattaatctgcattttataatctgttttattcttacaatcaatttaaacaagaatttctaggattccaataaaactggacctaattccttgcctgttttttccttcctacatctctcttcaaaacaattctcagtaacctattttcatgcccagccataactcaacagaagccacccagaataatgaggtggacccctaaatacctaagaactcccctatatctgaaacataaccactgctgcacccattctgaaagagacattacctcttggtagtgctgaccactacttcatttcccatttgctaatcaagaagcaatacttcagatgagcccatgtcaccaatccatagaagcatttctaaaggtggtccaatttcgcccaaaggtttgaaagcacactaccc

SEQ ID NO: 201096 - DNA, 363 bp, Homo sapiens
tttaaacttcttaattcctcagtttccttgtctataatggaaatgtgatgtcataccacctcttagagttcttaaggatttagtaagttttagatgtaaagtacctataacagtgcctggctcatattaagcactgtagctgtagtacagccatctcttattatcaccgtcattacttgaggcagagctttgaagccacacttgctgaccctctggttgttccttccttcagcatccccagctgatatttgcccagcacttcacagcttaaaaattcaaggagcctatgcctcattcaaacttttcagctcacctaaaacgatggtcacctcattttttaaaaaaacttactggggtgaaatg

SEQ ID NO: 201097 - DNA, 432 bp, Homo sapiens
cagccaactagatggtgatggagttggaaaggcatttccagcagtggagagagggctaagggaactggggacgtcatgggaagaaaagagaagacaaatatttcagtgaagcaaaataatatgtattgagcagtctatccccaaatctaccattatatccttgccaaagaaggcagtgcggatcaagtaaagagtaagttgctacataaagaatacacaggccagcctgagcaacatggtgacaccctatctctatagaaaaatacaaaaattggtcgggcatggtggtgcatgcctgtggtcccagctacttggaggctgaggtgggaggattgcttgagcccagaagtttgagcctgcagtgagctgtgatcatgccacagcactccagcctggatgacagtgagaccctgtctcaaaaaaaaaaaggag

SEQ ID NO: 201098 - DNA, 425 bp, Homo sapiens
tcgggaggctgaggcaggagaatcccttgaacctggaaggtagaggttgcagtgagccgaaattgtgccactgcactccagcctggatgacagtgtgagagtctgtctcaaaaaaaatatatgtatatatattgttaagactaaatgtcttaataaataaagaggctgggaatggtggctaatgcctgtaatctcaacactttgagaggtgaggttgaagtatcacttgagcctaggagttgaagaccagcctgggcaacataggagcctcccatctctacagaaaaatgttttttaaattagctgggcatgatggcatacgcctgtagtcctggctactcaggaggctgtggcaagttgatcacttgagcccgggagttcaaggctgctactgtaagctgtgatcgtgccacttcactccagcc

SEQ ID NO: 201099 - DNA, 448 bp, Homo sapiens
ccagggcttaacagacccatttcccaatagtttgttcaaggacaagccctcacaccgtgtgactagcctcccacacactgggtttgtatgcttcctttcctgttctccttgagccaggcctcaccagcaaaaatgcatctagccactcaaaacgccctcattacaactcacccagcaggattcccacatgcctgttggcatgtgcacacatatactaaaaatgcatgcaatgtgatgcagcccgataaagcgcgtggctcccttccacatacgttcaacgaacggtatagcagagtggaaagagcaggatttgtgggactggatgggtgtgggttcaaagctatttccttcttttaacagtggtgtgatcttgagcaaatctgtaaatcttggtccccttcctccaaaagatggtaattataatacttagcttttagtgttgttctga

SEQ ID NO: 201100 - DNA, 288 bp, Homo sapiens
aacagtaataataacaatggcagcgaccattgctgcagaggttactgtgtgccaggcaccattcccagcgccacccgtcattctcagtcacgggagatggctgctgttttcctctccattttgccctgaggaaactgagacccagagtggttaagtcactggcccaagccacacagccgggaagcagcccctgaggctggttcctgactccactgcctctcggccctgtggggtcaaccctctgtccccctctccgctattgccatcttcacccccagagctccacac

SEQ ID NO: 201101 - DNA, 438 bp, Homo sapiens
cagataggacccaagcaaggggttcatggagagaaatccttcatcaggaagttaagggtcctccatcggaggggtgagagcaacaccaaaccttcatgttcctgaaactatggcctcggcgtctgacagacccacaccctcctcagtgaagggtatagctgacactccttcccggggggtagggagaggccggcgggctggaagggctgagcctccactgcgggtgagaagtgctcaacaagttcaacgtcctgatatccagtggacctccgtgctggaggctggtgatccagggaagggatccaccaggaaggggtctggcttcacaggagtagggacctgggggttaagcagagcctttccattatctccaaccccccaccccgagacggagtctcgctctgtcacctaggctggagtacagtggcacgatctcgg

SEQ ID NO: 201102 - DNA, 1116 bp, Homo sapiens
gggaaacggacaggtagcagagcagtaagagagactttcaccatcttttgatttgaaaactgcattaatgtaaaaccattccaaaagagaacttgcaaagtataaaatgcagattcccaagtgcctgaactcctagtgggtagatatgaattatggcacatagaaatagatatttattccccggatgatcctaaaagtaggtattctgtgggccaaatattgaaaaacttccctgtgtttcattatcatttataaaatggaacctgaatttataccttaattcaaagtccacgtgagatcttaagagactgagtgcctgtcagtattagctactattaccaagcccaagtgattatgggaaccagatttatcccaaccagaacagctctttgccccacagacacacaggaaggacctggagaaagttaagggatgaaatgtgccaggaaggaagggccgctggaacagtggttcaccactacaagtggctttgccccccaggggacatctggaaattcctggagacctttttattgcccccattctgatggagagagttgctagcatctagcagggccaggccaggaatacagctaaacattctacagtgcacaagtcaatcccaacacacacacaccccacaccaaaaccttacctggccccaaatgtcaatattgcctaggctgagaaaacctggcctcgaaacaccaaggctgggaggagatgtgaccaacaagagtcctgaaaggaggacatggttaacgaccgtgttcaccagaccacagcacattagaaccagggagcctatcaggagacttgagatggtagtttcaggataaacaagaggcagagctaccgtctagagtggacggtcaacttgcagaactcattactcatatgagaactggtagaggctgaaacgctaaatagtttccaaaaatttagataacttttttttctttttttttttttgagttggaatcttgctctgtcacccaggctggagtgcagtggcacgatctcggctcactgcagcctccgcctcctgggttcaagcgattctcctgcctcagcctcctgagtagctgggattacaggcataagccactgcaccca

SEQ ID NO: 201103 - DNA, 668 bp, Homo sapiens
gcatgagccactgcgcctggttgcctgcccctcttttctgtactccacgtgctgtcctggtccacctcactcctccatgggcttcttgagacacctgctgacctctagccggacctgagcttcagaccctctctccagcaggaagggctgcagactcggcctgttcccagactcggccttcacctcccttctcctcctgtgtttaagtggatggcccctctatccatccaggtcccatgccaagaaccagtgattctagtggcccaccacctccctctcctgccacccttatacctgttcagcctcctaaagagggacaaactctgtctctgcgtgcactggcttgcctgccctgcctttgtcactccaagggagatcttgagacccatgccctgaattggtgctggaatggtctttgggagtcaaactctgatcatgccctccagtggctcctctcacactaaaatcaaaactctttaaaacaagctgagtgcagtggcttacacctgtaatcccagcactttgggagactgaggcgggaggatcacctgaggtcaggagtttgagaccaacctgaccaacatggtaaaaccctgtctctactaaaaatacaaaaaattaggccaggcgcagtggttcatgcctgtaatcccagcactttgggaggc

SEQ ID NO: 201104 - DNA, 249 bp, Homo sapiens
gcatgagccactgcgcctggttgcctgcccctcttttctgtactccacgtgctgtcctggtccacctcactcctccatgggcttcttgagacacctgctgacctctagccggacctgagcttcagaccctctctccagcaggaagggctgcagactcggcctgttcccagactcggccttcacctcccgagttcaagtgattctcctgcttcagcctcccaagtagctaggcctgcaggaacccactcg

SEQ ID NO: 201105 - DNA, 469 bp, Homo sapiens
tatcttgcatgtaatagtttctctagtgcctgtgacttagggcaagtcacttaaacgttttttgaattgccttatctgtaaaatggggcagtattacttggagagtaatattcagaatctcaaataagaaaattaatatggaatacttttaaaaaatgaagaattatgtgaataagggattattaggattactataataacagtgacaattactaaattactgtttgcacccacagcacctaacattgaacttgtgagaagagcctggacatatcttttgactagctgagaaacgtatttattatttaataattttaaaccaatagaagcaagttacattacctttagaaactggtgtgggaggagttttatcccatgataggagttggccaagagaattctgtctataatctctactatgttagcagagctaaaagtggcatcagttattgaaacccattgacaagct

SEQ ID NO: 201106 - DNA, 256 bp, Homo sapiens
catcattcccacttctctgccaagttgtgcaatgcaagaagctggcttgatctggaatttaggataactcaggtttacaatgtcgctgtgatagttgatagttgatctgttagcagcactgacagtatggcagctcttgggagggtcaactctggcatagcctgtagacacctgagtgcctgtcaagttgattttgcagcaagtaaaaggtgtttatctaacacatcccccttggcagtgcaggctgacttcctca

SEQ ID NO: 201107 - DNA, 315 bp, Homo sapiens
gcaagaatcttctattttatttaaatgaatgccatcttttttagtgcaaagataacattcatcctcagagctacaattttcaagattggtgatgattggtatgctaaccaaatttccagaagctcattgatttttttaccagtgatatgagacagcacctttattttcacccatgtcgtgcaagcgatgttcatagtttcacatgtatgtgaggatagatactagagaggtactttatatgctactttatttaataagctaactctttatacattaaaaagtatcttagagttccacagtggagttagaacagga

SEQ ID NO: 201108 - DNA, 418 bp, Homo sapiens
ctgtgggaaacaagcatgtatagcagtctgcctattgagtattgtactgaaattaagacacattaaaatctgtatgaaactttttcaaaagagactattgaaaaattgcaacttataggtcacataatgcctgcagacgccctctatgtcatttgtctaaaatgtctgccaacttgcagctgaccattattgctgtcttgaaagcagtgatgaagtaacatgaagtaactttagatagggaattatgagcactctctgtctaaagtagtagccccagtagaaagaacccctttgctcaccctcctggagggtgggcaggttagatctgcccaagtaaagagctgaaaaatctcattgtggaaaagacataaatgtttaattatttgcaataaattttttaaaaatgtagcagtttaaa

SEQ ID NO: 201109 - DNA, 293 bp, Homo sapiens
tgtccatcgtaaagtgcgcatctggaggccattgcgaacgtatggttgttggccgtcgcgatagacacgtagcgattggaaatgcctcctggaaacacagccagatgccaagagctggcattcttgattctagcccgggtgtgtaagtctggcttgctcgctaactttgctcaatggtctgacaagtcatttagcctctctgagcttctgttttcccatctgaaaatggggataagaaggcgtaatctacagatattaagaggagctcactgatggaacctaccgcttgtttc

SEQ ID NO: 201110 - DNA, 711 bp, Homo sapiens
cttgtggttagaagagaggttattttattaagtggtcatctctctggggcacagggtctggtgccttccgtagagtgtgacagccccactgtccaaggaggagaaaagctgcaggaatgtggatatcgagatgtttaggaaggggttgattgccactagagacagctgagattctaagaccttagaacataaaaagggtatagttctaagtaagcatccaggtaagcatccaggccgggcacggtggctccaccagtaatcccggcactttgggaggccaaggcaggtggattgcttgagctcaggagttggagaccagcctgggcagcatggcaaagccctgtcactgcaaaaatacaaaaaaaggctgggcgcagtggctcatgcctgtaatcccagcactttgggaggccgaggcaggcagatcacgaggtcaggagttcgagaccagcctgaccaacatggtgaaaccccgactctactaaagatacaaaaaaaaaaaagaaaaaaaaaaaaaaaaaaaaaaaaaaaaaaaaaggcgggcgggcgtatttcttgtgtggggggggcgaaaaaagaagggtatagggacagggggccagggaccatgggtggtcccccgaaccccgtttttttaaagagagggggtaaaaacggggccgcccccacaagaggggagcagtttaattcagaagggggcggggcgcccga

SEQ ID NO: 201111 - DNA, 735 bp, Homo sapiens
gtttcaaggagaaaacaagactttaaattatctttagttattgctaacgtgtcttaaaatagtcgtgacgaatggttataagtagtaaccatataagcaagcagtcctgtcagactgttccagcacagtatttcagctcactgcttatatacaggtggtagggttcagtacagtgcaaaatcacatcaaacttgctcaaaagttacattcaagcagaatctcatcaaggtttaggtgtaagagtacatctggttatggattacagaagcataatcactaatcccatcagacatctcatgtgtaagaaaaggcaaggactggggtcatttaaggaatgtagtgactcaggcaagcgatgtgggggtgccctgtgccctgttttgtcttcaaggcatctttccagagagttgcatgtcgtcacagggtcaggggctttgtgaaatgatgctggcaggcagaaatgagcagacctgggttctttttgctgctttgtctcactccaccacctggctcagctctctgcatgtagtcaacactgactgcactgggaggccatacagatactacatgagagtgtgatctttggaaccacattgattgggttgggatcctggtgccaacacctatgagctgtgaccttggcaagttacttcatctccaatgacctcattttctttattggtaaaataggaataattcataggactgtggtggttttacaatgaaaggtaaagc

SEQ ID NO: 201112 - DNA, 191 bp, Homo sapiens
cttttagaagggacactctgatgtacagctatgagagggcatatggttggctggccagaactgtgcataatgtaaagcctgtcctatctatgttacaatttaaaatctggggatgctcacaaaattgtcacatagaaaagcatgcaaaaaaaaaaaaaacttttcttgtgtttccttgttataatcactga

SEQ ID NO: 201113 - DNA, 329 bp, Homo sapiens
agcataaactattagggaggggcatttcaaatattagggcagtggttctcaaacttgagcatgctccagagggcttattaaacacagatgctgggcccctctcccagagtttctgagttgagagtgaggtagggtgggtttccctgctgataatttgcatttctaacaagctcccaggtgatgctgctggtccagagacaacactttgagaaacactctcttatgagatatatactcactatatatagccaatataaatcctgaattttcaaggatagttcctatatcttttcattttattatttatagtaaagcttattttttaaaat

SEQ ID NO: 201114 - DNA, 411 bp, Homo sapiens
cagtcttcgtcccatcaggaagaataaaggagattgtgaagaaacattctcagtttattggatatcccattactctttttgtggagaaggaacgtgataaagaagtaagcgatgatgaggctgaagaaaaggaagacaaagaagaagaaaaagataaagaagagaaagagtcggaagacaaacctgaaattgaagatgttggttctgatgggagcaagatggcgtatctcccatcagatagtggcccagcttgggacttgaccttcaaggccaactcagcatccctcctgtctctctccatccctgatcatcaggtataattgactgctttctcctccacttctcccgctagcaatactcacagtgaatgtcatggtaaggtgtttatttgccactgatgggaggaagtag

SEQ ID NO: 201115 - DNA, 331 bp, Homo sapiens
cgagccagaactcttccgccgtccataggatgcatgctcaaacacgctggaaaagctcttttacctcatggatagagactcaaaacacatttcaatattgtacctctttctttgctttggctgatgggacgaagacgatcttcgtatctcccatcagatagtggcccagcttgggacttgaccttcaaggccaactcagcatccctcctgtctctctccatccctgatcatcaggtataattgactgctttctcctccacttctcccgctagcaatactcacagtgaatgtcatggtaaggtgtttatttgccactgatgggaggaagtag

SEQ ID NO: 201116 - DNA, 510 bp, Homo sapiens
tttataattcaacctgaaaactatatatatatatgcatacatacgtagtttatagacacacatagtttatatatgtatatatacacgtagtctatatagtctattcatctttgtatagtctgtatacatatagactatatgtatgtgtaaatacatatatgaaccatacatatgtctatattatatataaagcttatatatacacacatctataaactacatgtatatagacatagactgtatatatgtatggtttatatatatacacatacatatacgtgtgtgtgtatatatatagttttgttttggttttgggggtttttatgagacagggtcttgctctgttgcccagactggagtacagtggcacaatcatggctcactgcagcctcagcctccccaggagctgggactacaggcatgcgtcaccacacctggccaatatttttggtgttttttttgttttgttttgtttttggtagagatgaggttttatcatgttgccaaggc

SEQ ID NO: 201117 - DNA, 218 bp, Homo sapiens
tatccttgttcttttatttttcaatatcatcaagttgttagttctaagttaacttacaaacttaatgcaacctcaataaaaatacaaagaaacctttccccactgcccctgccctgccctgccccccaaagtgctgggattacaggagtgaaccagtgcgcccggtccaaatgtcactttggtatcaccttatcaagatgtctaataggagggacctc

SEQ ID NO: 201118 - DNA, 430 bp, Homo sapiens
gttgcctctgcccaccacaggtaatggtatattgtactcgacacctaggcaacattccgtagatgacctaacactacggatgcgagaatcccaagttagtgcggtagtatccatcctagaagtcgatcttggtgtcctgcaagtatgcgtaaatgtccaacgtttaccgatcgacgtatgacattcataaaaacatgggacctatgggaccatcactgtctgtagtccatggttaaccgaaatgctgttgggtggcacatgactgcatgttcaaaactgaccttcggatcttcgactgtcctacttcaaacctgcttctctcaaagtcttactcatctcagaaaatggcaattctattcttccagttgtccgggccaaaaacttacaagaaagcttcaacccctctttcttttccataatttatatccaa

SEQ ID NO: 201119 - DNA, 640 bp, Homo sapiens
cattaattcatctttttaacactacttctggtgactttaatccacacacacattgtacgtgagtcatactgatgctgtgttattcaattcattatattttgaaaagtactctatggtcaaattaactttgagaaacacggtttaagcaattttattgtttgcccaatttgaattttcgcaggcttctaacaggatacttaaattaatagatgcttttttacaaatttcacatatactcataggaagaaaacaagctatccaggggtgtcagagataggtagctgacaggcagacagatgccaagaatttgctccacaatttaaagggctacaatcaggataacagaagtgtgagaaacagactcagacagcttaagggtttttgttgcccagaaggaataccaatggaagggataccattgtccatttctatacctttctgttctgaatagccatatccaagcagctttactgtgtgagattcctggagaattagaagtactcccacttccctagatgattcatttgtaatgccaacttatgtgtctgaatgcatgcaaaggaggttgagggtcttctgaactagcggaaaaaaactgaaataacattattttctgagaaggtaatctattttaatccat

SEQ ID NO: 201120 - DNA, 432 bp, Homo sapiens
ataataacattcagttagttatttggcaatttatttaacaatatttaatctctggataggcttatcaagttaacaaaacattttcacattcatcatcttctttaaccttagtgacaactaagtgagataggattattattctcaaatcaggttgctctacttacttttttcctccttaaatccctatttaatctcataaacctggatttcctaaaactttgcagtggctttcatgaaagaattaggctttgtgttaaaaaaaaataataataataagggctgtcaatgacaggcacagatttcagatttcatcacctatccttccttctttcctttagtccatcagcaaaggttaggaagacagatgggttttcggtcaaagggagtcgagaacagcgtgggcagcatgacataggtttatcttccttttct

SEQ ID NO: 201121 - DNA, 189 bp, Homo sapiens
gaaaaatcagcagattatattacttcctgcttaaagtatatcagtggcacctccaaaggtcaagttcaagctccttaaaatagcaaacaatgctccctcacaattatagccctagccagtgtttcctgtcattccgtacaccaaattacacattttggccaactcactgattttggcacttgaggattc

SEQ ID NO: 201122 - DNA, 153 bp, Homo sapiens
aaagcacttagtactgtcaccaacaccttgagtgccaccctgagtgtaacatcggaaccccattcagagagttgggtctgcattcctaaatcagcatgtacaattaggatggttaaagacttgctgtattttacatctgtgaaagggtatgat

SEQ ID NO: 201123 - DNA, 298 bp, Homo sapiens
catttgtgtgttgagagaggtgggagaaggtggtacggtatgaagtggagtctttattcagggtctaagctctcgtttcctgggacagtgagaactttgtcttttcggaaagcttgcctgaagtgtttgcctgttttatagcttgaggtcagggaagaagaacaagatatatctgagccgcttcctccctgagcctttcatccctccctgctacctaagtctgcagcctctgcaccctttggctagattcctgctcaggagaaccaggtcaactcgcacacatgtgcacatacacaca

SEQ ID NO: 201124 - DNA, 1322 bp, Homo sapiens
cccaggcattctaaaaaaaaagaatcccaactgacatgaagcagtctaatgatagacaactgggcaccacaggcattctaatgggagagactcccagtcgattccagacattctaatttgagagaatttgggagatgccaggcattctcattggagatatcagcgaccgacctgcaccagactaatgatgaaaatgcatccacgaacccaggcattctaatgggaggggctctgggagacctcatgcagtctaatgaaaaagacacctggatgaccttagacgttctaatgggagagactctggtccaaccctagactgcctaaggttagagacacctggtcaaccccagacattccaatgaaagagactcctggcccaattcaggcagtctaatgatagagacaccaatgtcacactaagcattttaatgtgagagactcctggctgagaccaggaagtctaattatagagacacctgggcaaccccaggcattctaacgggagagacttcaggctgaccccaggcagtctaatgatagagaaacctgggcgactccaggcataataatgggagagactgctggctgacccaaggcagtataatgatagagacccctgggcatgctatctgtgaaaatgctttaggatgtgtggattagtctcaccaaatggaacctgtgtattgattcaccaggttgaaaacactcttgctgtagaatctataaagggatatttctaagacaatgtaggcctatagtgacagaccgtatattttgcaataaaaaatagaaacaagctatctgtgaaaatgcttcatgaaatgtggatttatttcaatgagttaaaactttgttttgattcaataggctggaaagcctcgttttgtagtatctacgaaaagaaatttctgagctcattgagactggtagtgaaaaatctaatatcctgtgataaaaagtataaaaacgctatgtgtgaaaatgctttgccatatgtgagttcatctccaacagttaaaactttgttttgattcaacaggttggaaacacttttactgtattatctatgaagaaacgtttttgaggccattaagtcctacactgaaaaactgaatatactgcattaaacattctaaagaagctaactgtgaaaatgctttgcaatgtgtgtatttatctcacagagttaaaccattgttttgattcatcagtttggaaacagtttctttgtagaatctatgaagggacctttcagaggccattgaggcctataataaagaaacaaatatcccacaataaaacaagaaacatatagaaacaag

SEQ ID NO: 201125 - DNA, 1029 bp, Homo sapiens
  misc_feature (926)..(926): n is a, c, g, or t
  misc_feature (942)..(942): n is a, c, g, or t
  misc_feature (946)..(946): n is a, c, g, or t
  misc_feature (948)..(948): n is a, c, g, or t
  misc_feature (955)..(955): n is a, c, g, or t
ctggacgacgtaactacacctcatctcttcaaggaagaggtgggaggatcgcttcagcctggaaggttgaggctgcaggtgcttgccactatgcccaactaatatttggaattttcgtatacgtggattccagaggggtgacagcaaaacgtgggaacatccagttgcaggaaaacaagcttaacacgcccactgattctacattatgctcctacctcccggcagcctctccaggccgagaactttctccagtcagcctctacagaccaagctcatgactcacaatggcctatttaggcccataccctacgtcacggcagcctccgcagatgagcctactgcctcacaacagcctccacaggcacagctccatcgttacaatggcctctttagaccccgctcctgcctcccagccttctctccaggccctgaacattctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattccagaggggtgacagcgaaacgtgggaccatccagttgcaggaaaacaagcttaacacgcccactaattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagncgacctcagccaggcncagntntgcatcntggtggaccctccaggcccagcctcagcgctcccgtcaggagtaatcgggagactcaagagtcacctgaggagg

SEQ ID NO: 201126 - DNA, 1043 bp, Homo sapiens
  misc_feature (940)..(940): n is a, c, g, or t
  misc_feature (956)..(956): n is a, c, g, or t
  misc_feature (960)..(960): n is a, c, g, or t
  misc_feature (962)..(962): n is a, c, g, or t
  misc_feature (969)..(969): n is a, c, g, or t
gcacatgccttgggagctaagtggttgctgcccttgaccactgtgaagactggtgtgggaagggtcgctttggatgcacttgagcaggggtccccaacccctgagccatggagccgcaaggagccacacagcaggaggtgagcggtgtcgagtgagggagtgagggaagcttcgtctgtatttacagccactcccctttgctcacattcccgcctgagctccaccttctcagatgagcagcagcgttagattctcataggagaacgcaccctgttgtgaaccgtgcatgtgagggatcgaggttgcgctgtccttatgagaatctaatacctattgatctgttactttctcccatcacgctcaggtgggaacatccagttgcaggaaaacaagcttaacacgcccactgattctacattatgggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattccagaggggtgacagcgaaacgtgggaccatccagttgcaggaaaacaagcttaacacgcccactaattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagttgacctcaccaggcccagctcatgcttcttagncgacctcagccaggcncagntntgcatcntggtggaccctccaggcccagcctcagcgctcccgtcaggagtaatcgggagactcaagagtcacctgaggagg

SEQ ID NO: 201127 - DNA, 567 bp, Homo sapiens
  misc_feature (464)..(464): n is a, c, g, or t
  misc_feature (480)..(480): n is a, c, g, or t
  misc_feature (484)..(484): n is a, c, g, or t
  misc_feature (486)..(486): n is a, c, g, or t
  misc_feature (493)..(493): n is a, c, g, or t
gcacatgccttgggagctaagtggttgctgcccttgaccactgtgaagactggtgtgggaagggtcgctttggatgcacttgagcaggggtccccaacccctgagccatggagccgcaaggagccacacagcaggaggtgggaccatccagttgcaggaaaacaagcttaacacgcccactaattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagttgacctcaccaggcccagctcatgcttcttagncgacctcagccaggcncagntntgcatcntggtggaccctccaggcccagcctcagcgctcccgtcaggagtaatcgggagactcaagagtcacctgaggagg

SEQ ID NO: 201128 - DNA, 1010 bp, Homo sapiens
  misc_feature (907)..(907): n is a, c, g, or t
  misc_feature (923)..(923): n is a, c, g, or t
  misc_feature (927)..(927): n is a, c, g, or t
  misc_feature (929)..(929): n is a, c, g, or t
  misc_feature (936)..(936): n is a, c, g, or t
gcacatgccttgggagctaagtggttgctgcccttgaccactgtgaagactggtgtgggaagggtcgctttggatgcacttgagcaggggtccccaacccctgagccatggagccgcaaggagccacacagcaggaggtgagcggtgtcgagtgagggagtgagggaagcttcgtctgtatttacagccactcccctttgctcacattcccgcctgagctccaccttctcagatgagcagcagcgttagattctcataggagaacgcaccctgttgtgaaccgtgcatgtgagggatcgaggttgcgctgtccttatgagaatctaatacctattgatctgttactttctcccatcacgctcaggtgggaacatccagttgcaggaaaacaagcttaacacgcccactgattctacattatgggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattccagaggggtgacagcgaaacgtgggaccatccagttgcaggaaaacaagcttaacacgcccactaattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagncgacctcagccaggcncagntntgcatcntggtggaccctccaggcccagcctcagcgctcccgtcaggagtaatcgggagactcaagagtcacctgaggagg

SEQ ID NO: 201129 - DNA, 747 bp, Homo sapiens
  misc_feature (644)..(644): n is a, c, g, or t
  misc_feature (660)..(660): n is a, c, g, or t
  misc_feature (664)..(664): n is a, c, g, or t
  misc_feature (666)..(666): n is a, c, g, or t
  misc_feature (673)..(673): n is a, c, g, or t
ctcaacctcccacgtggctgagactacaggtgcttgccactatgcccaactaatatttggaattttcgtatacgtggattccagaggggtgacagcaaaacgtgggaacatccagttgcaggaaaacaagcttaacacgcccactgattctacattatgggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattccagaggggtgacagcgaaacgtgggaccatccagttgcaggaaaacaagcttaacacgcccactaattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagncgacctcagccaggcncagntntgcatcntggtggaccctccaggcccagcctcagcgctcccgtcaggagtaatcgggagactcaagagtcacctgaggagg

SEQ ID NO: 201130 - DNA, 223 bp, Homo sapiens
tgcactttaggacacagaactgtggggtcaagcaaagtccttctgaatgtggccagagagcctgggcagcctaagtcttaatgatctaccaagctgcacagaagcaaatcctcattctttgactccctcgggcccaactagacatgaagctgctgaagtcctagagatggacttttccagcttgctgatagttgagtaattttccagaaacaggacttggcca

SEQ ID NO: 201131 - DNA, 2779 bp, Homo sapiens
  misc_feature (2)..(2): n is a, c, g, or t
  misc_feature (4)..(4): n is a, c, g, or t
  misc_feature (6)..(9): n is a, c, g, or t
gncncnnnncccaaacagccttctgaggttggtaagggtattcagccatcttcgctttgcatatgagaagacaatctcaaagatttgaagtgtcccagtggtaactggcagaaggagaactcttagatctcctgacttgcacatcctgtcatctgctgtgttacattctcatctagagtctgctctccacacttgatccttgctacccctctacctgctgctgttcctctgagagttcatcttgcctttattttgagggagggaggggcaagcccagtgttagtgttgattttgccctcaaggaccctggcggggaagcagtagtgttcccattgtagaggccagaaaagctgcccagtgacacagccaggatcagtcatggagccatgataggccagagcctgagctcccagccactgaggaggggtggcagaggattgtttggccaggtctgtgtgggctgaaggcttggtgaccagggacgacatgatcatctgcaagaccaatgctatcactgccctgaggatgttcttcccccgaaagtttgcctccaatagcacaggcacctgcgtctcagatggtggtgacatctgagtacttggacttcatcagctgcctgtaggaggtgaggtagcaggaggtgagggcaatactcccttcagcttcagcaggtgaaaagtgtggttctcaatgaagttgagctagtgtgtgccaggtctccttctacagtgggtacgcgtcatacaggatcccatcaaagcgaccacctggcaggggagcgccacctccttccacaggactttcaaggggatgaccttgtgtggctgctgctgggtccagtcctggagcagctggaagatgctgtcattgcactccatgatccagtgttcctggatggcgacctcctgcaccttccatattcttgtggccatgccgaagcccacctctaagactcggccccctttggaggtggtgaaggcagcgaagggggttgcagtaggggcgctcttgctgcagatggagccccaacttggaacccgacgtgccagggcccagtccctgcagccatctcacttttcacatacctcatttctgcttgccaaacccacccagccacttaataaggaagcagagagtatgggatagagaaattgtgggaatagtggcccagccagatgttcattgctccactgggactctgataggaggcttggccttcaagctctgcagtttcctgtctggcaccctggcagctgggctcaagtctaaaatgtgcagaagtgttttatagataaatagaacattccaaagagatggcctcatcagcagtgagacatcttagggaaggagacaccacagtattaaagagaattacctcaatggcagtgcctgtgagctggcttgagccaccttctttacctctgagctttctgccttctgaagccctttttgctctttctgttcagatgagaggcattatggttcctatttgggtaacattagggaggtggtcaaagcccccagtatagcccattcctgtagtcctaatccaagatggtcatcactgatagtaggattctcctctccccatttcagtcacaggaaatggggtggtgaccaaacaagctcaagtgataaactgctggtgatatgtatatatgtttgttgttttctccacctctgaggtgctgggttgcctgataccaaagtgttccagtttgtgtactaaagttgtttttctggcagcctgagacttcgctttttaaaaaatgcagcaattggttgatttttgttgttcctgaaggacccatcacactacccacggtatctgagtttcaagtctagcatggcttgggtaatctgtgattgtacctgtttcttcctgggattctgcacatagccaggagcatctcattgcttcattccgtgttttcttgcagttatgcctgggatatgcagatggaaatgcatattttattgtaaatttcattttatatctagcttatattacccttagggcattaagtgggtcttttaaacttatgtctgttaagtaggttgtctgtgacttgacgtcgggcagtaaaggtagatgctaagcaagtatttattatcaaaaggaaatgttgagtcaacattaagggtgagaactgctcttcgtggttaaggataaaaccaagaaggaaagaagtgatgggaatgcagagacaggaggcagcccagctcttcttggggttgtttacgcccatccttgcgttggtctgcggcgtttccccagcagacaccactgtgggctactctaatgacttctctttcctcctcgaacaacttctggagaagtcgcaccgttgcagagtggtgccgctacacattgatcatctaaccttacctgggtcctcagctatagggccgtctgtctcgagtcagctgtcacttaaaagtttcaccattttctctggtttgacttgctgaaaaaaaaaaaagaaacattaaaaaatttcactattttcttaaaatagtttaccttatcacaccctctcatgttcactggatgactatcctttcttcctggtgaaagcagaaaccctcagtttctcatcttgcacctacagactcatctgcaatccttacctccttgggaaaaaaagacgtctctctttccatgtgagtatcagtcatccccctgtgccatttcattttctggttttcagtccaccctgccttttctccgcaaagttttcacttctgtgtctttagcctttcctctaatggatgtagg

SEQ ID NO: 201132 - DNA, 2512 bp, Homo sapiens
  misc_feature (2)..(2): n is a, c, g, or t
  misc_feature (4)..(4): n is a, c, g, or t
  misc_feature (6)..(9): n is a, c, g, or t
gncncnnnncccaaacagccttctgaggttggtaagggtattcagccatcttcgctttgcatatgagaagacaatctcaaagatttgaagtgtcccagtggtaactggcagaaggagaactcttagatctcctgacttgcacatcctgtcatctgctgtgttacattctcatctagagtctgctctccacacttgatccttgctacccctctacctgctgctgttcctctgagagttcatcttgcctttattttgagggagggaggggcaagcccagtgttagtgttgattttgccctcaaggaccctggcggggaagcagtagtgttcccattgtagaggccagaaaagctgcccagtgacacagccaggatcagtcatggagccatgataggccagagcctgagctcccagccactgaggaggggtggcagaggattgtttggccaggtctgtgtgggctgaaggcttggtgaccagggacgacatgatcatctgcaagaccaatgctatcactgccctgaggatgttcttcccccgaaagtttgcctccaatagcacaggcacctgcgtctcagatggtggtgacatctgagtacttggacttcatcagctgcctgtaggaggtgaggtagcaggaggtgagggcaatactcccttcagcttcagcaggtgaaaagtgtggttctcaatgaagttgagctagtgtgtgccaggtctccttctacagtgggtacgcgtcatacaggatcccatcaaagcgaccacctggcaggggagcgccacctccttccacaggactttcaaggggatgaccttgtgtggctgctgctgggtccagtcctggagcagctggaagatgctgtcattgcactccatgatccagtgttcctggatggcgacctcctgcaccttccatattcttgtggccatgccgaagcccacctctaagactcggccccctttggaggtggtgaaggcagcgaagggggttgcagtaggggcgctcttgctgcagatggagccccaacttggaacccgacgtgccagggcccagtccctgcagccatctcacttttcacatacctcatttctgcttgccaaacccacccagccacttaataaggaagcagagagtatgggatagagaaattgtgggaatagtggcccagccagatgttcattgctccactgggactctgataggaggcttggccttcaagctctgcagtttcctgtctggcaccctggcagctgggctcaagtctaaaatgtgcagaagtgttttatagataaatagaacattccaaagagatggcctcatcagcagtgagacatcttagggaaggagacaccacagtattaaagagaattacctcaatggcagtgcctgtgagctggcttgagccaccttctttacctctgagctttctgccttctgaagccctttttgctctttctgttcagatgagaggcattatggttcctatttgggtaacattagggaggtggtcaaagcccccagtatagcccattcctgtagtcctaatccaagatggtcatcactgatagtaggattctcctctccccatttcagtcacaggaaatggggtggtgaccaaacaagctcaagtgataaactgctggtgatatgtatatatgtttgttgttttctccacctctgaggtgctgggttgcctgataccaaagtgttccagtttgtgtactaaagttgtttttctggcagcctgagacttcgctttttaaaaaatgcagcaattggttgatttttgttgttcctgaaggacccatcacactacccacggtatctgagtttcaagtctagcatggcttgggtaatctgtgattgtacctgtttcttcctgggattctgcacatagccaggagcatctcattgcttcattccgtgttttcttgcagttatgcctgggatatgcagatggaaatgcatattttattgtaaatttcattttatatctagcttatattacccttagggcattaagtgggtcttttaaacttatgtctgttaagtaggttgtctgtgacttgacgtcgggcagtaaaggtagatgctaagcaagtatttattatcaaaaggaaatgttgagtcaacattaagggtgagaactgctcttcgtggttaaggataaaaccaagaaggaaagaagtgatgggaatgcagagacaggaggcagcccagctcttcttggggttgtttacgcccatccttgcgttggtctgcggcgtttccccagcagacaccactgtgggctactctaatgacttctctttcctcctcgaacaacttctggagaagtcgcaccgttgcagagtggtgccgctacacattgatcatctaaccttacctgggtcctcagctatagggccgtctgtctcgagtcagctgtcacttaaaagtttcaccattttctctggtttgacttgctgaaaaaaaaaaaagaaacattaaaaaatttcactattttctt

SEQ ID NO: 201133 - DNA, 926 bp, Homo sapiens
attcagatgccagacgaattgaggactagctgatacaggcatggggcagaagcagcgtctgcaaggccgcccaccagtgtgccttgttagtttactgtcgccatggccacacccggagttactgcctctttccatggccgtgacctgacaacccaaaagccaccacccttttcctagaagtgtctgcctaagcctacctttactctacaggaaattaaaagtaggtataaggtaaggctgggcgcagtggctcatgcctgtaatcccagcactttgggaggccaaggcgggtggatcacctgtggtcatgagttggagaccagtgtggccaatatagtgaaaccccgtctctactaaaaatacaaaagttagcctggtgtggtggtgcgcgcctgtgatcccaggtgctcgggaggctgaggcagaagaatcgcttgaacccaggaggtgatgaaggtgccagttgggacaaatgtaaacaaacgtaaagatccagtattaaatcgtaactgcataaaattaacggtagtagccatctcctattgttattgtgctgagctcaagtgctgggattacaggtgttccagtaagtggtcagagccctgcctgtcccaagtgggtgaggtcccaaagggattatcatagcagtgttggaaggccagctagtgattcatgccaaggtgacctgtaggataaacctgctacagcatggtgctgctgcacggccattctgaatttgcatgtctttggccaaattatagagcagaatttccagggctggggatggtagtccttcctccctcatttgtctctgcctgtactctgggatatttctgccttcagacagtcatgatgttttctgtgggttaaggcaaggacaaatctccccccagggaacccaagaaggtggagaagctggttgaaca

SEQ ID NO: 201134 - DNA, 602 bp, Homo sapiens
ggtataactaaggctcttcgtgtaagtgcaagtaacaggaaccaccttgggttcctttaaaaacaaaaggaatttattggaaaaacaatgggtaacctcacagatctaacgcaaaggctagaaaaatctaggctctgaaattaggctggtatcaaggtagagcaggcagccagaactgcggctgaaccactcacgggaacagtctggtgaagacaccactgcctgtataacatgagagcaccctcactattaccactgctaccactgcccctgtccatgatcttctgcgtcactcactgcagattcaaagttctactggctgagcctgggtcacattcctgtgctctagctgccaaggaacagggaaaaatgagtacctgaactttccagattttgaggtgtgagacaggtcctgttccccaccaagactctgtagaatttcccaaatgtaagaaaaaagttcagatgctagacagacagacagacagacacacacacacacacataaaaggcaaatttccattacttgggacacagtgaaagacaagccagtgaggtaggtgaagactgatcattaggagatttatcattcatgttaagga

SEQ ID NO: 201135 - DNA, 460 bp, Homo sapiens
cacctccaggagggagtggggctcccaatgcccatctggggacattgcattaaagggttcctttccacaggctcaatcttcagatgcctcagccctccccgagccctgaccacaagccaaatggcgctggaccacagtatcagggttctccagcgactccatcctccagggaggaagaggtggtgaatttccgagctgggacagaacccagagtggctggagcaggccagcacctcgcctcatatacttggagcctggagacatcaggcagcaaatgagaagcattttaaggttctctgactattttcttttttaattaattaattagttcattaattttttaatttaaaaatttttcttacctctggttcaagttctcatgaccgattccttaaggttgcaacacatgaacatgcctttcctccaagaaaatttagagaattcagattagtaaaaagaa

SEQ ID NO: 201136 - DNA, 503 bp, Homo sapiens
actgagcggccaaggacaagttggcctactcccagtgctaggcagctttaacacacttggcagtaggcactttatccttctcccttaatgctacttctaagccattacagctccttccctggtcctccaatgctcatatattgacatcctttcaatctttcatctgagatatggttctcgccccatatcaattttcagccttttctattgtgcctcattatccaggtgctattgtcttcaggcccgtaagactcaaatactcccacctccaatttctccagacaaacatccttataactaggaaaataaaacagtaagactagaacatgggtgcactagcctgctccaggctcattctctgggacccatcaccaatgtttttgtctgtttgctttaggccggaagcatgcgttaatttgtaagacagccttgcttaatttgttttttggatcattttacaaatattgatcaggctttctaagcacaaaaagctttattttagg

SEQ ID NO: 201137 - DNA, 131 bp, Homo sapiens
ttttgtaacattcatcactcttgtagctattgatttagtgcctgtttctccaccagatcacaggctctactagagctgggaccatgtctatcgttaccaccgtgctatcccttgcatctagcacactttga

SEQ ID NO: 201138 - DNA, 231 bp, Homo sapiens
gtaacgcttcagatacttacatagttattggggaagccaagatcgaagatttatcccagcaagcacaactagcagctgctgagaaattcaaagttcaaggtgaagctgtctcaaacattcaagaaaactacaatgacctctaactgttcaaataaaagaaagagctgcatgtttctcacttcatatcaaaagctacttggtaggctgaggcaggagaattgcttgaacctg

SEQ ID NO: 201139 - DNA, 122 bp, Homo sapiens
cctagcctcccaggtcttaactcaatggtacctacatgaagcgacaaattctgaggctaaatctggattcaagaagaaaagtgcaccttgattaatttacagtgtcagctactggccaagaa

SEQ ID NO: 201140 - DNA, 350 bp, Homo sapiens
ctatttcttttcctttggatattacccagtagtgggattgctggatcacatggtagttctacttttagttcaaaatctacttttattggacaaaccaaattttcactaaatccgtgtgccaatataaattagtgaaaatttctaatttatcatctgtatatctaattatcatatgtatgatatacaatatacaagttattaatagctttacctaaagtgttactaataagaaaatattcacattcagtcttgttcatgccaacaacatattcctaagtcaagtttgttaatatgtctgtgtcaaaaaaaatacaggccgagggcggtggttcacgcctataatcccagca

SEQ ID NO: 201141 - DNA, 344 bp, Homo sapiens
tgcataaattatattgagagaaatagttaattagattacaggaagtcaccttcccaatattctaaaatcacagtaaaatgaagtcaatagaaaccatgccatcagcatgtaggtcttccgtctgattttctctcaagatctatgctaagaagcatgcaaccgtcttcttgacaactttactgaacaatttaggtaaaattcctctgaagttttaagtcaaaacaatatgttgaagggtatatatgaataaaaaagtgttataatcagtttaaaattaataacagattttaatgtgtttgtattattttctctattttaactttatttttataacagcagataca

SEQ ID NO: 201142 - DNA, 312 bp, Homo sapiens
caaactggccgttgttcccagctgataagccaccctatgtcacgtaatccaccatggggaccctggattagcagaagtcaatggctgccccacctcctaaagttgaagaggagagagacaaagaagcaggaagccccgaggcccatcagaggctgcctcccggatgtgccccttccccttcatgacctctgcggttgggttcattgtttgggttcagagaatcattcgaggcaccaaactcaagggccacacccaccaatgggtggcacaaatttcatctcaaagatgattcaatttccctcaaatgtccaa

SEQ ID NO: 201143 - DNA, 644 bp, Homo sapiens
agacacctatgatactgtgtgtgggggagtctagatcgtaaaatagcttccaaatagagttggtgccctctctcttccttgaagtgatggtaattaatttgggggtaagaaaaatagagcttgttcatcaaactatttttctgttccaattaaacaacaacaactctaatatatagttcactgggtgaaagagaattaggtagctatttttcttcataaaaggcatggaacatcagtaaatagaggatcaacaataaccataatctaaactagttaaatgccacactgaatggtctgaaggccagggcactcaaaggaaatctgaaaatgcacacgtctttattcctgtttcttccaattgaatagaacctgctttatttatccgttaagtgggaatatacaacagctttttgacaaagtcataaacttccttcttcaagtattctagacaaatcataaagccagtggttgctttataaaggcccacatgaagtgtgtagagctttggactggaaagcagttaaatttagggtaaaggggtaaatatttcataggaagcaaatgctgtttgttttttgagttttcttttttctttattaaatttattattttttccctaaccctcagaacctgtgactttgttt

SEQ ID NO: 201144 - DNA, 139 bp, Homo sapiens
cagccacttccagttatacagcctgtgaccttgagcaacttaaagtgacatccactggcagtgcctggagcttctgcctctgtgacaggtagaacacccccctcctggggctgaggtgaggctcagaggggcactgcag

SEQ ID NO: 201145 - DNA, 930 bp, Homo sapiens
agggctacgttggtgaggactgcggccagcggcagtgtctgaatgcctgcagtgggcgaggacaatgtgaggaggggctctgcgtctgtgaagagggctaccagggccctgactgctcagcagttgcccctccagaggacttgcgagtggctggtatcagcgacaggtccattgagctggaatgggacgggccgatggcagtgacggaatatgtgatctcttaccagccgacggccctggggggcctccagctccagcagcgggtgcctggagattggagtggtgtcaccatcacggagctggagccaggtctcacctacaacatcagcgtctacgctgtcattagcaacatcctcagccttcccatcactgccaaggtggccacccatctctccactcctcaagggctacaatttaagacgatcacagagaccaccgtggaggtgcagtgggagcccttctcattttccttcgatgggtgggaaatcagcttcattccaaagaacaatgaagggggagtgattgctcaggtccccagcgatgttacgtcctttaaccagacaggactaaagcctggggaggaatacattgtcaatgtggtggctctgaaagaacaggcccgcagccctcctacctcggccagcgcctccacagtcattgacggccccacgcagatcctggttcgcgatgtctcggacactgtggcttttgtggagtggattccccctcgagccaaagtcgatttcattcttttgaaatatggcctggtgggcggggaaggtgggaggaccaccttccggctgcagcctcccctgagccaatactcagtgcaggccctgcggcctggctcccgatacgaggtgtcagtcagtgccaaaccgagggaccaacgagagcgattccgtcacgcactccattcccaacaggtaa

SEQ ID NO: 201146 - DNA, 340 bp, Homo sapiens
ttattgatgtctcccgggaggtcacttctaaaagacggttttatgtacaaaagcagcggtgtcgggcagcccagtagagttgaaagagcgctgaagaggtgaagcccaccctttgagtctctgagacccatttccaactcaggggaaaccctgctgtgcgggaccccctccctgtgttactccatccctggtgcaggcatcaaatatttattgagcacctactgtatgcctggagaaagggcactgaggttatacaagtggaagaaatggggaggcctcggcctttggggacctcacattcctaccaagggagtacataataagccagtgaagaacaaga

SEQ ID NO: 201147 - DNA, 439 bp, Homo sapiens
ataatttagaaatagaaaaggtttttcggcttatggttctgatgtctggaaaagttcaagactgagcatctgcatctgatggtagcctaagactgcttctactcatgccagaaggcaaaggagagctggtgtgtgcagagattacatggccagagaggacgcaaaagaagaaagggtgtttttagataaacagaactagaagttgaaaggctcttctttgacagatgaatttggtatgtgtatttttttttttagatggagttggtgaaattggcttacagaaaaattaaccagatgatatttatgtacaacaatgccgggaatatgaacggagactctaaagactttaaagcaagtctagtatacatgatggccggaaaacaatctgtgtcaagaatactatcaggtgggccaggcgcagaagctcacgcctgtaatc

SEQ ID NO: 201148 - DNA, 2828 bp, Homo sapiens
atttgcaataacttcaataaatgcgaatccaataatccatctacaatacaaagggcatgcgtccggaccaagaacacgtctccagactctggaaagaacctctacgaacgaagaagacaacccaattttcaaatggaccccggggaacacccaggcggctggggctggctctaggtccccactgctctgtccttgcgggggccgctccggcctggtcgccttctccgggcgcatccagggaactcgctcggtcctccttaagcggggaagctcggaaagcgtctccccgactccgcccccagggttgcctttcccttagaaggccaagccccaagcccagcctctcgccagctgggagtcgcgcgctgcccacctcgctgcccaggcccccgacgccgcggcaggagccccccaagagcgcgggaagccccgtggacctggcgctcccggctcgggcgtggacggggcgggcgccggggcggggcgcgcgtcctcgcgggtctgaatggaagggtcgaggtcgtcgtcggcggcgagcagatcctgaagccagaactccaccccggcgcccgcgccatgcggcgggagaggtgcggcgccccccacccgcgtcgccgccatggaggtgctgcggcgctcctcggtcttcgccgccgagatcatggacgcctttgaccgctcgcccacagacaaggagctggtggcccaggccaaggcgctgggccgggagtacgtgcacgcgcggctgctgcgcgccggcctctcctggagcgcgcccgagcgtgccgcgccggtcccgggacgcctggctgaggtgtgcgcggtgctgctgcgcctgggcgatgagctggagatgatccggcccagcgtctaccgcaacgtggcgcgtcagctgcacatctccctgcagtctgagcctgtggtgaccgatgcgttcctggccgtggctggccacatcttctctgcaggcatcacgtggggcaaggtggtgtccctgtatgcggtggccgcggggctggccgtggactgtgtgaggcaggcccagcctgccatggtccacgccctcgtggactgcctgggggagttcgtgcgcaagaccctggcaacctggctgcggagacgcggcggatggactgatgtcctcaagtgtgtggtcagcacagaccctggcctccgctcccactggctggtggctgcactctgcagcttcggccgcttcctgaaggctgccttcttcgtgctgctgccagagagatgagctgcccacctggcagtggccgcagcctggccctctgggcccaacgcaggaggccctcagcacccgaacacatcttcctccgcagacccaggccctccggaaggggtgagtggggaggggctttcctgagcctggagctgggctttggggcagcctgcgaccctccccgcttgtgtcccttctcctgtgatctctgtgttttcccttttctttctggggccaggaagtcagggtcaactcccaggcctcagatgcaggggcccagaacacctgctctcacctgagccccaggtgaaggggcccgggaacacctgctctcacctgagccccaggtgaaggggcccgggaacacctgctctcacctgaaccccaggtgaaggggcccggaacacctgctctcacctgagccccaggtgaaggggcccggaacacctgctctcacctgagccccaggtgaaggggcccgggaacacctgctctcacctgagccccaggtgaaggggcccgggaacacctgctctcacctgaaccccaggtgaaggggcccggaacacctgctctcacctgagccccaggtgaaggggcccggaacacctgctctcacctgagccccaggtgaaggggcccgggaacacctgctctcacctgagcccctggtgaaggggcccggaacacttgctctcacctgagccccaggtgaaggggcccggaacacctgctctcacctgagccccaggtgaaggggcccggaacacctgctctcacctgagccccaggtgaaggggcccgggaacacctctcacctgaacccgggggtcccatcccaggaagaagggccatctcaggacatgagtcctcaggggccctgcacattcaatctgaaggtgaccctggcctggctgaagctggaagagctgtggggactcagcctgtaaacagagcgtaaggttcacatgctggttgcttaatccgtttctggaggaagagtatgacacccacttgtgatggggtccttgtgcggtggggaccggggccggcgggctccaggccagcacacctaacccatggatgtggaacctacggccgagaaggaatgttgcatgagtcggatcccagtccattgtcagtggagggtgagggtgaccccatctgctatttttgtgctcatcctcaaacaaccatttggggatgtgcctattagggctccgtaagaactcagatgcctgggaagcccagcccctcaggtgcccccacacacagccttcccttgacgcctacatttctaggcacatgtgaggcatctttcctggagccccgagccagccctgtccctccccagtgcagcatggcactcaggagatacaggctggacatggggcagtcgttctggggaggcctggcctagcagccacccacctgagccctcccggccaggcttcgtgctggggtgggccatgtgccaggacaggagggtcccggcggaaagccagccccggactcatcgtgacattgagatcccactggagggtaggggtggtaataaacttctccaaacgatcgttgtcatttt

SEQ ID NO: 201149 - DNA, 1631 bp, Homo sapiens
atttgcaataacttcaataaatgcgaatccaataatccatctacaatacaaagggcatgcgtccggaccaagaacacgtctccagactctggaaagaacctctacgaacgaagaagacaacccaattttcaaatggaccccggggaacacccaggcggctggggctggctctaggtccccactgctctgtccttgcgggggccgctccggcctggtcgccttctccgggcgcatccagggaactcgctcggtcctccttaagcggggaagctcggaaagcgtctccccgactccgcccccagggttgcctttcccttagaaggccaagccccaagcccagcctctcgccagctgggagtcgcgcgctgcccacctcgctgcccaggcccccgacgccgcggcaggagccccccaagagcgcgggaagccccgtggacctggcgctcccggctcgggcgtggacggggcgggcgccggggcggggcgcgcgtcctcgcgggtctgaatggaagggtcgaggtcgtcgtcggcggcgagcagatcctgaagccagaactccaccccggcgcccgcgccatgcggcgggagaggtgcggcgccccccacccgcgtcgccgccatggaggtgctgcggcgctcctcggtcttcgccgccgagatcatggacgcctttgaccgctcgcccacagacaaggagctggtggcccaggccaaggcgctgggccgggagtacgtgcacgcgcggctgctgcgcgccggcctctcctggagcgcgcccgagcgtgccgcgccggtcccgggacgcctggctgaggtgtgcgcggtgctgctgcgcctgggcgatgagctggagatgatccggcccagcgtctaccgcaacgtggcgcgtcagctgcacatctccctgcagtctgagcctgtggtgaccgatgcgttcctggccgtggctggccacatcttctctgcaggcatcacgtggggcaaggtggtgtccctgtatgcggtggccgcggggctggccgtggactgtgtgaggcaggcccagcctgccatggtccacgccctcgtggactgcctgggggagttcgtgcgcaagaccctggcaacctggctgcggagacgcggcggatggactgatgtcctcaagtgtgtggtcagcacagaccctggcctccgctcccactggctggtggctgcactctgcagcttcggccgcttcctgaaggctgccttcttcgtgctgctgccagagagatgagctgcccacctggcagtggccgcagcctggccctctgggcccaacgcaggaggccctcagcacccgaacacatcttcctcctccccacccgagcctggagcactctaacctcggagaccccctaagcccgttctccgcagacccaggccctccggagggtgagtggggaggggcttcctgaagcctggatgtggtttgggggggctgcgacctcccgttgttgccttcctggtgtctctgtggttccttccttcttggggcaggagtccgtcactccagctattgagagcaaactgctcctgggccttatgccggaccttccccttccgggagccgactctgccaactgaggggaatccgcgggggactccgg

SEQ ID NO: 201150 - DNA, 705 bp, Homo sapiens
gggcggggagggccgggtcctggcagtcgccgtgggggacgcgctgggctgtgccctccgcccccgccgcccacgcactcgtcttcgagggcgggcccggcggccccggagcaaaccgccgtctccccgcggccccaccggtccctggcagcctcggggaatgtctgtagctgaattcgggctctgaaagaaggtggcgctgggtttttaaagatttggggcacaaaaaacgagagcggacccggcgccggctacggcccttcccgagggccacgcccagcccggcgccccgcgcgccccgttccccgcgccgcctccctccacccggctgagcgcttgtgcccgcaggtgcggcgccccccacccgcgtcgccgccatggaggtgctgcggcgctcctcggtcttcgccgccgagatcatggacgcctttgaccgctcgcccacagacaaggagctggtggcccaggccaaggcgctgggccgggagtacgtgcacgcgcggctgctgcgcgccggcctctcctggagcgcgcccgagcgtgccgcgccggtcccgggacgcctggctgaggtgtgcgcggtgctgctgcgcctgggtgagtgcgccctggtgggatccccagctgcgcctcctcccctgctgggccgcagcctccctccgaggccgagatgggggtccggcccaggggcgcccaccccctgcc

SEQ ID NO: 201151 - DNA, 1253 bp, Homo sapiens
atttgcaataacttcaataaatgcgaatccaataatccatctacaatacaaagggcatgcgtccggaccaagaacacgtctccagactctggaaagaacctctacgaacgaagaagacaacccaattttcaaatggaccccggggaacacccaggcggctggggctggctctaggtccccactgctctgtccttgcgggggccgctccggcctggtcgccttctccgggcgcatccagggaactcgctcggtcctccttaagcggggaagctcggaaagcgtctccccgactccgcccccagggttgcctttcccttagaaggccaagccccaagcccagcctctcgccagctgggagtcgcgcgctgcccacctcgctgcccaggcccccgacgccgcggcaggagccccccaagagcgcgggaagccccgtggacctggcgctcccggctcgggcgtggacggggcgggcgccggggcggggcgcgcgtcctcgcgggtctgaatggaagggtcgaggtcgtcgtcggcggcgagcagatcctgaagccagaactccaccccggcgcccgcgccatgcggcgggagaggcatcacgtggggcaaggtggtgtccctgtatgcggtggccgcggggctggccgtggactgtgtgaggcaggcccagcctgccatggtccacgccctcgtggactgcctgggggagttcgtgcgcaagaccctggcaacctggctgcggagacgcggcggatggactgatgtcctcaagtgtgtggtcagcacagaccctggcctccgctcccactggctggtggctgcactctgcagcttcggccgcttcctgaaggctgccttcttcgtgctgctgccagagagatgagctgcccacctggcagtggccgcagcctggccctctgggcccaacgcaggaggccctcagcacccgaacacatcttcctcctccccacccgagcctggagcactctaacctcggagaccccctaagcccgttctccgcagacccaggccctccggagggtgagtggggaggggcttcctgaagcctggatgtggtttgggggggctgcgacctcccgttgttgccttcctggtgtctctgtggttccttccttcttggggcaggagtccgtcactccagctattgagagcaaactgctcctgggccttatgccggaccttccccttccgggagccgactctgccaactgaggggaatccgcgggggactccgg

SEQ ID NO: 201152 - DNA, 2092 bp, Homo sapiens
atttgcaataacttcaataaatgcgaatccaataatccatctacaatacaaagggcatgcgtccggaccaagaacacgtctccagactctggaaagaacctctacgaacgaagaagacaacccaattttcaaatggaccccggggaacacccaggcggctggggctggctctaggtccccactgctctgtccttgcgggggccgctccggcctggtcgccttctccgggcgcatccagggaactcgctcggtcctccttaagcggggaagctcggaaagcgtctccccgactccgcccccagggttgcctttcccttagaaggccaagccccaagcccagcctctcgccagctgggagtcgcgcgctgcccacctcgctgcccaggcccccgacgccgcggcaggagccccccaagagcgcgggaagccccgtggacctggcgctcccggctcgggcgtggacggggcgggcgccggggcggggcgcgcgtcctcgcgggtctgaatggaagggtcgaggtcgtcgtcggcggcgagcagatcctgaagccagaactccaccccggcgcccgcgccatgcggcgggagaggtgagcgcggcgggcgtggcgtccgtgccggggtgcccggggtgccacgggaacggcgaggccggggacacgcgcgcaggacgccagcggcggaggtgggcggccccgggccggggcggggagggccgggtcctggcagtcgccgtgggggacgcgctgggctgtgccctccgcccccgccgcccacgcactcgtcttcgagggcgggcccggcggccccggagcaaaccgccgtctccccgcggccccaccggtccctggcagcctcggggaatgtctgtagctgaattcgggctctgaaagaaggtggcgctgggtttttaaagatttggggcacaaaaaacgagagcggacccggcgccggctacggcccttcccgagggccacgcccagcccggcgccccgcgcgccccgttccccgcgccgcctccctccacccggctgagcgcttgtgcccgcaggtgcggcgccccccacccgcgtcgccgccatggaggtgctgcggcgctcctcggtcttcgccgccgagatcatggacgcctttgaccgctcgcccacagacaaggagctggtggcccaggccaaggcgctgggccgggagtacgtgcacgcgcggctgctgcgcgccggcctctcctggagcgcgcccgagcgtgccgcgccggtcccgggacgcctggctgaggtgtgcgcggtgctgctgcgcctgggcgatgagctggagatgatccggcccagcgtctaccgcaacgtggcgcgtcagctgcacatctccctgcagtctgagcctgtggtgaccgatgcgttcctggccgtggctggccacatcttctctgcaggcatcacgtggggcaaggtggtgtccctgtatgcggtggccgcggggctggccgtggactgtgtgaggcaggcccagcctgccatggtccacgccctcgtggactgcctgggggagttcgtgcgcaagaccctggcaacctggctgcggagacgcggcggatggactgatgtcctcaagtgtgtggtcagcacagaccctggcctccgctcccactggctggtggctgcactctgcagcttcggccgcttcctgaaggctgccttcttcgtgctgctgccagagagatgagctgcccacctggcagtggccgcagcctggccctctgggcccaacgcaggaggccctcagcacccgaacacatcttcctcctccccacccgagcctggagcactctaacctcggagaccccctaagcccgttctccgcagacccaggccctccggagggtgagtggggaggggcttcctgaagcctggatgtggtttgggggggctgcgacctcccgttgttgccttcctggtgtctctgtggttccttccttcttggggcaggagtccgtcactccagctattgagagcaaactgctcctgggccttatgccggaccttccccttccgggagccgactctgccaactgaggggaatccgcgggggactccgg

SEQ ID NO: 201153 - DNA, 274 bp, Homo sapiens
tgcgcgtactgccaccgggatggtgcattgactgctgacccacatgctcctcagcaggggacagctgcatccatggtgctccatgcacacaatcgaatgctttgcagtcaagagaaggcaatgaggaggatctacatactgctatggcgtgaaaaaaatagggtgcagaataatgaggataacatgcaagcttttttttttggtttgagacagagtctccctctgtcacccaggctggattgcagtggcttgatcatggctcactgcagcttca

SEQ ID NO: 201154 - DNA, 331 bp, Homo sapiens
atcaaaggtgtcaaagaatataagagcaaaaactccatccaaaggacagtgatatggtttggctctgtgtcctcacccaaatgtcaccttgaataaatccccatgcgtcaagggcaggaccagatggagataacttaatcatggggtgcttcccccatgagtgagctctcatgagatctgatgattttataaatgggaattccgctgcacaagctctcttgtttgacaccacgtaagaggtaattttgctcctcttttgccatgattgttaggcctccccagcctaacaatgtggaattgtgagcaaattaaacctctttccttataaatt

SEQ ID NO: 201155 - DNA, 533 bp, Homo sapiens
ttaacatgatacgaatcgagctggtacccaggctgcagcttggaatctcatactatttgattatattgatcactctcccaatgtttagtcactttccctcattctttgcagtctttacaacctgacttaactgccattattttgatgtctcatttaaattacttatcttctttgacatttgacctcatcatttccaatgtacttgctatcttcagtatctagctattcaatctcatgatctcagctcaaaccacgttattactcctaattgcaaatttttacaatctaacttttaagtctcctgccttctgaacattaacttctatctttctagttcattccatttactacaacttcaaaaatactgtgactcatcctggatctacaatctcatacaatatacaatacagtccttacacaattctcaatccagttttctccacacatcctttacttctcagcaaacccaccttcaaaacatttaaataatttttactactgctgttatccacccaggccaagccaaaatcatg

SEQ ID NO: 201156 - DNA, 573 bp, Homo sapiens
caaaagaagagcagatggtcttatggattatattcacagaagagctgtaacataatctatctgagacttggggtagtcatggaggaaaaaagttagatgggcttagagagaaaaggaagaggactattcttgctgagtgccttatgttttctcagtttcattcaatcacactgtaactttgagaggtaaattttatacccacctttacataaagaaagttcttggacttttaaaaactttgacaagcattgcttagctagaaagttctagaaccctctctctcccattccaacctgaacagtaaaaacacattctttaactttattcaataacgagtcaaggtaggtctcttgtcagggagacaaatgaaaggctcatattttatatgtctccagtgcacttggcataatcaagagtgtagtataattaaaattgtagacaaaggaatgaagaggattaatgtgttacaagtttgttgactaggctggagaaaagaaaaagagacagctgactagtgtggagtgtaatatcacagaataatgatatggtaaactgggccttgtaagggcaaag

SEQ ID NO: 201157 - DNA, 426 bp, Homo sapiens
tgggctgtagccacagaagcactgtaggaggagtccaggtcttggatcctagacctgcctctgacacccatttgcagtgaagtatcccttcagctccttcagcctcacttccctcatttgtccctttcccacctcctagaaaagggtacatggtttaacaataaatccaaaaggttaccattctgacccaggttagccagtagaaatggaaatatctactctacttccaggtcatctttgagggctatagacccatgccacttagttcttatagcatcctcataaggtacataagaaaaacactcacaacagctctgcaatatacccaaggtcattcactcttgagcagcgaggctgagagctgaactcccgcctgtcctgtacagcgccttcacgtggctgggctatgtcaacagggcccgagag

SEQ ID NO: 201158 - DNA, 226 bp, Homo sapiens
aagaaacatcaaatcatgtccaagcttccgggaaaaaaataaactttgatgtaaggctgacaaagacaatgtcgcttgggtggtttcttgattagtataaccttagaaacctcaggagacagaagtatagagaaactagcttctgcctttttcttctaattctagccttgtggacagcccagcataaactagagaactgaatcaggaagcacagcagcctcctgtt

SEQ ID NO: 201159 - DNA, 791 bp, Homo sapiens
tcggagaaggtgtggccccactgttagcgggctcgcggggccatacccgggccacactcttccagccccagaaagccagattatcttctctggaccctccgcgtgcttcaggcacccttgggccgactcatccctgcttgggagggagggaggaagccgcccccctctgtgaggtgttcctgactcttctaccccacctagtttctaggaaaggaggcaacatgacgtgctgggagctttctggtcctgagctttgaacatgagaaatgccgtgaggaactgttttctccgcgatcgaagtgtcacacttcgatcgcggagaagcattccaaagtctatccaagtccaaaacatgtgctctaaatattgtactgtgctataaactgtgagtactgtaaaagtgaccttctaaccaggctctctgccttcaatctcccatttgttttccatcctacggctagatctaactttggaaatgcaccctgtttgtctgacctagaggttgtgtggcttctaggatcaactctagaccccttagcttagcattgcaatcagtttcatctggtcttagtctccctgactcttcttgcctttggctggaaccttggcattgttcgaactgtcaatttactctgaacccagtgtagctaatatttttcacagccctttgctttcccttttccttttctctggaatgcttctccccacttctcttcctagccaaacccagcgtcctccagtgtggaccttcgtcctcttgtgttctccgcgatcgaagtgtgcatcctctc

SEQ ID NO: 201160 - DNA, 808 bp, Homo sapiens
gctgctagactaaaacataaaaggcacccgaggaaaatccaagagccgtcaccgttgaaacaggaggcgaatacctttctcgacgacattgccaagcaggagcgaacagcccggaaacgccccggagtttacgagctagtctctgtcattgagccatcaagaaggaaaaaccactcagaccgcgttctctccctctcactccccaatacggagagaagaacgatcatcaatggctgacggcagttgcgacgaagcaacgccaaaaagcagcttcacgctcaggagaaaacgctacctctccttctccgcgatcgaagtgtcacacttcgatcgcggagaagcattccaaagtctatccaagtccaaaacatgtgctctaaatattgtactgtgctataaactgtgagtactgtaaaagtgaccttctaaccaggctctctgccttcaatctcccatttgttttccatcctacggctagatctaactttggaaatgcaccctgtttgtctgacctagaggttgtgtggcttctaggatcaactctagaccccttagcttagcattgcaatcagtttcatctggtcttagtctccctgactcttcttgcctttggctggaaccttggcattgttcgaactgtcaatttactctgaacccagtgtagctaatatttttcacagccctttgctttcccttttccttttctctggaatgcttctccccacttctcttcctagccaaacccagcgtcctccagtgtggaccttcgtcctcttgtgttctccgcgatcgaagtgtgcatcctctc

SEQ ID NO: 201161 - DNA, 355 bp, Homo sapiens
ggatggcagttccctgcactgaaaggacactcatctgccttgaccttcctcccacccaggttggagacaaaggcttgtgccaacttggatgaggcctaaccttcaatactgtgccaccatggaaagcttcccaaggtaggcggatctcaacaccttcagcctgctttgctaaaggaagacagacattaccaaattgaaggttaaatcacaggacacttgggctgtaaaagttctcacaacagaagttggaaaattatgggataagtgcagcagaagtagcgataaagatgacgtgacttctttaagaacccttctgagaactcagggtggctcagggaagccttcacgccttgat

SEQ ID NO: 201162 - DNA, 383 bp, Homo sapiens
tggttttgtgtgtcagtaggtaagcagggaagtagcattttggttgttttggttttatggtgatctcccattccctttacctgattgtctgattaggacttttggtaacagaacattctgtcaccattaacttttgcttgacattggattatttctaaatacagtttggctgtcttctgatcggacattttcagaggaaatgaagttaggttaaacaaatactacgtgaaaggctacatttgattttgacagccaagaatgtttcctgggtatggagttttatgaagaatctcctatttgctctggttaatttgatattgcattgcccatagttacagagtacagtccccatctgtacatcacccacagctatttcacattgg

SEQ ID NO: 201163 - DNA, 376 bp, Homo sapiens
taaatctccagacagcagccttaataaaatgaagctatataatttatctgacagacaaataaaaataactatcataaagatgctcagaaagctcaagagaatcatgcatgaacaaaatgagaattccaacaaacagatagaaaatataagaaagtaccaaacagaaatcatgcggctgaagaacacaataactaaagtgaaaaataactagcgaggtccagcagcagactagatcaagctaataaaaggaccagcaactcaaggacacatcattaaaaataattcagtcaaaagagcaaaaagaacaaaataatgaaaaaagtgaagaaaccttaaggctcacaatttagggaccaatatttacattatgagagtg

SEQ ID NO: 201164 - DNA, 507 bp, Homo sapiens
ttgggcacctctatctcctagattgcattgtttctagggtttgatttatatctaggtttcaggatgttctagatctttatcttagttctgggaatggtgggaattctccccaaatcaaagtttccaggtgccagcccagggccggccctgcaggtgggcctttctagagacagcagcctcagccttgccacggccactctcttctgcacacccaccttgccctgcctccatgtcacaggcatagggcatgtgcccaccagcccagcctcgggctccggggaaattacacattgctctgcctcactgcatggctgaaggctcggctttaggatatgaagagaccctgagcatcatgatcagggtaaagctgctgctccctccagagcctttaatgttaatttcagatggactctgctggctctttatgttttattaacaagcagacttaatcttgctgaagcatgtgggaaaaatgcagtggccaagttttcaaacccgagttcattc

SEQ ID NO: 201165 - DNA, 374 bp, Homo sapiens
gacaatgctgtttagcgaatgcttgctcctgtcatttaaaggaccgggatgatggctctcaattctggaaagccagccaccatgagcacttggggaaattttcctttaagtgtgaaagagcaacagtgggtggcactcaggctccattcctggctggcagggagctcttccttcaatacagacagtgtcacccacttgaatctcacaatggcacacagctgtcctcgcactgttttggtccatcctggactgagagctgagtcagcccatgagtcacctgcctggccaccatgcagcaggacgatgctgtggcatcgtatccgcatcccatgacatgatgaagttactgccaaaacaagaatcttttctcctag

SEQ ID NO: 201166 - DNA, 315 bp, Homo sapiens
actaaggtgctggctataatggatataattagttactaaaataattgagtggtatcatgtatttttaatgtatttacattttagtacaaagtctttaaaagttcatatgttctgtcttgtaaacaccttcagaagattgacaggatacaaaaattctaatgtgtcacaaggataagccaaattacttgttgcagcatttcctttcaacagtttccatcagaaaattagaatcccattaacaacaaacaaaaagaggtggcaaaacagaggcaaagaaaagcaaaaattttttgaagtccattaattgattttcag

SEQ ID NO: 201167 - DNA, 1116 bp, Homo sapiens
  misc_feature (978)..(978): n is a, c, g, or t
  misc_feature (981)..(981): n is a, c, g, or t
  misc_feature (1042)..(1042): n is a, c, g, or t
  misc_feature (1086)..(1086): n is a, c, g, or t
ggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcaancancctccgtgtgttagactcttgtccttctgtcctgccccaagctgctgctcacttatcctgncatactgggaaagggggttccccacgatggcttattctgggtcnaactttcccaggtagggaaacggaggtaga

SEQ ID NO: 201168 - DNA, 771 bp, Homo sapiens
agcttgcagtgagccgagatcgcgccgctgcactccagcctgggcgacagagcgagactcagtctcaaataataataataataattacttgatatacttgaaaaattaataaaaatgggggctaatcaggattaggcaccttgagaaaccaaaacccctggtttgccttcttttaggtcaaatttatctacttagtttatattataacttacaggtataaatgtggttgttgttattaataataatcttttattcagtgtctacttgctgccagtttcatgaggctttctttaaacattaatactgactttaggctagcttaaatatattataaattctgatacagatttctctagtcatgtgcttcttagttatgatgtcaattcagaattttttatcagaattttgttctagaaaaaaaaaaagtcaacacacgtcactgctataaattatatcccagaatgggggctaaaataaacttgcaatatctttaaaaaatctaacttccatgccctattctagaaagctactggatgtttctacgaaaaggaagatgtgatagaggaaagatgaaattcaataaacaagaaaggttaaaggaatcctcaaaatagtggatggagccaggcgtggtggctcaagcctgtaatcccagcactttgggagactgaagcgaatggatcactcgaggtcaggagttcgagaccagcctgggaggtggaggttgcagtgagctgagatcatgctactgcactccagcctgggagacag

SEQ ID NO: 201169 - DNA, 873 bp, Homo sapiens
cctgcttcaactgtgcttggacggaacccggcgctcgtcccccaccccggccggccacccatagccagccctccgtcaccttttcaccgcgccctcggactgccccaaggtccccgccgccgctccagggccgcgcagccaccgccgccgcctctccttagtcgccgccttgacgaccgcgtccacctcgcaggtgcgccagaactaccaccaggactcagaggcggccatcaaccgccagatcaacctggagctctacgcctcctacgtttacctgtccatgtcttactactttgaccacgatgatgtggctttgaagaactttgccaaatactttcttcaccaatctcatgaggagagggaacatgctgaggaactgatgaagctgcagaaccaatgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctcttcgacaagcacaccctgggagacagtgataatgaaagctaagcctcaggctaatttccccatagccgtggggtgacttccctggtcaccaaggcagtgcatgcatgttggggtttcctttaccttttctataagttgtaccaaaacatccacttaagttctttgatttgtaccattcctgcaaataaagaaat

SEQ ID NO: 201170 - DNA, 653 bp, Homo sapiens
ctggaagtgtggatgggccaggtcagtggaggtaaggggctaagaccaggaggcctgggttctggtttctgctctgaaacatacacattttcaacctcgggtcagcaatgcaacctccctgtgcctcagtttctacatctgagggctgcccatcagcctgctgcagactcacatgagagagcctggaggggccgtgctggctaccaggtacaggaagttttggtatcccaaaacgactcctctctactcccctagactggggcgtgcagcctcccaggaccgcctgatccctgaaccaccgcccctaccaccaaggcacaggtgtccctctagttggacgtgcataggtatggggcttcagtccaggaaaggaggacttggagcagggccaccccactctgtgggtgcatccctagagggcttcttgttggccactcagctgcatgatctggcctctggaaggccagatccaggtcctgcctgacctgtcgacgagtcccccatctgcctctgccgcccacagcgtcctggatcccagcctcccgctgaccccaaggtgattacagtaattaatagcactcataatcacagtcatacagctgagtgtactttacagtctaccagcactttcactgacattatctcactagtca

SEQ ID NO: 201171 - DNA, 1228 bp, Homo sapiens
  misc_feature (1170)..(1170): n is a, c, g, or t
atcactgacaggcttggaatttgagctctgtcattaatgggacaagttacattatatttcattgactcaaagatgtacatttcccctctgcctggaatgttctccttgcccctttgcagggctgcctccttctcagccttgagaaatgttaccacctcagagaggccttccccgatgacctaggctaaatcagaaggtaagctctgtcttagtcagcagggttttgcaccgagtaggtacccaacacgtatctgccgcatgggtgaattactattttctatcaaatagaacgtgctattaccttgacagcctttctccaatatgtatgagtctgtgtattgcctctctccccacaaaagacagggagttccatgaagacagggattgtgtctgcatcatcccctctacacatcctctgcctgacctgcactagtcctcaataagcatttagcacatgaatgagtgtatgtgtcttatttcatgctgttttatatttataatcaacaaccctgtgaggtaggtaccatcatcttcattttactgatgaagatgctaaggctcaacatgatgaattaacttactcaaggtcacatggctaataagaggcagaaacaggatttggactgactcagatatgtaggtctgactccaacactgatgttcttaataattatggtatgtatacagctgctacaaatcctctacaaaaaggaaggtcttgaaggatatacagcagtatgttgaatgtatcagccaggcacctacattaaagccgtgcaggtaaaaaggtaagtgcttgctgaatggaacaacagatgaatgctaagagctgtcttgggaagactaaacaaactccacacaacacaggcgctgagatttgagataatctgtggatcagggtttcctagcccatcacccctgagcaaggcaatgtacactcattactaacagtgagtcactaaggcagttgtgtttctctctctttttttttttgagataaagtttcactcttgtaatttcacgggctgtttgacactgaggtaaatcaagcaggcatcagccactttattcaggtcaccctcacctaggtccagtctctcacagagggggcccaggccctgtaagacagccagctgcaacttgaaggtcagcgtgtgcgagtaaactggnccagccctggcactgatgggggcctgggtgactagggagccagccagctttggcagga

SEQ ID NO: 201172 - DNA, 381 bp, Homo sapiens
cactgttggcaggtatggccatggtactaccccaagactaaccttggaaccccacaaagcctgacctatttgcagcaacacctctcagcctgcaaagtccattagaattggtgggatcttgtgtggccaagaggagctgaggctgatggcagaggccagtgcaaacgcaggttctccccaccagggtccagattctttcaaagacatgcaggctattacctacagtccacatcttttgaatgacagttcctgatccacatcaccttatgccaccattacctctgctgctggacaaggagggagagcctgctcatttgtccatccatcagcctgtttagtccatcctcctctccatctgccttccttctcccttctgccctc

SEQ ID NO: 201173 - DNA, 563 bp, Homo sapiens
ttcctttgctctcctggctagatgcgatcttttcctctaacgctttaccactataccactctgctttgtagtaacttatgtacatgcatcattctccctgtgttggctccacatacaataaaatgagaactaatgtttatataatatgagtttacagtgccacgttttgagcatctcatttattctcataataggctcatctatcagaaatagttggttttaattttttaatgatggatgaagagattttcctggttagtatgttattttgtctaagattacataggaaatagatgatgttggctcgttaatttaagctcagttcatcagacccctgagcctttgctgtttctgccttttgttcttgtgatcacccaagtcctgagggcataagctccttgacttgtgtgggtgtcccctgcagtatccagcagagcgccatccaacatctgtggactgtagtgaatactggtgtgcaattaaatgccaaaagctcatactcaagatagatgtgaactcagttgtaagaatgatgtctgtcatttgctgaatgccttctgttt

SEQ ID NO: 201174 - DNA, 477 bp, Homo sapiens
atcgtttattactttagttgctgaaggatacaaaggcatactacttgctttcagttctgagagaaggagcacaaataaatactgccccattccccattctaaaagggttagcccacatatatgtgtaggtctaaaatttttaattagagcatcttacctagaagggagaatacttatcactaattatatcagctatagtgaaacatatatagtcatatgctgcttatggagggggatacaatctgagaactgtctttaggagattttgtcattgtgtgactatcctagtgtgtacttccataaacctagatgacacagcctactacacacctaggctgtatggtagagcctattgctccttggctgcaagcctgtacagcatgctactgtactgaatactacaggcaattgtaacacaatagtaaggatttgtgtatctaaacacagaaaatgtgcaataaaaatatggtacaaaag

SEQ ID NO: 201175 - DNA, 324 bp, Homo sapiens
ggagtcgtcacaagtgtgtgcctctcccggtctctcttggctcttggcatgtaaaacacctgcttctctttgccttccaccatgagtggaagcttcctgaggccctcagcagaagctgatgctggtgtcctgtttcttgtacagcttgtagaactgtgagccaaataaacttctttttttataaattacccagcctcgggtgttccttcatagcaaggcagacagtctaggacaccccccaaatgtgagctgcaccataaggcaaactgggaaacctcctttagttttgcatatgtgagaattttgattgactgaaccaaggaa

SEQ ID NO: 201176 - DNA, 731 bp, Homo sapiens
attaagttgaagaaattttctgcccagcttaataaacaaggtcaaaaatgtaaagttataacaaggaaggaagtgtagcattggctctatcattaaatcacagatctgagtatttatgactaagattaatccttggccattcaaagctacttatacacacacacacacacacacacacacacacacacacagcccataaagtatggtaaaaactggaattctaaaaagtaagacagcaatgacaagcaaagaccaaaatagctaaatttgccacaaacgcatctaataaaagacattctactgaatagaaagatgaatgaatagggaagtgtttttagctagagaagtgtcaacttgtgattaaataactgaaaggatatagggctgcatatcccttcatccactgggtacccacccatttgctctcagcagaactaaccagtgacaaactgcgtccacagatcaacacagaatggagtgcttcatacggatgcatacctaagccagtatgttctcaggccatcttgctcactagcagctagttttgatgaaggtgtttgtaggtgtgacaccaaggatattaagtctggtgcaagaaattctatcaccgggaagcagaaaggactaaattgagttcaaccatgtgtatatggttagaagttgaaaggaaataatctaaagtcctgtttgctttgttactgtactgcccattactaggtagagttgctaga

SEQ ID NO: 201177 - DNA, 244 bp, Homo sapiens
aaatctgatggaaatagtctttgctaatctaaagctaaccttcacagcttcttcccatgtaatggtttgtgcatgggaaacctcagtgaacacagcaactaagctaaaccttaatttaatagaactcaaataaagggcactttaaaaagccacaaattaggcaaaattaagattatttgacttggcactaatgtagaaattttccatgttgtatcctaaaaggtctagagcagtggtccttaca

SEQ ID NO: 201178 - DNA, 225 bp, Homo sapiens
tacgtgggcaacctgggtgtagaagggaaaagaaagaatgaactccctctgaccttctggtgcccagtgattccagccactagaaacaaaaccggcaatgtatcctggagcctggcttttgagaccagtattcctcctacttgctgggtgggcatggggaagagttaaggcgacaactttacctcgcatggctgcgcatgctattggtcaggaaaagactacttc

SEQ ID NO: 201179 - DNA, 572 bp, Homo sapiens
atttcccatggaattacacatacagataatattctagacagccagaaggtaaggcaggtgaaaagcagaaggagctataacagcagggatatcttaagtgactctgagatcagactcactgtcagatcacgcacagctttgcaattactgcctatgttttcatttcccattgttacttaagcgattaggggaaaaatgattcaaaagttatctgacaccaatttttaaaaataagctattctcaagaccacatactcacataaaaagaaaacaatttaaacatgcactggtgtctaatcacctaattactaccttagttgaattagtttcactggtaacatcacatgtcattgaattttatgttaagattatacaaaaataaactattgtgcaagaataaaacaaaaaactctcaagtatttctaaatttttctgtcacagggtaagcaatgcaattaaagacaacagcacaaactctcttacaatgacccacagagttcttaaaattaaaggttggtttgaacagtttctaatgctaacataagtcaagtgtattacttaggcactaacgc

SEQ ID NO: 201180 - DNA, 456 bp, Homo sapiens
acatttaagaaagaatttataccaactttggacaatctttttcagaagataatagcagaggcaatacttccaaactctttctatgaggccaggtttgccctaaaccaaaaccagacatagatattacaaaaacaaaaaactacagatcgatatctctcatgaaaatagatgcaaaatcctcaacaaaatagtaaatttaatccaacaatgtataaaaaaattatgtatcctgaccaagtgggatttatcccaggcacataattctggatcaactttcaaaaatcaattaatataatccaaaatatcaacaggcaaaaattacatgattatatcaatagatgcaaaagaagcatctgacaaacttcaacacccattcataacaaaaatattcaataaactaggaatagaggaggacttcctcaacttgatacagacaatctgtaaaaaaccttatta

SEQ ID NO: 201181 - DNA, 486 bp, Homo sapiens
tttagaggatcccgtgctcacttcatcgcgttatttttgtattttttggtgagacgggttttcaccgtgttacccaggctggtctcgaactcctgacttcaagtgatcctcccgcctcggcctcccatagtgctgggattacaggcgtgagccaccatgcccagcctagacccttaagaatgtttgttgaatgggtgggtgaatgtgctgaggcatggagtccagtccagagtcattccttccttatgaagcttacatacaaattagagagagagagacaaaaagtaaaaactacaggtgataaatgccagatagtgataaatgctattcagaaaaataaagcaaagtaacaggatagtttatggaggatgttactttatatggatggtcagggaggacactgtgaggtactccctgtgcctactctagggcgccctgggagctgagacctgaaggaagtaagacatgtggctatctggaggaagg

SEQ ID NO: 201182 - DNA, 547 bp, Homo sapiens
ttttttacaggcagggtctaactctgtcacccaggctggagtgtagtggcatgaccatggctcactgcagccttgaactcctgggcacaagagatcttcccagctcagcctcccgagtagctgggactataggctcacgccactgtgcctggatacttttttaaattgtattttttagaggcagggtcttgtttccttgcccaggctggtctcgaactcctgacttcaagtgatcctcccgcctcggcctcccatagtgctgggattacaggcgtgagccaccatgcccagcctagacccttaagaatgtttgttgaatgggtgggtgaatgtgctgaggcatggagtccagtccagagtcattccttccttatgaagcttacatacaaattagagagagagagacaaaaagtaaaaactacaggtgataaatgccagatagtgataaatgctattcagaaaaataaagcaaagtaacaggatagtttatggaggatgttactttatatggatggtcagggaggacactgtgaggtactccctgtgc

SEQ ID NO: 201183 - DNA, 633 bp, Homo sapiens
  misc_feature (137)..(137): n is a, c, g, or t
tcggtacccgttcttgtttttgtttttttgagaccgagtttcactctgtcgcccaggctggagtgcagtgctgtgatctcggctcactgcaacctccgcctcccgggttcaagcgatttttctgcctcagcctcccnagtgactgggattacaggcatgcaccaccaggcccaggtaatttttttgcatttttagtagaaacagggcttcaccatgttggccaggctggtctcgaactcctgacttcaagtgatcctcccgcctcggcctcccatagtgctgggattacaggcgtgagccaccatgcccagcctagacccttaagaatgtttgttgaatgggtgggtgaatgtgctgaggcatggagtccagtccagagtcattccttccttatgaagcttacatacaaattagagagagagagacaaaaagtaaaaactacaggtgataaatgccagatagtgataaatgctattcagaaaaataaagcaaagtaacaggatagtttatggaggatgttactttatatggatggtcagggaggacactgtgaggtactccctgtgcctactctagggcgccctgggagctgagacctgaaggaagtaagacatgtggctatctggaggaagg

SEQ ID NO: 201184 - DNA, 611 bp, Homo sapiens
ccactccaactttcagcaaccaccaccacccccatccgtcagtggccatccacatcaaagcaacatctttcaccagcaaaaagattatgacttgctgaaggctcaagtgatcattaacattttttagcaataaagtattcttaaattaatgtacttaacattttaaaaatacataatgttattatgcatttaatagactacagatagtataaacctaacttgaaaatacatggagaaactaaaaaattctcgtgatttgttttattgtgatactttattgaagtggtctggagctgaacttgggttatctctgatgtatgcttgtaaatttaacagaggttatttgagcattaacagatgtatttattgggcagcacttagaactagaaaaggctcagagatgcccacttcaatagtgtgagcagtgggcttctattggctgaatgtggaaccaaagtaaggaaattacttaattgactacagctgtgttgtttttctgtatgggtatgatttagtagaaagtgtccagttacgttatctgatgtctagttggctgttgtggttagttgaagcttgttttttttttttttttaaatttaatttattacaag

SEQ ID NO: 201185 - DNA, 325 bp, Homo sapiens
ttccctcacccaagggcctccagcaccacctcctcccacgcagcagtctcctgcctcttccctcacccaagggcctccagcaccacctcctcccacgcagcagtctcctgtctccagagctgcgccttttgtggatgtcttgcaggcaagcctcacttcactgtgcttcagacactgcttttcacaaacgggaggtctttggcaaccctgcaccaagcacgtctgtgggcaccacgtttccaacagcaggtgcccacttcatatctctgtgtcacgtttcaataatgctcatgatgttccaagctttctcattgctatcatatct

SEQ ID NO: 201186 - DNA, 488 bp, Homo sapiens
ctttatcaagtgccacaaggcatgatccaggtaagatctctgaggattcagagagttgggagatctctgggagaagcctggtgaaggggcaggatctgctagatctagaaggcagggttgtgtttggatgagtagcagggagaatgcagggtatatttggcagtgggaggagcacaaaggcatgaagctggaatgagctgagactgtttaggggaccatgaggagacctgtcagggtagaaaattctttttttttttaattaattaattcattcatttttttgagatggagtcttgctttgtcacccaggttagagtgcagtggcacgatcttggctcactgcaacctctgcctcccaggttcaagcgattcccctgcctcagcctcctgagtagctgggattacaggcatgtgccacaatgcctggctaaatttttgtattttagtagagatggggtttcattatgttggccaggatggtctctatc

SEQ ID NO: 201187 - DNA, 277 bp, Homo sapiens
cgacggttggaagacaagttgtaaagttttaagaataaaacctcacgaaagtgaagtattcaaataaatgttcattttaatccttatgtgtggacacataaaaacaataacagaaggtagagaaagatgagatttttcactgtcaaatgtagtagaacaaaactagaacaagaaaatcaggtgcttttaggggtctggcattgttttaagtattggatattgggaaatgtgaaactcttcagacacacgttttactgaagttaaataagagattttg

SEQ ID NO: 201188 - DNA, 521 bp, Homo sapiens
ctaactgaaggtgaaaatacacaaaacaaagctgctgctttgtgaaacttccccacttactggtagatgttctaaaactcgcacaacactgggcacttcttcttacctgcccctcacatatgagagaaaaccaggtagcagcaaagaagcactgagcactggataaggtgacccctgtgccagtgccaggatgggttccccttccttggcatagtgctccccttcagcaattcattcaaatagatgcccaggacctcacccacaggccccagtggtggggtctgagcacatacatcttgaacaggcttcagaggcaaatctgatctctcagctctatcacctcactccttttctttcaaattctgggaagcagaaaggaactcaactctaaatactctgactagcctatgggtcccagtggatttaggccaaggaaaagggcatcttgcatgattatagacctcttttcttgtctttaattttaaaagcacggttcagtgttaggtggggagagggtgccc

SEQ ID NO: 201189 - DNA, 140 bp, Homo sapiens
ttgtgaggatatcagcactggagaagaaaccccaactaaggccaaataataagaaaaaggaacaagcaggtcaaggggagtgggtggtactgggagagcctgccagttttagaagaggaagaaacagcagtagaatcaac

SEQ ID NO: 201190 - DNA, 422 bp, Homo sapiens
  misc_feature (3)..(3): n is a, c, g, or t
  misc_feature (5)..(7): n is a, c, g, or t
  misc_feature (9)..(11): n is a, c, g, or t
  misc_feature (13)..(14): n is a, c, g, or t
  misc_feature (16)..(16): n is a, c, g, or t
gcncnnncnnnannancttacattttaagtcatctttttgtgtgtagcaaacccctcatttcttgtttctgaatgtgtgatctttgctctaattatgttgagagtgcctgttatttcacctgactctggttgtttgtgagctgctaagtagccatgaggttaaaacagactaggatcagagagcatctcagcctctcaggaccttagtttcctcctttaaaaaggaaggagattggactaaggtcatttggtcatgcaacaagagtatgtgatagataaagtaatgaacttctgttcggtgaaagcaatgaatagggctctccaaggtccctttcagctttctggttccagcagagcccaggcctcaaaatagaagtcaagattttattcagaagatagggattaccagtaccaacaataaa

SEQ ID NO: 201191 - DNA, 351 bp, Homo sapiens
actatcctatttgcaccacagaaaatgtgaaatatttataaaagcaaatagaagaaacttaaaatgaaaatcacagctgggcgcggtggctcacgcctgtaatcccagcactttgggagaccgaggcgggcggatcacgaggtcaagagattgagaccatcctggccaacatgatgaaaccctgtctctattaaaaatataaaaattagctgggcgtcgtggtgggcgcctgtaatcccagctactcaggaggctgaggcaggagaatcacttgaacccgggaggcggaggttgcagagagctgagatcgcgccagtgcactccagcctgggcgacagagcaagatgccat

SEQ ID NO: 201192 - DNA, 320 bp, Homo sapiens
gatatggtttggctctgtgtccccacccagatctcatgttgaattgtaatccccaatgttgggggagggacctggtaggaggtgattggatcctgggagcagatttcccccttgcttttctcatgacagtgagtgagttctcgtgagacctggttttgtagcactccccccctcactctctctctcctgccaccatgtgaagatgtgcttgtttccccttcattttccgccatgattgcaagtttcctgtggcctcctcagccatgccttccgcacagcctgtggagccgtgagtcaattaaacctcttttctttataaa

SEQ ID NO: 201193 - DNA, 154 bp, Homo sapiens
actgtgaaattgtctatcaattctagacatgtagtctagaatcactttttatactacattttataattgagcatcactggtatatagtatataggacagtttttggtttctataattaaaggttgactttattaaagtattaagtagatacacc

SEQ ID NO: 201194 - DNA, 410 bp, Homo sapiens
aatgcagattcctaagatatatggggtgaggataatttgtatacagatcataactggtctcgttcttccaatcctcttccaatcctctctctgaggaaataccacaaacaagatggccctctctaggtatgtccagatggtgcatttgaaaaccctggttctcctcaggcctcccagggaaagagtaggttcaagatttcattctcttcggaaattttctgaaggactctgcttttcaaggtcactgaacactctaagagacattgcatagtctgctagctgggtgtggttctgggaagacctgacaactcagtggaaatggaagtgcttctcaactttagaaagagagagcatgtggatttaactattcctagtactttcagctgggagagggctgctcttgtatcctg

SEQ ID NO: 201195 - DNA, 192 bp, Homo sapiens
gcttcagtgccttctgctgttatctggagctgtcagaaattagcctgttagactttctcttggacattttgtgtatgtaagattattaataaagtatgtgtctgtagctcaggacatcttgcagacacagactgtgtccgccttaaagtaacacccttgccccctttgggtcggtgaatgaagaactgtgtc

SEQ ID NO: 201196 - DNA, 323 bp, Homo sapiens
cattttagttgcctcctagaccttgtcagaactcattctttgagtttactaagaaacaactttttggggaggccaagatgggaagatcggttgagtccaggagttcaagaccagcctgggaaacatagtgagaccccatctcttaaaaaaaaaaaaaattgaaaaattagctgggcatggtggcatacacctatagtctctgctactcaggaggctgatgtgggaggattgcttgagcctgggagattgaggctgcagttagctattactgtgccactgcattctagcctgaatgacagagcaagaccctgtctctttaaaaa

SEQ ID NO: 201197 - DNA, 210 bp, Homo sapiens
aaaggatgccagtaagatatttaatcagtgttttccctgcaatttcaaactgcctttgaaattgcagaaagcctgtgttttcctaattagcaaggggtgtcatgataggaatcatgaacttttctatcaaataacgtttctgttctcgacagtctgtcaggtcattagagataggctgtacatttatcactccagcagcagcagaacaat

SEQ ID NO: 201198 - DNA, 508 bp, Homo sapiens
cttgaacacaggaggtggagattgcagtgagccaatattgcaccactgcattccagcctgggtgacagagcaaggcttcatctcaaaaaaaaaattatatatataaatacttctgcactataaaaagatgagtctagagcaggaacacaaaagcaagtatataatcataaaaatgaagtaaggcagatctacttagaccgcctttctcaaagtaattgacacagatgccctgtgctctaacacagtataattaatgtgtatcactcttaaagggccacattgcctgcctgtaccatgaagcatctttagagttggcactgtacagtcattaattacatgagcccctgagttaggtatcattatccctgctttgcaaacaaggaaaatcaagggtgttggtgcctagactctaagcagtgtgtggctgggctcaataaagaatcctggaatttctgactcttagcctgaacttgggttttttgcactgtggagtcaatacatcattgaa

SEQ ID NO: 201199 - DNA, 349 bp, Homo sapiens
gagaatcgcttcaacccaggaggatgaggttgcagtgagccaagatcgtgccactacactccagcctgggcaacgagtgaaactctgtcacacacacacacacacacacacacacacacacacagacacacaccaaaactatttaacctatttagatcgccaaatacccagggttataaagtttttgctgttcttgatggcttcatgccaatttcttcaacctctcaaatacaaatacgtgtcttcctccttacaaatcagcacaggactgcagtcctaaagcctcaattcaccccctgtaagtttatatcaacttattcaacacctgtggctaaacctatacacccac

SEQ ID NO: 201200 - DNA, 419 bp, Homo sapiens
cattttcaaataatatttatcttttgtaaaagtattgaagaaatgttggactaaatactgactatgagtaactggtccccttagttatggatagcatggtattaagggggtttaggtcacaggattgagtccacaagtggcttgttactcgagtgttccatggtcaggaagttagttcaactttgttcccagttttgtgctattgatcacaaaagagtcaaatgacaatatgtagatacaccagtgcaaataaattaacactattaattagtattttgtaccttgtttttctgtgtacgtggtgaatcattagtctcatttttattactgagcattttcattagtttggttgaggctggaaatgtttatgtaatttgtactatttatttgaatatttttgaaagttttgagaaaattat

SEQ ID NO: 201201 - DNA, 365 bp, Homo sapiens
ggtggtcagtaagcatgcacaggtgataccacatgcacacttcactatagattcagatggaggatggaggaagaagtggatattgggaggatgggagagatttccttcaggaaagactgggagaaatgtggcttttgagctgctctctaaaagatgaacagtgggttgagacctgcagtgagactcaacaagtcaaaactgaggtgggatctacttaacccaaaaaggttgtttatatatctgtgcactcagcaagcaggtggcaagggctgttgttttcctgtgggatgggactgtggtagaagtgctgtgtcatttagtaccttctgtgcttgtggtacatgggtgcgtcatacagtcattta

SEQ ID NO: 201202 - DNA, 634 bp, Homo sapiens
gcaatcctgagcaaaaagaacaaagctggaggcatcacactacctgacttcaaaatatgttacaaggctatggtaatcaaaacagcatgatattggtataaaaatagacacatagactaatggaaccacatagagaacccagaaataaattcacatatttatagccaactgaattttgacaaaggcaccaagaacatacaatagggaaggacaccttcaataaatggtgctgagaaaattaaatatctatatgcagaggaatgaaacaaggcccctatctcaccatatacaaaaatcaactcacaatggattatagacttaaatataagacatgaaacaataaaactactagaagaaaatataggggaaacactttaggactggtctaggcaaagattttgtggctgagaccttaaatgcatagactactaaaaaatagacaaatgggactgtatataaagtgcttctgcacagcaaaggaaacagtcaacagaatgaagagacaacctgttgaatgggagaaaatattggcaaactcttcatcagataagagactaatatccaggatatgcactaaactcaacaacaacaaaaaataaatcttttaaaaagccaaaaatgagtagacaattct

SEQ ID NO: 201203 - DNA, 506 bp, Homo sapiens
tgaaaagcctaaggctgggtgcgatggcccatgccctgtaatcccagcactttgggaggccaaggcaggtggattgcttgagctcagttcatgaccggcctgggcaacatggtgaaagcctgtctctactaaaaatacaaaacttagctgggcgtggtggtgggtgcctgtaattccagctacttgagagcctgaggcaggagaatctcttgaaccccagaggcggaggttgctgtgagctgagatcacaccattgtactccagcctgggtgacagaccgagaccctgtcttcacttaccgcccccccccgccccccgaaaaaaaaaaggcaagcctgagtggcatcaaacctttgtttcccatgaatatactagtccctgcttgatggactgttacctgggaacaggggcaaacagggagttacagtcaagccacaaatgggagatttgcaagcctgacccaagcctgaaagtgctcatctagtctcatactcttgtaaccatct

SEQ ID NO: 201204 - DNA, 304 bp, Homo sapiens
cccgcgggttgccacgttttcccagaaattaccaagtatcctatcccttgggtgagaaccactggagtagagtatagaaagtggacttggagtgaagagactacaacttaaccactggcaaaatccatcctcagactactctgcatgtctacacacccttctacacacatgtccatgtgagcattcccttacctagagactacattgtaacattacaatgaaatttgtattaaataatgaagaagcagaagtaaaaagaaaatagttaacatatacagagacacacaccaaacccatgagaatg

SEQ ID NO: 201205 - DNA, 463 bp, Homo sapiens
aatcagaaaatgcaggctctagcccagctctgccaaggattaactttgcactcttgggaaaatcacctcaatggtatcagcttcatcatatttaaaataagaggctagaaccagattagctgcttgtcaaagatgcccctccacccaccgagccctaaggctgcctagagatgaagcctttgggatcttcccccacttcagtcagagctatgcctcttctacctgctttatattgatgttgttgtttgaaggcattatagaaggagtttagttactttcaatagtttgagaccgccgaagccaaattcttcatatatataatcttttcctctgttttttaactgtcatgaagagaaattcttcctagggtcatttgcagtgctaaaaaagtttgtacatctgattaaatcttattaaagttgtacatctgattaaatctgattaaagagcttctccctgttct

SEQ ID NO: 201206 - DNA, 279 bp, Homo sapiens
aggtaggtaattagagaaatgaggcaggtcttttcctgtttggaagcagctgagtttcataaagttgggaggctgctgcactcgtttctgctcttccctctggtctctttgtgacccatcacccctgtcagtccagggcctaccttctccatcctctgtgctcacttccgacctgagacggtagcaccactttgatgccagcaatatcctcatttgatttctagtccaaacttctcacatactaaagactcagatatccacctgcccatgtaacatctc

SEQ ID NO: 201207 - DNA, 294 bp, Homo sapiens
ggcttgagaagtagcctgattgggagcccccagccccagcaaagccacaccgttgcttccacaaacacccacagtctaagccactgaggcatttgcagatactgctgacattgataacagtcaagaaatcacagggagactatgctactgcacccacccagaaccaaagccaaagtgccttacccaatcaacagtgtaggacacatctataggaaaaagtctttccctatgaaaactactccataaaattggaagaggcaacttccaccagatgtgcagatattgagagatata

SEQ ID NO: 201208 - DNA, 525 bp, Homo sapiens
aagtatgctgacggtggaggagtgtgcatgagaataggatgcctgaaatcgcaaacatatccacccacagaaacacataatctcacaaacacctattcactcaacactcaccctttgtgtcttcctgccgctttctctggaccacatttgagtcacaaaatcccaggctcagcttgagtgcaatcacaaatgtatccacctacagaaacgcataatctcacagatacctattcactcacatactcaccctttgtgtcttcccgtcgctttctctggactgcatttgagtcacaaaatgccaggctcagcttgagtgcaaggctagccagaccacacatagggcatgaaggagaggccgttatggttctcggtaacatccacgtatgtttctatgctttggccacccagatcacctcagctgcaggtccattcatcaatattacgtatctgccaaagagtttttgtttatgtacatctaagaaatttcaacagaaaggagataagcccaacaccattatccattta

SEQ ID NO: 201209 - DNA, 340 bp, Homo sapiens
aaccctcccagtacatcagaatcaccttagtggatttttaaaatacagatgccagggctctatcccaagagaagcagttagttgaaggtcataggaaataattattttttgaaagttttcccagatgatactaatccagtacaaaacaggattaaatgaagtcatcatagtccttttctgtcagaataaaggaatagagcttccattcaaagaatggaagttttataaattctatatctaggctaaggggacataatcataggttaagtggagaaaactgtgactcaaatactttgtgtgacttgattgaaggatgatatttttctgacagtgtgtcaac

SEQ ID NO: 201210 - DNA, 294 bp, Homo sapiens
acaagctttagaatgacaaaggcatgacaacaatttgttttgcagtaaatgataatacattattttcctgtaaaggagacaaaatgtgtataggatatattgtctgcaccaaaaaataagctcctttttgggcagggaccttttcttgcaaaactttctatctcctaggatgctttgcatataccaggtaagcattaacattcactggccggatagggggctcatgccagtaattccaacactttgggaggccaaggaaggaggatcacttgaggtgtggacaatgtggcaaga

SEQ ID NO: 201211 - DNA, 395 bp, Homo sapiens
atgatctctcagtggagggtttttgcagggtcttcttggttaaaggggccttttgaattaaaacggaagaaaatgaaggcccttgcctcatgaacatcagagcttggagccagactggcctgtctttattccctttcttctgtgtagagctggtggtcccttctgtttttcaaaaatgaagatgcttggatactcaatgcctggacttgctcattctaataatataatggtgaaatattaacttatctaagtactggaagcttcaataaccattctgcctgactctttgagcagaaaagactgtggaaaaaccactgtgctctcattttcaccctcacaccccacaaccctccattaatttccaggcatcacccttcattagccaccccagggct

SEQ ID NO: 201212 - DNA, 236 bp, Homo sapiens
tccaaaccatatcaataggtctattcacctgttgtctagagactgtgacactggtgtcctgactggcctcttgccacctgtctcatcccagaccaactcattcttcacactattgccaacattaaattaaaaatactttcggctccgccctgtctcttgattgtggaatcagagggatctcacaatccagttctcagtgacattgactgtgtttctttacctgttcctgtatgtga

SEQ ID NO: 201213 - DNA, 459 bp, Homo sapiens
ccaaatttcaaggatgctcaaggtccttgatataaaatggtatagtattgcacgtcctcccttatactttaaattatatctagattaacatatactagcaaatacaatgcctgtacatcacttcattcacatggattcaacttagtacttggtgcatggcaaatgcaagttttgctttttggaactttggaatttttttccccaaatattttctatcctagattgctgaatccatgaatgcagaacccacaaatatggagggctgactgtatttatcaaacatcaggttgtataccacaatttttttttattatactttaagttctagggtacatgtgcacaacgtgcaggtttgttacatatgtatacatgtgccgtgttagtgtgctgcacccattaactcgtcatttacattaggtatatctcctagtgctgtccctcccccatccccccacccca

SEQ ID NO: 201214 - DNA, 339 bp, Homo sapiens
gtagcccaagaactcaaggggctagcctgtgagctctagggaccagcgaaacttagacaaaatgcagtagactaacaaaatcagatcaaacaattactgagcttttagccaaatgccagatagtgagagagggcctggagatatggtggggagtaagaaagtttctgtcccaggggaatctcaagttctgaaatgatagtgtgccagaattgagaccaggagcacttattcattcactcaatatgtatttattaaagttctatgtaccaggcactgctctaggcaaccagaagcagaataaaacaaaatatgggtccctgcccttatgaagtttgcttt

SEQ ID NO: 201215 - DNA, 197 bp, Homo sapiens
actgggcaggattattaattggagaaaggaggaaaggggaaacatgtaactgttccaccaaatcatgcctctctcttctttctctttctgaatttcaatcgggaaatgacatgcatcccctgccagctgtattacttaactgccacctcagacaccatctcctaatgataggctgtttcgggagatggctatcacct

SEQ ID NO: 201216 - DNA, 191 bp, Homo sapiens
tctttctctcccatcggaattctctcattctcctacccatagtgggagctaaggatgtttcttgcctcctaagacttggaagtcttgcgttctcccacatcagaaacctacctgacccaggcgctcctccctcaggaactggatgttgacaatcaacatgggctgatgggagaaggtgaacctcccacacc

SEQ ID NO: 201217 - DNA, 472 bp, Homo sapiens
caagccttgaatgttgaaagagtacgctgaagaaggtctaagcattttgtacaaaatgggtgttacatttagttttagtattcagcgatttcatgaaaggaaggagatttgcagaggttccctgttcagataggcgactcgttgagggaagttttctagtagctgctgcaatttcagaagtgtgttccatgactgaagagatagaaaggagactatggtacatggggaaggaaattctctctgctgggctctcggtactctcccctgactgccttgctcccctgcaaggcatacacacactgctttaaaatataggggatttatttttcttgtgaatgtgaaacactgaatcagcaggtgctaattggaaatagagttttgtggactactcaaggacagcagtgtttccctttggggccacaaactggactttataatttcctattgaatcactgcaacaggcttcagccag

SEQ ID NO: 201218 - DNA, 448 bp, Homo sapiens
tatttataaagaacatatcaacaaggggttcaaacccagtgatacagctaggaccatgtagatcccaagagatagcagaggcagagctgctaggctggtgggctgagaaactaaagcagaacatccaagcttatccacaggcaggccaaaggagctgataaaatcaccgagagagagtaataactttctgggttaagttagtccagaaggcaaggaggtggtgggggttagaagactgatcgaccaataaataacataaaattacatgtcaataccacttacatcaatacaaatacccaaaatgaaacataaccaaacaaaatccagtaccagattaaaaacataatatacaacagacaaataggacttattccaacaatatagactagtttaatatttggaaatctattaatatgataagccactataacacagcaaagaagaaaaa

SEQ ID NO: 201219 - DNA, 409 bp, Homo sapiens
gtttggattgacaccagaattatttccctcacttagatgcatacagttttgaaaataagaatgggaaatatctctaacaactgaccaaataactcactcagaaatgaagtacaaactcattcttaaaaatcaaagagaaaggccgggcgtggtggctcacgcctgtaattccagcactttgggaggccgaggcgggcagatcacgaggtcaggagatcagaccacggtgaaaccctgtctctactaaaaatacaaaaaattagccgggcttggtggtgggtgcctgtagtcccagctactcgggaggctgaggaaagagaatggtgtgaacccgggaagtggggcttgcagttagccgagatggcaccactgcactccagcctgggcaatagagcaagactctgtctca

SEQ ID NO: 201220 - DNA, 336 bp, Homo sapiens
accagcctccccgctgcacttaaactctgacaagtcctttcccacctcccagcccatgcgcttgcaaactgaagtgtacctgtcaatcagctgggggccttgtcaaaagcagattctgctgcggtggatgtgaggtgagcccaagctcccacggtgatactgccaagtccctggagcacacgtggaggagctttggcatgcagtaggtgctcaacaaaattcatctcctggtgttatattcacctgactaaatttagaaggaactgtgtatctgaccctcctgctgggattaaattggaatcgcttcagatctatgcaagaccctgacttaaatct

SEQ ID NO: 201221 - DNA, 546 bp, Homo sapiens
ggttcatgaggatcaaactagatctcatttggttttccacaaagattgggactatgcttcctgggagtcacagcagaggtcagctgcacctgatctaaagccttatccctagttttccactttgccattttcttgttttaggtgagccccatgcccaatgcccagactctagtatttttttctagagatgcactgtactccagcctgggcagagtgagactctatctcaaaaaaaaaaaaaaaaattgggacttcccgtgcctcttatgtgtcagtttccgaaaacggacatagaggcgggggttgaaaaaggtttacaaactagacttctcttttctccaatcttaatacagccatccatttcataccatggtctcagtcaacagcggccgtgttaagatggtaggggagatgaaaatttcttatggcctagggacatggtagccatgtgattgtagtataacacatttactcacttgttgtgtggtgttgtggttgtaacaaagcttatggagcggccaggtggccaaataagtgtatagcaaa

SEQ ID NO: 201222 - DNA, 485 bp, Homo sapiens
gcgtcgacgggtggaggagtggcagaggatcccctggggagagcaaagtcccagaagacagaggaactccagtggcccaactcctcaatcttggagcgccagagctcagccgagctcaccggctccctagggagctggggcaactgttagctccccctgacctgtgtgatcctacgtccagtggctgccccgacctctgtgatcccacgtccaggggctcccccgacctctgtgatcccacgtccagtggctcccccgacctctgtgctcccacgtccagtggctcccccgacctctgtgctcccacgtccagtggctcccccgacctctgtgctcccacgtccagtgggtccccctgacctctgtgatcccacgtccagtggctccccctgacctctgtgctctatgtccagtggctccccctgacctctgtgatcctatgtgcagcggctgctggcctctcaaacttaatgtgttcattgcgg

SEQ ID NO: 201223 - DNA, 357 bp, Homo sapiens
aattagccgggcgtggtggcacgcgcctgtagtcccagctattcgggaggctgaggcaggagaatcgcttcaacccgggaggcggaggttgcagtaagccgagatcgcgccactgcactccagcctgggcgacagagcgagattcggtccccaaagagaagaagaagacccgcagtaggaggaagagagaggaagtggagtcggccagctgggatgctggaagccactggatagctcaggctgagagagggcgctgtgctccgcaagcctccctgcaaccgcaggcctcgggccgccttcctccaggaagacgctccagacttctggtatccgttgagatctagtttcccttgagac

SEQ ID NO: 201224 - DNA, 350 bp, Homo sapiens
tcccctcctcacaccatttcctgatagttctagaaaaaaaaaaaaagcagtgtggggacacatttatgatttccctctccacccaacctcccaccaatagcttcttaacgctaaaagaagtctcttgatcagggtagtggggacatagtgaatacctatgtaaaaattcactgagatgtatgcttaggatttgtgactttatgtttgtcattccccaataagaaaagatcctttaaaaagtcacttaaaaaaaaaaagaacctagcaaatctgaaacagagaaaaatatgcatctgctaaagaaactggggaaaggccataaaaatgccagcaactgtgaagaattcttt

SEQ ID NO: 201225 - DNA, 199 bp, Homo sapiens
gccttctactgcaagggtttggtaatcatagcaatcactgaagccattcagccagagctgagagtaatgtcattcatagatgctgtttgttacgttttataaatcaatcttatccgtgcaacctggaaagttcatctcttgtttaccttcagtacaaagaaagtccattgtacatacacaaaacagcccccaaacagcc

SEQ ID NO: 201226 - DNA, 491 bp, Homo sapiens
tgcacaggggtgactcaagagctaattctttatactaaaatttcattcttcaatttactgtatggattctgcctcgtaaatggaccttgcttagcacatgtaccataaagctacagtaaccaaacagtggcataaaaatatagacagatcaatgaaatgaaagacctaagaatatataaataggtctcaacatatatagatcatggcaattcaaagaattgataggtttttcaaaaagtgatgctaaaaaatttatatccatgtgaaaaatattacccttgacccttacctctatcataaagaaaaattaaattgaattgcaatacagacttacatgtaaaactgtaactggaaacatctagaagaaaactgtcatggccttggtagtcaatgctaccttaagaaacaaaagcaaaaatcataaaagaaaaaaattttttcattaaaagggcttcttaaaaattcaaaacttccgctgagaaatagcttta

SEQ ID NO: 201227 - DNA, 529 bp, Homo sapiens
agttgggtattcatatgggggaaaagttgagttcataccacattctatatacaaaaataaaatccagatgatataaaaaaccttatttaaaaaaatacagctataaaataagcaaaaggacagtgttttataatgatagggtggtgagggaattcccaagtaagccacaaaacccaaaaaccataaaggaaaggagttagacatcttcctgtgtcaaaactctgagtgtgtctagtgaaagctgccataaacaaagttaaaagacatgtcatagataggttccacaacctctataacagacaacagattaaaatctagacaactgaaatctttcaaatcagtacaggaaagaccaacaacctattagaaaaatagacaaaagattaaaacatgcggctcacacaagaaatgtaagtagtcagatcacttgagctcaggagttggaggctgcagtgaactgtgatcacttttgtgaatagccactgtacttcagtctgggcaacacagtgagaccctcatctctttaaaa

SEQ ID NO: 201228 - DNA, 466 bp, Homo sapiens
ttgttaaacgtttctcaggagagaatccaaaattgatgtttgcacttcagtagtaaatcattgaagatggagaaattatgccaagtgactctctcaagcctttttaactcagacgcactgcctcctcaatcagctcagcagataaacctcaactaccttaagcaaagacttccttacttttacactttcagtctctgtctccccacttttccttccaacttctgacttttggtgactcttacttccataccttccctctcttttccactgccctccttctcctcaagaacaatataagacttaaggatgcattctctaatcaagcacagagagcttggtgatgaattacccaaaggacaaaaggtagggagctgaaggagaacagatcataacttgaagcactcaactttatattgccaactttcattcttaataaagaagtggttaaaatggttataaatagttc

SEQ ID NO: 201229 - DNA, 486 bp, Homo sapiens
acatagaaatggtattgaaacctgcaggactaataaaataatctagcaagagagtagagataaagaaaagaaggccagaatcgagctatagcaccgtcacacagttagtctgatagagtagaggagccaagaatggagatgggaaaagatcagtaatgaggtagaaggaaaattaagagtgatgtcacagatgtcaaaaaggggagtggctcaagaaggcagttgttttggggagtaccatgaccacctactagtgatttgctggaaggactcactcacgactcaatatagaatcatattcaaggctaagatttattacagcaaagggtatggtgcaggaacagcaggatacagatatatggtggcaaaactagagaagtcgtagtaggctttcttgtcctctctctgtagggattccacatgtttctcaggaatgcatgtttctctccagctgtaaactgcagagacatatgcaaaacgcctcca

SEQ ID NO: 201230 - DNA, 270 bp, Homo sapiens
tattgttgtgctgacaccaacagacgttcatcctgagccagagtttcacatattccctgggcatgactaggaacaggtgcacccagtctatctcaatttacttgcatggatcaaaaatgtttccctaatatattccacaatgattatattgcatactccttaatttatgaatttcctattaataaagagatatcataattgaaaaaagtcatcaaccattgaactcttaaattactttcaattcgactgcttggattacaaggaggggtg

SEQ ID NO: 201231 - DNA, 345 bp, Homo sapiens
tgtgacggcttcagaatcaggtggagggcaactgagaagaatggaaaccacctcacattctctcctacctggtctaactttacagacgaaatgcatctttcagctgcatcacaagagaggaagccaaggtcgtagggtcttcatttctgaaaactgattgttcaagtaaatccttcagtcgtccccctgatgcgacctgctagggaagctgggagtgccttcacagtggctccaagggggtgtccttataggggattacatctcaagacacattttacccagcaagaggctgcatgactcagcagtctgatgaagaaagctctgttaagttaccaccaattgcaa

SEQ ID NO: 201232 - DNA, 280 bp, Homo sapiens
tccattcctccctccctccatccatccactcattccttcattaaagtatctctggcctgccaggtgctgtgctgggttctgagacaaaggtgtgaacagagacccacagtccccgtcctcaaggagctctagtttgagtggcaggaaggagggtggacagtaaacaaatcactcatttggcacagctgaggccagcactccagactccagcctctctcacaccttaaaggaggccgagttccactagaaaccgtgcctatggacatgaatagacgttctt

SEQ ID NO: 201233 - DNA, 921 bp, Homo sapiens
tttgtgaggtaggtggtatgatctttcagcctgtggaaacagctgccattgctgtgactcctgacgatctgtttttgatcagttagtgcagatgcttagatcatactgtcccagttttgcattaatttgatcaattctattgattacagagaagtgaggcccaagactaagccttgaaatctctaagtagctatttgctaccttgtaacactgttctgtttcatttattgaaacactaactcacaacatgttggaaatattaaggaaacctgatagtgtactgagggattctgtttcttttggtaagagttgttggcagctatctggtagggtgtctttatacttctgaaatcatttattgaccacttgaatgtcttagtattatacacagcaaaaagaccctgatgagatatattcacttcctgtgtatccagtcatatgtttagtaaggttgctaatgatttattttgggtcagaacaaagtaatgtgcatttcatatgcattatattttatttcttgtgtaaataggccattagggagatagactattaaatttaccaacctacactactgcttctgtcttatgaacacaaatttaaaaattaatctttatcacttatagcactttaaaaattctgtttttagaaataattttcaatttttttttttttttttgagacggagtctcactctgtcgcccaggctggagttcagtggcgtgatctcggctcacagcaacctcgacaacctccacatcccaggttcaacgattcttctgcctcagcctcctaagtagctgggattacaggcatgagccaccgtgcccagcctttatgcctggctaattttatatttttagtagagacagggtttcaccatgttggccgggctggtcttgaactcctgacctcaggtgatcc

SEQ ID NO: 201234 - DNA, 503 bp, Homo sapiens
cttgtgtttgccagttgcaaagtttccttgatcttaccaacaccagtgtccgcagtaaggacagtactgatgcaaatcagtaactgcattagtaaaaaagaatgtgaagactcaaactttgtaaaggctaaaagttgcacccacgcctggggcctgaggacagctacatgctgctgtgtggttggagggtgctggatggtggctgcggatctgtggtactgagaatggccatggtcacagcccggatgagcattgcctccttcctagggagacacatggcctggaacacacagcggctgcagccgggcagccttggagcataggttggtagcgctttcttcttgacgaagctcccactctgagtgcctcctccccagctctgctttcttaggctttgtggtggaaggggcaagggcagcccaggcttgcaggaggctctggagaaggttctgacctcagactgcaaagcggaccttggcactcagcctcacagacacttcaat

SEQ ID NO: 201235 - DNA, 603 bp, Homo sapiens
ggcaccttgatcaatgctttgtgttgtctcatttaaaactcctaaaccacacatcacagactcagagctgttaaatggcttgccgttaaaatggcggaaccaaaagcagaaatcagcccatgctcttcctcccagaccaggattactttaccctgccatcttatctcatctggaaaatgagagtacagatatctttctggcaggaatgggcattaatgcatgtaagactcccaacacagtatctggcatataactagccctaaggaaaaagtaggtgtcttagggtggcaaaattttaagatggagagttgaaatcaaaaatgtaagagggaatcctgatgctcagagatctaccttgctcagggttacacaatcagaagtggtgtggccaaaatttgagcccaaatgacttcaatgtctgtggtctttccagaataccacctttctcaaggacatcatcaggcttaaacatacaaattttccaaaatacaaggctacaggagccctgctcagatgggtcaaattttattatgttttgttttaaaagaaatccaattaggtttggatgtgtgtatgtacatatgtacacagcaaggtaaactg

SEQ ID NO: 201236 - DNA, 239 bp, Homo sapiens
caaattcaacaattggttaggtgtacttacgtagcttcttaatttgtataatcaaggtggaaatttcctggttatgtaatcagagcttatttggcagtttatagttgtttaagcctgaaatttgtttccccaaatgtagtaatttattaacaaatcaacttgagtttacatttttttacaagtaggaatctgaggactagagccttctcagtctaattgcctgccgcttaattattttc

SEQ ID NO: 201237 - DNA, 443 bp, Homo sapiens
cacccatgtttcagaaggcactaattgtcgctttgggcgcctcagtgtcataactgtagacatcattcttgggagttgttggggggaaaaatcctagctacttaaggtttctgattgattcttgataaagtgaagattattgtgtgtggtgaatgagttcagtgagtccccatgatgcagtagtttttttaaaaaattagagagtaattatatcttttatggaaaaaagttgttttagtttgtcaggttttccctctttgaactgtttttaatgtttacaaacctcactttagctctaacattttgtgtttagccctcaccaaaaagcacttactgtggcaggaagattttgcagtaacatggagaaatccccaagatcaagtgctgacaaatgttgacagctttagcagcgtactgtgtaataaataactccgagggggcgg

SEQ ID NO: 201238 - DNA, 497 bp, Homo sapiens
aatgtctcctacctgaacaaccatcctttcagttggttccatctcaactaggtgttccattgtgccaggaatcaactcaggatgttttgtctgccacaatttcatgttttctgtcctcttgaaacaaacacctccagctgtaatccacaggcttgttagacttataaggagttcatcagatacctttaagatagagaactttgtggcttttttcagttgaatgtggaagatacacggcttaattttgctgaggtaaaacagcaagctgggttaggggcacaggtgtccttgttgctggaaggtttagtgtcttgtctttgcagaatgtgcaggagtttagtgaaattgattaaatatttctattagcctctcaagtacattatgttattattcatcatttcttatattatattgtgtttctacaccataaacttgaagagtaaaccccaagtgtgtgacgactatacagatattgacctttaaaaaaaaacttttaa

SEQ ID NO: 201239 - DNA, 632 bp, Homo sapiens
ttcctcctttgtctcaggctggggcaagtgaacttttggaagcccctttgttccttactaaagttacatattaccactctctctttcctatctgtgcacaattaacagtcagccagatcggctttcccaccctcccagcttccttcataggatacaccagccacctgggcctttcctggaagaaatgaacagctacacactatttatggtaacggtcagaattcaagggatggagaccctttgtgggctccgactgcttctcccaaggattcatggcctcctggatctctgcctgagtccttagtctacccacagttcaagttcactggggctgattctactgaagaatacacagaggttaattttcagagggtcaagtcttcttttcctgccttgctagaggagtcattctctacaaaaacaaaaaaagatttttaaatcaatcttctgataaaacttgcacaaaaggagacttttcaatgccttttgttattgagataaattagcccaactcaaggttggggtaggtcatggtatggttcttcagtttctcccattacagtcttcttggcttatgaggcagtttgtgctcctgtaaactccttagcacataccagcacacccaactgagc

SEQ ID NO: 201240 - DNA, 555 bp, Homo sapiens
ttagccatatgcagaagaatgaaaccggacccctacctttcacagtatatgaaaattaacttgagatggattaaagatttaaatgtaagacctcaagctatacaaattctggaagaaaacctaggaaataccattctggacattggccttggtaaagaatttatgggtaggtccccaaaagcaattgcaacaagaaaaatgattgacaagtggaacaaattaaaccaatgattcttttacctccttgcatttgtgcatgccatttattctccctgaaatgatagcctaccgttagcaaaccacccttggccttgcctcatccttatgttggataagaccattcaagtcgtagcttaaaagtaatttctgtgagaaaccttttctgatacctcaagactgcgttgagtgtccctcctctgatcttttctaaaactgtgtactagctttctatcagcacttgcaacttattcatttctttttacttgaagaaattacaatttccattgtaaacccactgtctatcgtaagaccttgtaaatggatgagtgggaaaag

SEQ ID NO: 201241 - DNA, 390 bp, Homo sapiens
atctaacaccgcaatctaaaaaattagaaaaattttaaattaaaaaatctaacaatgtattccaaagagctagaaaagaacaaaccaaaccccaaattagtcaaaggaaataaatatcagagaaggaataaacaaaattgagactaaaacaatactacaaaaaatcactgaaacaaaagttgcttagctagactaagaaagaccaaaataaataaatgagaaaagaaaaaggagacatcaaactgaatatcacagaaataaaaaggatcattagggactactatgaagaactatacatcaataaattacaaaacctaaaggaaatggttaagttcctggacacatacaacctttcaatattgaagcaagaagacacagaaaacctggaga

SEQ ID NO: 201242 - DNA, 1105 bp, Homo sapiens
gggaaatttaagcattttctgcttttccgaagtaaattttctaatgtttttcttaaagctgaactaaattgcaaaacttgctttaataaagtgtgtatttttgcatcagttaagcccctgacctctttatgttctttaaatttgattcattagtgaaattaacaaggttctgtgtttttctcacctcattcagttttataattaaccaataaaagcttattagcttttaaggaagttttaggaacttaaattgatttatgggcaccatatggttacatcaaaggacttgtttttgttttaactggaagtggattcttaagtcctttaagatggaaatttatgttctttctattataccaagcaatactttctgataatagttagtgatttttttttattccatgctaccagttggtcatgcaattcaaatattaaatactagattacagatattagaatcttgtaatgcatctggtttaatacctgtcattttgtagaacggttaaatgtcttcccaaggtcatacacctaatcagtggtatattcaaaacccaaatcctaggcttcctatctgaagtccattgcttatgaagtggtttgctatgtgttctgactttgttgattcaaataagtaagctaaatcaatttaagccattaataggtttataaagttatttgctatgtgttgttcttacatcattgattcatgtaagtagacttgtgtgacagctaattcttaaaaaattatgaagatgttagacttcttttgatatatatatgttgattgtatgaacagattgacatcaatatacttattcattataaaagatttgagtgggaactcaccaaatcccacaccaaaaaatttaaaattttaccatagtaaaaaaaactaaaaagcaagatgaaattatacatagttcttggtgtagtatttttaatttttattatttatttttatagaaatggggtctcaccattttgccaggctgttctcaaactcctggcctcaggcagatcacttgaacctgggaggcagaggttgcactgagctgagatctcgccactgcgctccagccagaatgacacagcgagaccctgtctc

SEQ ID NO: 201243 - DNA, 202 bp, Homo sapiens
catgtctatgaaatctatatgtgattcagtttttgacctttagaaatacacatgaattatttattgaaattaaaaaccaccaaaaagaacttaaattgatgagtttttacaaggtgaacagacaccaagaaactcagtatgatctgaaccccagaacctcactgaagtcccatttagtcactacctgcttcccaaacataac

SEQ ID NO: 201244 - DNA, 641 bp, Homo sapiens
aattccccaaatcacagtaaatagccagtttgggaagaattttaagattggataattgctggctttaaaggggtttttaaatttccttcgtttgtcttcttcacaagaaatgtgaagcctcttaaaggcttctttgccattacacaatggaggcagtgtacaatagtggagagatcatgggctttaaagccagatagaacctgggcttgaattgaatcacagctctgaagcttaccagctgtctggactttagtcaagcttctgaaccttacttttcttgtctataaaacttggatattaaaatagctatttcacaatgttgttaatgattaaacaagatgacacatgtaaaaagcttacaacctgacacatggtaaaggttcaattaatttgtaaacctttctttccccaaacttaatggagtagagacttttaataattgaaatgagaagtgtcttgcatgagaaaatcaagaaagtctgtttatattttctaaattcagaaaataatttttgagcaaactctagccactggggaatttttttctaagtgactaaggcccagtcctccagctactcaagagagaaaggcacattaataatacaattactgaacaagataagaggtggaaataatgtgtt

SEQ ID NO: 201245 - DNA, 401 bp, Homo sapiens
aagttgatgaggaaggaaggggtgggatattttggtccctcctgagtgtactgctgcttccattttactctcagagctcagcatgaccatcattattatatctcaccaggcaaccaaaagggcaagccactcaacagcatactcaatggtgagaaactgaaagcttttcctctaagtttagaaacaaggcaagaatgcctacgttgtgcacatgtaccctaaaacttaaagtataataataaaaaaaagaatgcctactttcaccatttctattcaacatagtactggaaatcctagtcagagcaattaggcaagaaaaaaaatatattcaattcagaatatgtgtattgtccgtttgcagatgacatgattttatatatagaaaatgctaaagactccta

SEQ ID NO: 201246 - DNA, 588 bp, Homo sapiens
agtacacaacataatgagatataaaagaacataaattgaactagaatgatataccccaagttcacaatagtggttgcttctggagagtgagaaagtggggattaatgtataattatatgccaggtgcagtagctcacacctgtaatcccagcactttgggaggccaagacaggaggatcgctttgagaccagcctggtcaacatactgagactgccatctctacagaaaatgtaaaaaattagccgggtgtggtggcatgcacttgtagtcccagctactcgagaagttgaggtaaaaggatcacttgagcctgggaggtcaaggatacagtgaactgagatcacatcaccgtgctctagcctgggcgacagagacagaccttgtctcaaataaataaataaattaaatattttttaaaaggccaggcctggtggctcacgcctgtaattcccagcactttgggagaccgaggtgggcagatcacgaggtcaatagatcgagaccatcctggccaaaatggtgaaaccccatctctactaaagatacaaaaattagctgggcatggtggcttacacctgtagtcccag

SEQ ID NO: 201247 - DNA, 338 bp, Homo sapiens
ctgcaggtaccagcacatctgggcactttctccatggtccgctgtcctaatcctgactatttcagcacccagggagcaagccaagaacaaaaacacctatcatccatgcccggcattagaaaatctcattgttggtgagaatgatggtttccagcttcatccgtgtccctacaaaggacatgaactcatcgttttctatggctgcgtagtattccatggtgtatatgtgccacattttcttaatccagtctatcattgatggacatttgggttggtttcaagtctttgctattgtgaatagtgctgcaataaacatacgtgagcatgtgtctttatgg

SEQ ID NO: 201248 - DNA, 493 bp, Homo sapiens
ttccttgatgcatactattataggctccgggatggtaactgattcaaaaacagtatgtttttaatgtatcagtcagtagctgaagccaatctgaaaatgtgtttgactcaagtttttcccccttctatgccgatctcttgtaggttggaggaaagatggtaggcccaaaggctgtattccttattttcactgctaattgttttgtcctgttcttcacttctgttctttgtagcatgtatggggttttatggatggcccaggggaggtagaaaaaaacaataatgttctgaacttcaaagatatgtgagatatcacgtcagaagcaagcagcagagagatttctgaagaaaactgtaaataagccatacaaactataaataacttttctgtcttatgttgttgtttttttttttcctgtgcttagtacaaatctaggaattaagtcttatttttggctcaaaaaaaaaaaatcattgtcgtatacatcctgcag

SEQ ID NO: 201249 - DNA, 217 bp, Homo sapiens
ccaccgaggcaggcgctatagatgagtggtcccaccaggccatctccgtctccagcgactgccgtccaccctatgtccagcctccaaggccgaggttaggtggtagccgcagtgaatcactcgcgattcgcacgttacacacgatggcgacatgtggggccgcacctgggttataatatgaatatatccttgtatataaatatgtgtttgtaaaaac

SEQ ID NO: 201250 - DNA, 1967 bp, Homo sapiens
tccaggcgcaggccgaggccttcgcgcgccagatctacgggcccgagtgcaccttcaaggccagccacggctggttctggcgctggcagaagcgccacggcatctccagccagcgcttctacggcgaggccgggcccccagccccgagccccgcgcccggcccgcccgtcaaggaggagcccgcgctgccctccggcgccggccccctgcccgaccgcgccccggccccgccgcccccggccgagggcggctacggggacgagcagatttacagcgccagcgtcaccggcctctactggaagctgcttccggagcaggctgcgcccccgggcgcaggggaccccggggcggggggctgtggccggcgctggcggggcgaccgcgtaacggtgctgctggccgcaaacctgaccggcagccacaagctgaagccgctggtcatcgggcggctgccggacccgcccagcctgcgccaccacaaccaggacaagttcccggcctcctaccgctacagccccgacgcctggctcagccgcccgctgctgcggggctggttctttgaggaatttgtcccaggcgtcaaacgctacctgcgccgaagctgcctgcagcagaaggccgtgctgctggtggcccacccgccctgcccaagcccagctgccagtatgcccgccctggacagcgaggatgcccccgtgcggtgcaggccggagcccctcggtcccccggaggagctgcagacaccggatggcgctgtgcgggtgctgttcctgtccaaaggcagcagccgggcacatatccccgcaccgctggagcagggcgtggtggccgccttcaaacagctgtacaagcgcgagctgctgcgactggctgtgtcctgcgccagcggctccccgctggacttcatgcgcagcttcatgctcaaggacatgctctacctggctggcctctcctgggacctggtgcaggcgggcagcattgagcgctgctggctgctgggcctgcgggctgccttcgagccccggcccggcgaggacagtgctgggcagccggcccaggccgaggaagccgccgagcacagcagggtgctcagcgacctcacccacctggcggctctggcctacaagtgcctggctccggaggaggttgcggagtggctgcacctggacgatgatgggggtccgcccgagggctgcagggaggaggtgggcccagccctgccccctgcagcgcctccggccccagccagtctgccctctgccattgggggcggagaggacgaggaggaggccaccgactatggagggacctcagtgccgactgccggggaggccgtgcgggggctagaaacagctctgcggtggctggagaaccaggaccccagagaggtggggccactgaggctggtgcagttgcgctcactcatcagcatggcccggaggctggggggcatcgggcataccccagcaggcccctatgacggtgtgtgaccaggccagcccagtgacctttctcctgctgcacttggagggaggggacatacacacagtctcccatctctcctcccctccccctggggtggcccaccgcatgggtacagggggttccaggaatccaaatccagcatggcttggaggagctctgttggtgagaggtcgccctgcctcactggcaccctgggggcacagctggaagagaggcctggcccatgctcctctcagggcaggcacatgtacggggcatacaaggcacagcgcctgttggaacaggtggctgtgttcctgctctggcccccgtgcggctgggcctccgcccctgcaccagtcacatgcactggacgagggccgaaactcctgtctgctatcgagccctggtgctatgtggccccggagccacagcacaatcatctcagtggcgaagcacaccacttgattctatttttttttaacacattaaatctgttttta

SEQ ID NO: 201251 - DNA, 1738 bp, Homo sapiens
  misc_feature (1718)..(1718): n is a, c, g, or t
tccaggcgcaggccgaggccttcgcgcgccagatctacgggcccgagtgcaccttcaaggccagccacggctggttctggcgctggcagaagcgccacggcatctccagccagcgcttctacggcgaggccgggcccccagccccgagccccgcgcccggcccgcccgtcaaggaggagcccgcgctgccctccggcgccggccccctgcccgaccgcgccccggccccgccgcccccggccgagggcggctacggggacgagcagatttacagcgccagcgtcaccggcctctactggaagctgcttccggagcaggctgcgcccccgggcgcaggggaccccggggcggggggctgtggccggcgctggcggggcgaccgcgtaacggtgctgctggccgcaaacctgaccggcagccacaagctgaagccgctggtcatcgggcggctgccggacccgcccagcctgcgccaccacaaccaggacaagttcccggcctcctaccgctacagccccgacgcctggctcagccgcccgctgctgcggggctggttctttgaggaatttgtcccaggcgtcaaacgctacctgcgccgaagctgcctgcagcagaaggccgtgctgctggtggcccacccgccctgcccaagcccagctgccagtatgcccgccctggacagcgaggatgcccccgtgcggtgcaggccggagcccctcggtcccccggaggagctgcagacaccggatggcgctgtgcgggtgctgttcctgtccaaaggcagcagccgggcacatatccccgcaccgctggagcagggcgtggtggccgccttcaaacagctgtacaagcgcgagctgctgcgactggctgtgtcctgcgccagcggctccccgctggacttcatgcgcagcttcatgctcaaggacatgctctacctggctggcctctcctgggacctggtgcaggcgggcagcattgagcgctgctggctgctgggcctgcgggctgccttcgagccccggcccggcgaggacagtgctgggcagccggcccaggccgaggaagccgccgagcacagcagggtgctcagcgacctcacccacctggcggctctggcctacaagtgcctggctccggaggaggttgcggagtggctgcacctggacgatgatgggggtccgcccgagggctgcagggaggaggtgggcccagccctgccccctgcagcgcctccggccccagccagtctgccctctgccattgggggcggagaggacgaggaggaggccaccgactatggagggacctcagtgccgactgccggggaggccgtgcgggggctagaaacagctctgcggtggctggagaaccaggaccccagagaggtggggccactgaggctggtgcagttgcgctcactcatcagcatggcccggaggctggggggcatcgggcataccccagcaggcccctatgacggtgtgtgaccaggccagcccagtgacctttctcctgctgcacttggagggaggggacatacacacagtctcccatctctcctcccctccccctggggtggcccaccgcatgggtacagggggttccaggaatccaaatccagcatggcttggaggagctctgttggtgagaggtcgccctgcctcactggcaccctgggggcacagctggagagaggcctgcccctcggccgattnaaccaccgcctgtacctagc

SEQ ID NO: 201252 - DNA, 446 bp, Homo sapiens
ggcccaggctggagtgcagtggcgtgatctcggctcactgcaagctccgcctcctgggttcacgccattctcctgcctcagcctcccgagtagctgggactacaggcacgtgccaccacgcctggctaattttttgtatttttagtagagacggggtttcattatgttggttaggatggtctcagtctcctgaccttgtgacctacccgcctcagcctcccaaagtgctgggattacaggtgtgagccaccgtgcccagcctaaaaactggttttaaaaaaataaactggttgtagttaggcagggtgacatgcacatgcggtctcagggactcaggaggctgagacaggaggatcgcttgagcccaggaattcaaggcctgcttgggctatagtgagaccccatctctaaaaaaaaacctggtttgactttgataataatacctt

SEQ ID NO: 201253 - DNA, 874 bp, Homo sapiens
cctatttagcaccccatccctaagaaagccccatttatagcagtttttgacaccatggcttcgtgtatatcaaagcagggccttggagtatttgttaccagctgggctagcccagtgcaggccgttagcctagtgcaggccgtgagacagatgggatgtgggggcccaagtcactgcaggagcctccccagctgagctggcaccacatgtggctttggggggtggtttctccactcatgttctctttgttcatgatgtccaaacccgatctgtccctggtatccaaatctcctctcatcactgtccatgggtcaggggtcctgcaggtccccccaagagttcctgattcctctgcccaagccacacactgcctggtgcccttacctccaacctgagccactcccctctcctgtgagccccatgccagagtctatatactcctccttcctgctcctccctggtgccaagggagcacagctcctggagcacctctctgaggacagggctccaggaggactgctggccacatcttcatgcccagacgatggtcctgctgagccggcggttgatcacatctagacttgtagagtccaagatgctttccctccacgttgaaggtcagaggcttcccaccccaaccctgtgctggtccacagagccaggggctggccaggtacctactctgggatggtgggcaccacggcccccgcaggctgaaaacttgccttatccgtctatccgtccttctgtcctgtgtgtggtagtggaaaggcctatcctactaaaaatacacacacaaaaaaattagccgggcgtggtggcgggtgcctgtagtcccagctactccagaggctgaggctggagaatgggtgaa

SEQ ID NO: 201254 - DNA, 181 bp, Homo sapiens
tataaaagcgtaaaccgttagcacatgagaagagtaatagagcctgactgaaatttatagaacaggagtacatcaaactcaaccagcaaaaaacagcagatactctcacatggtttacttgaatcatattttaaaatatattagaattatggttgggcatgatggcacatgcctgtaatcc

SEQ ID NO: 201255 - DNA, 561 bp, Homo sapiens
tgtaaaatcaaggttgctgatcagggatgctgtatgcctccctgggattgagcgaaacagaacagatcactgtgtctgaaacgcgtggagaaatcgtcagctagagatgctgtggaatcacagagtagaagtgttatcattattcttgatcatcatcatcagggtaataaaaacatcattaaagacaccctgagacaaatagactgaggagcacagatcaagtgtctgagcatttctaaggaaacaaaaagccttgttccacctgttggcttctgtcctttttctcttgtgtcttttcgttagatttattggccgatttgtacagagaatggggtgggaggggttgggttttcccctttcctcctccttgtacgtatttttgttttaaagaaggtcaatgtaagatgcttgagcgagaaaatgtgcctcctggtatagtagtttattcaagaccttgtgttttctggggctggcagggcatgcagacgcatctgtaaactctaccttggaggttaaagatttttattgtggcttttagagattaaatgagatttatttaca

SEQ ID NO: 201256 - DNA, 638 bp, Homo sapiens
gttgaatgaatgaactcattttcacagggagcagaaaatagacagccaggacgatctttcccagaacactggagctaaacaagaactctggactcatcaacaacacattcaacgagaaaacagccagaaaagctaccccagaaaccccctcattttatacactgaagaacccaggcaggggaggcagtagtccccggacttaatctgcccaaaaggtggtgcatggaaagttccctggtcagcgccctggatcttacaaaaggcttccagaatgatgaacactggcaggaagaaggtgctcctgcctgacaagatcaggatgagaggtgacgagtccagagtcacccctcaccctccccttggcctctcaccctttggcttgccttccccagttagcaaagaacactcccacctgtgtattccacacacacagcaccagcctggcaccttgccagcttcacagagtccgggagtgagcaacgccaccgtgtccaggccctctaagagcctgcgcttcaccagcgtgagaagagcaatcaatgatagacagataaatccatagtgaaagctgagagtttgttgcagaggatgcagggagggtgtgagggatgctgtttgagagaagactgatggcggag

SEQ ID NO: 201257 - DNA, 380 bp, Homo sapiens
tctctgcaagaaaaggtgaatacataaggcaataggcatttctagaacaaggcatgtacatttagtaagaatttcacaagcagagtaggtgaatgaaaaggtcctacctggaaggttttgtatttttttgttttgtttattattattacatcaacagctgtatttaatcacacaaatcctgtgtgcttttccttttttcctgcagtagaggaaatggaatagttgaagaggtatttttaggatggtttaagatccagcggctgctcctgtttgaaggcagctctggcatctagagttaaagctgctgcattgctcgtaacatacagtgatgttctgggcgcctggaagaacattaacacattcttgtctgctgatggact

SEQ ID NO: 201258 - DNA, 546 bp, Homo sapiens
tctctcacctagaactaaatagctatttttatttttattttacatacctccaaacacaacctcagagagattgagtaacttgccaaaagtaacagtagcagattcaggagtggaattccatccattttctactgcccgacacttttaagggtatgctcggccagagaaacaaatccaagcaccctatgcacacagcctcagctccctatcactcctttaccttaaagaaactgggtattacctaataaaacactcctagacattctcaagaatagtgtgtgtaattgtgtagtggcccaatgttaacaccactgactactgagaaaattttaaggttataaacaaagttcttatctccataatttggtggaggaagagaatgtcctagtgaaaagaaccaagactttgggaggccaagacaggaagattggttgagcccaggagttcaaaaccaccctgggcaacacagcaagactctgtctctgcaaaaattaaaaaattagccatgcgtggtgatgcatgcctgtagtcctagctactcagaag

SEQ ID NO: 201259 - DNA, 191 bp, Homo sapiens
agttttgtagcttcagcttttcaggccaccctttggaacgctgtactctagtcagagccacacacaggccgtctggaacttaaaaactataaactcctcaagagcaggaccaagtattattttttatttttatttatttatttatttatttatttatttatttatttatttatttttgagacagggtctca

SEQ ID NO: 201260 - DNA, 366 bp, Homo sapiens
gcagttctcttaccttccttaaatgcatcctcaatacacaggctgagtatcccttatccaaaatgcttggaaccagaagtgtttgagattttggacatttctgggattttgaaatatatgcattatacttaccagctgagcatccctaatccccaaaatccaaaatgctccagtgagtatttcctttggacagtaagttggtgctcaaaaatttttggatcttggaagattttggatttgagattttccagttagggataactcagtctgcaatacagcaagaaccacttatagtgaaaatctgttcaaattacttgtctgcttaaaatccttcaaaggctccccgtgtgaatcagtttaaagccg

SEQ ID NO: 201261 - DNA, 290 bp, Homo sapiens
cctagaggatcccggtgttcctttgtctggcagttcctgccctcaaagagcctcaagaatatagacttcatgaaaacagggacgttggttagttcactgctgtttccccaccaccccagatagttcctggcacatataggtgctcaacaaatagttgaatgagtgaatgaaagcatgtcttggaggaaacagatgctcacaataccaggtgataagagctgtacgtgataggaaattgcaaagcaagtgaccaatagtgaggctcaccaaatgcaagcttagtcggtgaa

SEQ ID NO: 201262 - DNA, 426 bp, Homo sapiens
tggcctcataaagcaagtcagatctttatttttatcggagcatgcagctttcctaaacattcggtgggatgaaggcataaaaggaagagccagactgattgattcaagtgtggcatcaatggagggcgaggtgacagttatgaccatccttcacttctatgcctattctttcgtaggttcttgggctactgatattcagggtgcacatggatttagcaaataaatacttatggagattgactgtcctctctcttttgagataggaaggggacaagacacattttctcttaggttaagatagcaagctgttttttgttttttctttctaagtggacagatacaatacatattaatatgtaaatttagaacagtgggatggttggtaaatactgcctatacaaaaacttacttttgcactgactccca

SEQ ID NO: 201263 - DNA, 457 bp, Homo sapiens
gtgttgataaggaagaggtgagccccttggggaggtagtttgaggaagaaacctgaagctagggggcaggtctcactggcaatactgattcaaaagccatcagcacaaagaaagaaaaacaactacaagcaagcacaaaaccacccaaagtgcgtgtaaacactggaaaatcagtgggctgaggccagagccccggagaacctctacatttaagaacaggagctagtgaaggaatgtgttgcacatggcttggaagctaggcagctggaaaaggccagcaggaatacaaccaaagactcttggcatggcagagcccaggatttaattcaagtgagacgtgtcagcaagagaaaaaggaggagacaggcacggggaagtgctgccaatgtatgttttccctcaagagcactgggttgccggtggactcgttaaacgggttggtgtgcgtgccactccg

SEQ ID NO: 201264 - DNA, 386 bp, Homo sapiens
acgttgcttcagggtgtagggacctttataggtcatgtttcaacttacagaaaattttatagttcaaatataaattacgttcaatgtggactttgtaatagaatttaaggttaagtaaagtttctgctttccttaggctgtttgcagtgcccagcaggccccatgatattgagatggaagttatgttaaaggaggagatcggtcagggatgggcagaataaggactatgggcagctcaggctaatgatacaatgattgaggtgtagaaagagggccaggcacgggataacgcctataatctcagtgctttgggaggccaaagcaagaggatcacttgaggtcaggagagcagcctggtcaacagagtgagacctaatctgtacaaa

SEQ ID NO: 201265 - DNA, 453 bp, Homo sapiens
ctacccacctccatgctcccttttctgtatttcacaatctccacagatgtttgccaacattcattcagacattcaaaccagaaacctcaagtctgagactcctccctctctctcaaacccttcatttaatcattcaaatatttattcaagaaatatttactcaggatgcattctgtgccaggtacagagctcagtcttgggtctaaaactaaacaaaaatgggcctctgttctgacagacagagctgacactctggtcttctgtgagtctctacaactgtatagtccacacatctcgcacatctgctccctgctcctcacacccaatgtggctgactcaggctagactgccatagccactgccagcctctcactatgcctcccaactgaatcctcttgctacagtcaaccttattccagtgcgactagagaaaactccagtctttctgaaaca

SEQ ID NO: 201266 - DNA, 613 bp, Homo sapiens
attctaaaatgtggatgaaactagaagacattatattaagtgaaatatactagacacagatagataaatactgtatgatttcacttatatatggaatctaaaaaaaatgttcagttcataaaagcagagagtaaaacagtggttgacagtgggtgggagacctggagagatgttggtcaaagtgtatgaacttacagttgtaagatgaataagttctggataccggacatacagcatggcaactatagttaataataatgtattgaatatttgaaatatgctataagaatagatcttaagcattctcaccacatacccaaaaaagtaactatgtgaggtgatggatattttacttagcttgattgtggtaataatttcacaatgtgtacatttatcagaatatcacattgtataccttgaatatataccatttttatttgccaattatacttcaaggcagaaaaaaataaaattagagtagaaacaaaagcttggaggtctgaaatgttactaaaagtgtaacattttccttttttcaatattcttgccacatggtgggtaggtccttttagtctgaagattcaagtctgtcttatttgggggatattttctt

SEQ ID NO: 201267 - DNA, 629 bp, Homo sapiens
ctctagtccaccttccgattctgatcaagagtgagaagtttgaaatgtggatgaagcactcaagggaaatgtttgctcagtaaatatgaagaagaacacatggcagcaagacagccccagttggaaacttacaagcactaagacctgatgctgtgggtcttgatttcagtttattaaaatcccaaacctgtagactgctgcttctgcccatgaagggataactgctttgggattttccccctctctgtaaacaaactgcaagacaggataaaatacatgaaacaactgtcttcagatattagccaacaggactctgaagaaggaaacaagagttctatgagagtcttaaattctgcctggaggcaatttctggatcccatagcaggaaagggaacgtaaaacagaacttggtaattacgctgagttgaagggacagagattggagttagggaaggctccagcggctatatttggcaacgcagactaccagcagaggaaaatctccagaaatctgcatggggttcccaagtctttagctgaataccagtctctgtgcatgcatagggtgaaaatccagaaggtgacgtaaagtccggggaccggctcaattcgtatccatgcatactaaa

SEQ ID NO: 201268 - DNA, 721 bp, Homo sapiens
ctctagtccaccttccgattctgatcaagagtgagaagtttgaaatgtggatgaagcactcaagggaaatgtttgctcagtaaatatgaagaagaacacatggcagcaagacagccccagttggaaacttacaagcactaagacctgatgctgtgggtcttgatttcagtttattaaaatcccaaacctgtagactgctgcttctgcccatgaagggataactgctttgggattttccccctctctgtaaacaaactgcaagacaggataaaatacatgaaacaactgtcttcagatattagccaacaggactctgaagaaggaaacaagagttctatgagagtcttaaattctgcctggaggcaatttctggatcccatagcaggaaagggaacgtaaaacagaacttggtaattacgctgagttgaagggacagagattggagttagggaaggctccagcggctatatttggcaacgcagactaccagcagaggaaaatctccagaaatctgcatggggttcccaagtctttagctgaataccagtctctgtgcatgcatagggtgaaaatccagaaggctaagcaaagagaaattgttaggaaaaagagtagttaactggagctataaggtaaacaatccccagagtttacacaaaactaaaactgcttcaagtttcttccaactacacattgtagagacacctcagtgaatacacag

SEQ ID NO: 201269 - DNA, 285 bp, Homo sapiens
caagtctatcttagagctcttgccatatttgtgcatgtaaatctaccttattcttttcagcttctacatagctgaaacatatacaacagcagggaaaggagacagtatctgtgacaccgaaactcatgtcttttttttctttttttttctttttttttgaggcagagcctcaccctgtggcccaggctggagtgcagtggcataatctgggctcacggcaacctctgcctcccaggttcaaacgattctcctgcctcagcctcctgagtaggggtaccgagctcg

SEQ ID NO: 201270 - DNA, 700 bp, Homo sapiens
tacttctcccctgacagttagtactattacaattaaaataagctatattcttctagtattttttctgtgaaagtcatctcataaatttacaatgctattattagtttttataaagcaaacactacgtgtcacaagatatacttgttagctactttcaggcacctctgatttgagtggtttaacactgctatcaagaaaaccactcatttcactgagcagtgtcatcacaggaatggtctgtctctgaaagtctgaaagctgatggaaattggagtggtagggtgtgacttttgcctgctcagtctgaggctacctgtcaggcgtagatcagacccagctgcctttcttcctctatccacaggcgagagacacagtcactacccaacttcggtgcaattgctccacccactctactcctgggagagctcctcccctctatgcttacagtcagttgggatacccaggctttaacgtcccttcctggctgccccaaagacaatggtcagggccttttatggtctacagggcttgacaaccaaccatcacaaagaaatacctggtgtaaaaccctggggagattacagagcttctacagaattcttacagttgtggtccttgatctgcagattctactccttaccagccatcaactggtttaacaaacctcctccttccttaaatgtaatccatgtcagtgagt

SEQ ID NO: 201271 - DNA, 365 bp, Homo sapiens
caaatgtaccccagaaaaaaatctattagtgagtcaatatctacatttacaggctggctttttactcacactgctgccctaaatgtcactgaaagatggggagtaaaaaaaataaaaaaagacattgctgctagcttctagaatgttaagaattccatggtgaaggccgagcaattacagaagaaagactccaacaaacatgagatgatggttttcatcatgcaatttgagacctcctttacttcgtgaaagcatagttgtattccattgcaattgaaatagtacaacattctgttgtttctaaacataagctttaggtttatttttggtctcatgtccaactttcttactctatttcttaagaa

SEQ ID NO: 201272 - DNA, 161 bp, Homo sapiens
gaaaagaaactctggaaggcatgaagaaactttgttcactttctagtctctagtctatgtcaaatgttagtaattgatcaacccataccaggcgcacaaggattgtgactttattgttgctggggtccacccagttcagaaattaatccttaacaataccc

SEQ ID NO: 201273 - DNA, 406 bp, Homo sapiens
tgagatagaatccactcctggtgaagatgctgtgaacatttttgaaatgacaacacacaaaaatagaatattttctaaacttagttgatgagacagcatcagaatttgaaaggttcgactctagttttgaaaggttctgctgtgggtaagatgctatcaaacagcatcacatgctacagagaaatggttggtaaaaggaagagtcaatggatgcaccaaactttcctgttttattttaagaaataaccacaactaactcaaccttcagtaaccaccacctgatcattcagcagcagccatcaaccttgagggaagaccttctagcaacaaaaagattaagactctgaagggtcagatgagcagtagctttttttttttagtaataaagtaaagtatttttaaatta

SEQ ID NO: 201274 - DNA, 429 bp, Homo sapiens
cccttatttttaaatgagatcttaaatagaacaccagggtgtaagtcagattaacctggaactagcctatttgaagtgtattgacttcacctatttgaagctatttgaagtgaagtcgttagatcccaggctgccacttaatatccatttggtaccttaggtacctccaagaagtggtgattagaataagaagcaagagtcactggaataaaggtggtaacagctgtgggagggatgacatttctgaaggacttagacatacaagtaatgcctggcatccaccagtattccaatgacagcagatctttccttacttcatgaaatgagtattatttttctgtccagaaccaccatttgctctattgaactgtcttaaggatttgtttcaaacagctaagttatttgattaaaatagtgataaaattgaaa

SEQ ID NO: 201275 - DNA, 300 bp, Homo sapiens
aaactgattttctgctggattcaaattgagtaagacacaatatcaagaacagttccgcaaatgcctgttacatgaattcaataaacaaagtcactgctctatttctttgaagggcctatttttgtattttcaataaagacacgaaaaaaattagccaggtgtgatcgtgtgcccctgtaatctcagctactcaggaggctgaggtgggagaattgcttgaacccgggagccggaggctgcagtgagctgagatcacgccactgcactccagcctgggtgacagagtgagactcagtctca

SEQ ID NO: 201276 - DNA, 847 bp, Homo sapiens
gccacctgccaacaattccgcagaaaggtccaagcctgacagtagcgagtaggagtaaaggacatggagcggccagagtcctcagccacgctactcacagccatgggcaggagtctaatcagatgagagggaatgtgtgcgtgcccggggcccaccccacacctctcccgagtgtgcccatgtgcaccaggagacattgtcagtgggcctgcagccgcagtacttgggacaaaaaaagtccatcctcagtgggctagagagccagatcaaggagcatccagctcacgggctgtgattccatagtggaaactgatgagctacagccgtgtgcatcagggttactctcaggggcacagatttttttacaaaacaaatcacagaagagtcatacagtgtgactcaggttatagaataattaatacacaacaaaataactgttcaggggcaggtccttatgtgctaaagccatgaagacaagccggtgagtcatgaccatggatggggaggggacactcaagtctgggcagggcattagtgatgctgccccagctactcaggaggctgaggcaggagaatcacttgaacccaagaggtggaggttgcagtgagccaagatcgtgccacttcactccagcctggccaacagtgagactctgtctcaaaaaaaaaaaaaaaaaaaaaaacatatcagccgggtgtggtggttcacacctatagtcccaaagtgaatgcatttctttttaactctaaataacattccattattcagaagtaccacagttatccacttacctactgaaagacatcttgtttccaagttttggataaattatgaataaagctgcta

SEQ ID NO: 201277 - DNA, 436 bp, Homo sapiens
caggagaagagttcagggatgcagaggaccctgaggaggggtagccagtgaggttacaggagaaccaggagaacatggcatcccaaactctttcaagacattttgctgcaaaggggagcatagaaacagggtggtgggccggcggggacggtggttggcacacacctgtaatcccagcactttgggaggccgaggtgggcatatcacgaggttaggagatcaagaccatcctggctaacatggtgaaaccctgtctctactaaaaatacaaaagattagccaggtgtggtggcacgcacctgtagtcccagctactcaggaggctgaggcaggagaatggcatgaacccaggaggcggaggttgcagtgagccaagatcataccactgcactccagcctgggtgacagagcaagactccgtctcaaaaaaaaaaaa

SEQ ID NO: 201278 - DNA, 538 bp, Homo sapiens
  misc_feature (524)..(524): n is a, c, g, or t
aagctgctgtcagggaacagatgggagagcctgcaaggggaggtgagaggaaggtgctgagccccagtcatgagcgaggtgacagttattgtagtggctaaacaggtggcccctgagatcaggctgcctgggctggaatcctggtctaccactccttagcactgtgcgttcaggcaaaccattggtccgctctgagccttgacttccttatctgtaaaatgggcgtggtaataatatgccaccctcattaggttcctggaagggttaaatgagtgtgtagcccatggtacatgcaatggaagtgctgcctcttatttgtgtggcattctgcagtgactgtctcgtgtactctcaatagtgcttataactcttacgggttctggagctagccacctggcctctgctaccacttcctagcagggcggcagagcttagagggagatttaaggtgaggatggtgaggtttaagtcctgggtccctcattggcatggccttgtacttcattatttaaaaagacaccccncacagtttatgtaa

SEQ ID NO: 201279 - DNA, 705 bp, Homo sapiens
atgatggatatttaggtcatttcagatttttagttcttcagatatttaactctttcttccctctttcagttccttattttattgagaaaacagaagcagtcagaaaagaattacctccctcttttcccacaatttattcactcaaggatatgatagtgaacaaatgaaacaaaaatctgtgccctcaaagtgcttatatactaaaggagggagatagacaataaacaaggtgtttcaaaagtaaagtatgttgtatattagatggcaataaatactgaggagaaaaagtagggaaggagcatagtatagtaagtgttggggtggagtttgcggttttaaaggcaaggagagagactcactgaagttgacagttgagtaaataactgaaggaggtaagggaaaaaatcacgtaaatatttgtaaacagaggcaacagcaaatgcgagtgccgtgaagctgagtgaggcctgctctttctgagttctgtcaccctacatccacttgcatcatatactctacctttccctctgatcataacaagtgagttgtccctgcccaggccaaccccatccacttgcacgtgaaatctgcttccctctgtcatataggactatgatcctgctgtcatgccctctcttacgtatttcacattttctctctagttggttcccctgagcttgcaaacatgcagtaatatcacccatc

SEQ ID NO: 201280 - DNA, 450 bp, Homo sapiens
ttgatacaggagagggggcatttttggtagggaatgagccctctacccccacctcactacttaagaaaccaattctcttttttttgagacagtttcgctcttgttgcccaggctggagtgcaatggtgcaatcttggctcacggcaacatcaacctcccaggtttaagcaattctcctgcctcagcatcccaagtagctgggactacaggcatgcaccaccacatccagttgattttgtatttttagtagagacagggtttctccatgttggtcaggctggtctcgaactcctgacctcaggtgatccgtctgcctcggcctcccaaagtgctgggattacaggtgtgagccactgcgcctggcctaatttttgtgtttttagtagagacggggtttcagcatgttggccaggctggtctcgaactcttgacctcaggcaatccgcctgc

SEQ ID NO: 201281 - DNA, 554 bp, Homo sapiens
aagtgctcctgatggctgctttcaatcactggaagaaccatgaaagtgcgagagattcctcccggtgaatgaagccagctcaccaccgtcaagggcaagggatcagcgtgtgttcacatggaggcctctcaccgagggaacccaagggggacagcacaggaattgcagagccagcacccatggaatgggcagggatttgggtttcatccaaccagccagttgatcaataatcactgaatgtctgtcacccattgcatcctctcctgagtagtgaggctaggccagtgccagtcacctggaaatccttactgttctgcagttgacattttgagaggcaagtcaaacaatatatataaacaactagaatgtctagtgtgtttcaggaggtaaatgccgtgccgggatgagcagaaggaggatggagccgttgctgggcagatagactgattttagataaagccgtctgggtgcaggaaagaagaccttaaagagggaatgacatttgagcaaagtcttcaacaaactgaacccaggaagaaaacattccgaaagtc

SEQ ID NO: 201282 - DNA, 562 bp, Homo sapiens
tgcgctcttaacatagcccaggtattttataatacggaacaattaacaccctaaaatggtgatttataattgcacatttcttggtaaaagtttgtcatcttaggtctttatttgatagtgcagcacgaatgggagcttgggtaacttgttcggtattcgcattttctcaaacatagaatacctctgttaaagaaacagctttcttagtgttctttcattcttgttggaatattctgggtaaactgataggagcttcatgcctttagaaagtttctccagtccttttctccagtcctgtaactccttatgctggttgagcaaggccacgttggtggtggtattgtttagctctctatgcctgcagggagggtgccaaaaagacattccctgttcaactctcgcccccgtccaggactctgatgtttgttgttttactctagtgacagtgttatcatttgttattctcaatccatgtaagcctttgtaaatttacattgtcagtgtcaagtcacttacctttttctaggagtagtaagacactttgaaatttttgtggtttaaa

SEQ ID NO: 201283 - DNA, 2454 bp, Homo sapiens
catcttccctgagaagcaagccatacacccaacaggtctagaacacctaggtcacaagaaagggtttcagtccagatgcactgtcagtaagtgaacacaaggacaagaatgcatgaactgttattttcttcccatcactggtttagcagcccctagggagaccctgtgttgctctttaatattctgacatggagcactaatatgctcaacactgcctccaacaggcaaatgttggaaatacactttcagagctggatgggactcaagatcatctaatataatcctctcattttatttcctctcaaggaaaccaagggcaagaaagtttaggcaatttgctcacattcacacaggcaattagtaacagagctgagttcgggtctggtataggctttttaatttgattctccacaaatgaacactaagataaatagcatttattgcatacccactatttaccagatactgtgcaaagggctttacatatattactttactaaatcctcaccataaactttaagtcaggtttaaccattttatagaagagggaagggagggccaggaaggttaagtaacatgctcaaagtcacacagctactaaatagagccataatctgaacctttgtctaattttgaagcccttgatttttccacttcatgaggctgctctttatatttatttagctgagtgaccaccatcttggattttactaatattcttacaagggggctttgatgccacttcttctgacttttaagaaaaggaaattcttgcattatttttgccatgtactccaggggaccctcaatctcatcatcatggggaataagaaacattctgacatctctttccttttctttctttttaaatttggtagacgagggagagggtccccaacagaatgagagggggaagataagaaccagaacataaacccaataccccccaccccactcttttgggaacatcccaacattagaagagtgggatatccagtcattttttccaagctggagcaggcagtgtagccaggattgaggaaggagaagccacagaataaacatggcacatgttctcagagcatcaattttactccagaatttgggaagaaaggattatattattagtgtattcaaaccagtatggatagcacaaatgcagatatcctataaattttgaggctaactccagcaggttgtagactgatttaggctacctccttccagactcccaggggtacaaacaccttcacagtcccctgcgggagtacatcagtggaaatatttggggaatgaggctagaaggcaggagatacattcagtttacttatccccctggtttcttttccccactccttacctgccccacatccctagtgggtgggaaggcatcagaagacagttggctacaatatcagctttctctgctactttggggaatttagaaggaaatcagtacttggcaacctggtatttttagctgccaggccaaaactccagacataaaccccttccctttaattgaatgatgtttatatataaaggaatagatctccccaagaaagaaccccagaacactggttccattccagtgtgggggctgcttgggcagcagtgacacctgtgcattagatgcaatagacacttcaattcctgcaaaaatgtcggccaactaagtgctcctttaccaactgcggaggcccagactcacaccatggtcccacagactcaaggtttagaatctattgtgagtctattttgggttaacacacaggctccttccttccaatcattcacacacacacacacacacacacacacacacatgcacacacacacatgcatgcacacatacacaggtgcacatgcacaaacacacacatctaatgattccaacctcgaatactccccaggcccatggggatgcccaagtaccctaagcaaatcactgtgacactgagggggtcattaactggggctccgagcagctgaaacccaccctggtggtctctagattgttgttctgagaaatcataaacaccaaatcctccaatccctttgaatttgagtttgtcattttaacctttaacagccttttcaggtaaaaataacaaagaccaatttattgactttgtagctacaatgagcttgaaaaagcgcttacttaaaagaaagactggaaggaagaaaaaaaaaagaaaatggagtacatactcctcagacgatgcacactttaattagctaaaataaaaataaaaatgtacagaggaagggagaggaaaaaccaacttctctgatcctttcatggcactgtagctcaaagactggaatctctgcttgttaaccattgttaactagtatttttagtcctggttgcttttagcctctgtatagttccttttttaaacacattttctatacgttaataaaagatcctgaaagaaaaatgcgtgt

SEQ ID NO: 201284 - DNA, 2125 bp, Homo sapiens
cccacgcgtccgcatacccactatttaccagatactgtgtatgcaataaatgctatttatcttagtgtcatttgtggagaatcaaatgaacactaagataaatagcatttattgcatacccactatttaccagatactgtgcaaagggctttacatatattactttactaaatcctcaccataaactttaagtcaggtttaaccattttatagaagagggaagggagggccaggaaggttaagtaacatgctcaaagtcacacagctactaaatagagccataatctgaacctttgtctaattttgaagcccttgatttttccacttcatgaggctgctctttatatttatttagctgagtgaccaccatcttggattttactaatattcttacaagggggctttgatgccacttcttctgacttttaagaaaaggaaattcttgcattatttttgccatgtactccaggggaccctcaatctcatcatcatggggaataagaaacattctgacatctctttccttttctttctttttaaatttggtagacgagggagagggtccccaacagaatgagagggggaagataagaaccagaacataaacccaataccccccaccccactcttttgggaacatcccaacattagaagagtgggatatccagtcattttttccaagctggagcaggcagtgtagccaggattgaggaaggagaagccacagaataaacatggcacatgttctcagagcatcaattttactccagaatttgggaagaaaggattatattattagtgtattcaaaccagtatggatagcacaaatgcagatatcctataaattttgaggctaactccagcaggttgtagactgatttaggctacctccttccagactcccaggggtacaaacaccttcacagtcccctgcgggagtacatcagtggaaatatttggggaatgaggctagaaggcaggagatacattcagtttacttatccccctggtttcttttccccactccttacctgccccacatccctagtgggtgggaaggcatcagaagacagttggctacaatatcagctttctctgctactttggggaatttagaaggaaatcagtacttggcaacctggtatttttagctgccaggccaaaactccagacataaaccccttccctttaattgaatgatgtttatatataaaggaatagatctccccaagaaagaaccccagaacactggttccattccagtgtgggggctgcttgggcagcagtgacacctgtgcattagatgcaatagacacttcaattcctgcaaaaatgtcggccaactaagtgctcctttaccaactgcggaggcccagactcacaccatggtcccacagactcaaggtttagaatctattgtgagtctattttgggttaacacacaggctccttccttccaatcattcacacacacacacacacacacacacacacacatgcacacacacacatgcatgcacacatacacaggtgcacatgcacaaacacacacatctaatgattccaacctcgaatactccccaggcccatggggatgcccaagtaccctaagcaaatcactgtgacactgagggggtcattaactggggctccgagcagctgaaacccaccctggtggtctctagattgttgttctgagaaatcataaacaccaaatcctccaatccctttgaatttgagtttgtcattttaacctttaacagccttttcaggtaaaaataacaaagaccaatttattgactttgtagctacaatgagcttgaaaaagcgcttacttaaaagaaagactggaaggaagaaaaaaaaaagaaaatggagtacatactcctcagacgatgcacactttaattagctaaaataaaaataaaaatgtacagaggaagggagaggaaaaaccaacttctctgatcctttcatggcactgtagctcaaagactggaatctctgcttgttaaccattgttaactagtatttttagtcctggttgcttttagcctctgtatagttccttttttaaacacattttctatacgttaataaaagatcctgaaagaaaaatgcgtgt

SEQ ID NO: 201285 - DNA, 2411 bp, Homo sapiens
catcttccctgagaagcaagccatacacccaacaggtctagaacacctaggtcacaagaaagggtttcagtccagatgcactgtcagtaagtgaacacaaggacaagaatgcatgaactgttattttcttcccatcactggtttagcagcccctagggagaccctgtgttgctctttaatattctgacatggagcactaatatgctcaacactgcctccaacaggcaaatgttggaaatacactttcagagctggatgggactcaagatcatctaatataatcctctcattttatttcctctcaaggaaaccaagggcaagaaagtttaggcaatttgctcacattcacacaggcaattagtaacagagctgagttcgggtctggtataggctttttaatttgattctccacaaatgaacactaagataaatagcatttattgcatacccactatttaccagatactgtgcaaagggctttacatatattactttactaaatcctcaccataaactttaagtcaggtttaaccattttatagaagagggaagggagggccaggaaggttaagtaacatgctcaaagtcacacagctactaaatagagccataatctgaacctttgtctaattttgaagcccttgatttttccacttcatgaggctgctctttatatttatttagctgagtgaccaccatcttggattttactaatattcttacaagggggctttgatgccacttcttctgacttttaagaaaaggaaattcttgcattatttttgccatgtactccaggggaccctcaatctcatcatcatggggaataagaaacattctgacatctctttccttttctttctttttaaatttggtagacgagggagagggtccccaacagaatgagagggggaagataagaaccagaacataaacccaataccccccaccccactcttttgggaacatcccaacattagaagagtgggatatccagtcattttttccaagctggagcaggcagtgtagccaggattgaggaaggagaagccacagaataaacatggcacatgttctcagagcatcaattttactccagaatttgggaagaaaggattatattattagtgtattcaaaccagtatggatagcacaaatgcagatatcctataaattttgaggctaactccagcaggttgtagactgatttaggctacctccttccagactcccaggggtacaaacaccttcacagtcccctgcgggagtacatcagtggaaatatttggggaatgaggctagaaggcaggagatacattcagtttacttatccccctggtttcttttccccactccttacctgccccacatccctagtgggtgggaaggcatcagaagacagttggctacaatatcagctttctctgctactttggggaatttagaaggaaatcagtacttggcaacctggtatttttagctgccaggccaaaactccagacataaaccccttccctttaattgaatgatgtttatatataaaggaatagatctccccaagaaagaaccccagaacactggttccattccagtgtgggggctgcttgggcagcagtgacacctgtgcattagatgcaatagacacttcaattcctgcaaaaatgtcggccaactaagtgctcctttaccaactgcggaggcccagactcacaccatggtcccacagactcaaggtttagaatctattgtgagtctattttgggttaacacacacacacacacatgcacacacacacatgcatgcacacatacacaggtgcacatgcacaaacacacacatctaatgattccaacctcgaatactccccaggcccatggggatgcccaagtaccctaagcaaatcactgtgacactgagggggtcattaactggggctccgagcagctgaaacccaccctggtggtctctagattgttgttctgagaaatcataaacaccaaatcctccaatccctttgaatttgagtttgtcattttaacctttaacagccttttcaggtaaaaataacaaagaccaatttattgactttgtagctacaatgagcttgaaaaagcgcttacttaaaagaaagactggaaggaagaaaaaaaaaagaaaatggagtacatactcctcagacgatgcacactttaattagctaaaataaaaataaaaatgtacagaggaagggagaggaaaaaccaacttctctgatcctttcatggcactgtagctcaaagactggaatctctgcttgttaaccattgttaactagtatttttagtcctggttgcttttagcctctgtatagttccttttttaaacacattttctatacgttaataaaagatcctgaaagaaaaatgcgtgt

SEQ ID NO: 201286 - DNA, 597 bp, Homo sapiens
gtagagtacatagttttcatctttattcagtcttctaagtgaattttctcatgtccatattctctctaatttttcccaattttcttgccatctctggtcagctgttatcttctcttttttttcttttacagtttgtatttttttaatctatgcattatcattttagagaaataaggagaagcaaagataagcatatacatttaatccactgcacttaactaggagtttgtatttaataatccactttaatcagatgtctacctaacattttattgaatcttttctgcctccttgcttttcaggttttttttttttctattcttgtatctaccatgtaggcttgcctattatcttcatttagcatcctcaggcaaagctattttttatcattgcccttccattgcactgtgtacaatgctgctcttgctgccttgagtacatattgatgtagtacaaatatgtggatggatggctgtcttctgtttctctgggtggggaatttttctacacccagggtccaacatggggcccgctactgactcatgttccttaaactttattgaatgaaaaaaaaatgcctcagaaaatttaatggga

SEQ ID NO: 201287 - DNA, 125 bp, Homo sapiens
atccccgtatccatctctgtgctgggtcctgcctgctctcacttcccactcatcttggcccctctccctgcccacctgagcagcagcgtcccatccagccctctttcaccaagtccctctgccgt

SEQ ID NO: 201288 - DNA, 277 bp, Homo sapiens
attttatcttaatatagatgcatgttattcataaatttgagtaaaaacttgttaaaaagatggacaggagagaaaaaagaaagaatattaattgtgccagacaaaaagaagggttcatttattggcctgaatgaactgcttccatttttttttctgcgatgactgtagttgtagatcagcaaaccagtttctgagcaagtttggaagagcttcttatttacctaacattgttaaatatattctgattattagcattctaaaatgttgatctaaagga

SEQ ID NO: 201289 - DNA, 102 bp, Homo sapiens
gtgtttctcaggtgctttattctttcactaggatctctgctaccttggccattagaaaatttgtatggtttgccaagatgctggtttcagagaggacaagaa

SEQ ID NO: 201290 - DNA, 330 bp, Homo sapiens
ctttcagtgctaatttgataataaaatcttgatgtatttctgttacttgataatagtaaaaaaatgtgtgagcatgaaattctaaacaaaattcattatatgaacttgtgacattctcatgcactgggttttttttcttccatttccaaacactaattgacagcacttgaaaacagtgattcagcttccgcatgtcatatgattcctagggactgtagctatattcctcaggccagtagactgacaaatcaaaagataagaagtacctctcagcttcaatcaactgaaatgtgtcagaaaatacatttggcataatcttcagaaatgtca

SEQ ID NO: 201291 - DNA, 749 bp, Homo sapiens
aaatgaaaacaagtctgtgaatattcagatgactacttcgaagtaattcagtttttttattagtatttttccagcttatgttttcccatgagctattttactttgctgaattttgtgggtaatttggtggatatatcctgccttatttaggattatagctggataagaaaattgccttttcattgtaagtgcccagttttggtctctagtttgaaggtactacatactgccgataaaggaaaacactcccctacaccccagtttttgtgttaccaagaaaaaaaaaacagtattggtttcatagtaggactcaaccagaattggtcctacatatatgtgagtgttcagtttttgcaaataaggtttttgagtgtgataaaacactacagaagtgctaagtgtattgagaatttgctgctgattgtatttataacaattacttgacgtttgcagaaatttagcactttccctccaaatttataggtgtaagagaagcgggggcaaggtgcaccacattttaaaactgcaaatgtgtgaaaatttatttagagattcagattcctaaaaggaaatttcaccacccaagtcatgcacttcttagccttttacaagccaacagactgacatgaagattgttcacagttcctaagatttagcacatatacaaaaataaaactttataaattcaaagccgcgtttacacttgtgactggccctgcgtacccacttatcgcctgagactccctttt

SEQ ID NO: 201292 - DNA, 139 bp, Homo sapiens
tctctcagagatctagagagaaattgacctctttcatttaatatatgaaattcttcatatattgaaaatgattgaaatccaaaccactattataataattttagtatattttaaatatttgccttaacaaattaatttt

SEQ ID NO: 201293 - DNA, 220 bp, Homo sapiens
tcccttgtgacttcccacattcactgattttgatccttggcccacagttttctctacttcaagcacttatcaccttcacttgccctcatctgaaagatgttatgctctgcagcctctgaacactgtctcttgtactccaacccctgcccctacgtctgctactgtacctcattagagacttctcttcctttgactgctccctttttcaatctgtcatttg

SEQ ID NO: 201294 - DNA, 147 bp, Homo sapiens
caaaaatttttctaactttctaaaattgaattcattgccaacatttaaaaattataagagttccccttaaaactcagatttccagtttctctggaaagatttagcagtcctgggtccccactcctgtcaggtgacaactgacaggag

SEQ ID NO: 201295 - DNA, 451 bp, Homo sapiens
aaaatgggaatgttttttctctactttcaaataactggaagatctgaattaatgctagtaaaaatcctatgagtagcgctaaatgcaattcagccacagtacagtgctttgaaaggacaaaattttaaatgtggtttttattaatgtgactcataggaaaaatgaagtattaaaaatgttattctctaaagactgacctgatgcaacaaaatgcaaaatatgtgatcaactatgcctaaaccaaaaattcagcaataattcaacttgtttttccaaattaagacctacaagagctagatctagtaattattccccatcaagaaaacagtaacaaaagattacttaacttgaatatctgaattttcagaaagcacaatctaaaaatcaaagaaaaatgataaaaagatcagtgcccgctcataaagggcactcagtaaaagtgttgtatttt

SEQ ID NO: 201296 - DNA, 176 bp, Homo sapiens
gggcaacccagtctaagatggctctagtcatcacatctgcattctaagcaacagcaaagagtgggggctgggagggaacagcagggaaattcagaaatggagtttctgtatatgcccaactgaaaaactggcaaatctattatgaaagaaagaaaaaaaaagaaaaagaactagaa

SEQ ID NO: 201297 - DNA, 542 bp, Homo sapiens
cccttacagagcccaaggctccaactcaggatccgtctccctgcacgagcccctcagccttggcttgaatgagtggctgttagccaacgccacacggcctctggggtcctactcctgactccctgcacaggttccttggcgctgcttctcctgcacctgataccctgggcagctagccctgctccttgctcccagcaccatactctgagtatgtttcctttttgttttttgagacagggtctcattctgatgccaggctggagcgcaatggcacaatcattgttcactgcagcctcaacctctggggctcaagtaatcctcccgcctccgcctccagagtagctgggagtacaggtgcatgccaccacatccggctaattttttttttttggtattttgtagagacagggtcccgctatgctgcccaggctagcctcaagagatccttctgccttggcttcccaaagtgctgggattacaggcacccggctagtacttttccttttgatcctgggagctgatggtgcaattatactatccca

SEQ ID NO: 201298 - DNA, 450 bp, Homo sapiens
tatctagggatttctcatgatacagggatgctaggtcacaggacaggggtaccgaaattcaagctctatctattgacattgtttcttaaagagtttttatagagctatctagaatatctgctattagctattctgacaaccattccaaggctatctaggaaatcctgtccgttgggaggcaaagactaattttttaaatgacttatcttattgaaaaaatacaaatcttaccttgaaacaactagaacaaattctataaatccagtcaaataatcatttaaaacattcattttttccacatttttttcctttctttgtaagcctttttgtcctctctacaataactactttatagcttctctgctattatgagattacccttcacctcttttgaaatagatggatctgtggccaaatggtaagtatatccttcccactaccattcttttc

SEQ ID NO: 201299 - DNA, 111 bp, Homo sapiens
ttagtttgaactgatgttgccatttccatctgttctccaaaccttcccatctttcagaacccagcttacattccttcccttccaccaagtttgctcaggttatcccacccc

SEQ ID NO: 201300 - DNA, 511 bp, Homo sapiens
attctggtggcctgtatttatttaattttagagatgaggtctcacatatgttgcccagcctagtctcaaattcctaagctcaagggatccacccgcctctatctcccaaagtgctgggattacaggcatgagccaccacgcccggcctccatgatcttatttaccagatttatagctagttcccctaatctgcctttatgctcagtgaccagtaaatgcaggtccccccgtaagtatttattgtaagtgagtgtttagagaggataatagttttacagtaaaatttaaatttaatataattctaggtgcaccttgctgatttctaaattgtttcatatatcacatcctcaagctggcctgggattagttgatttactgatgacacttttcaaaccaataaatggagtgataataaaacaccaccagtaaaattggaacatttctcattctgttccaatctttagtccccaaaacaaaccctggtccaattatgagtatagataaactccag

SEQ ID NO: 201301 - DNA, 184 bp, Homo sapiens
cactactcatcagggaaatgtacattgaaaccaaaatgagatatagttagagtagctattataaaatttttttttaaaaaaaacagatgctggcaaggatacagagaaaaggcaactcttgtacactgttggtgggaatgtagattagcattgccactatgcaaaacaatatggagttctctga

SEQ ID NO: 201302 - DNA, 399 bp, Homo sapiens
agcttctaaaagaagacacaaaggatgagtaggagttagttctgtgaagattcatgcaactggaaaccgtgatgaggaagactcagaggtggaacagagctttcataagaagtgaaagaagggcagcgtggagcattacagagaagaggtaaaacggggcccaactacaaaggggtttgttaggaattttttttattttgtactaagtgcagtggggagccgtcaaagtgttttaagcaggaaagtgacatgatacaattcatgttttagaaaggtcattctggctgctgagtggagaagagacttgaagggtgacagagaaacaaagaggccctttaggatccacatgagaggagcaaagtgatgtggccgcgtgatggcggcagaggagagaagtga

SEQ ID NO: 201303 - DNA, 369 bp, Homo sapiens
tccagtggcccagtgacacatccaaagctgtgctggggatatttcaaaaagtgacttgggaacccaaaagcaaatgcaataagaacaaagataaataggtgggacttaattaaactaaagagcttttgcacagcaaaagtaacagtcagcagagtaaacagacaactcagactgggagaaaatcttcacaatctacacaaccgacaaaggattaatatccagaatctacaatgaactcaaacaaattatcaagaaaaaagcaaacaatcccatcaaaaagtgggctaaggacatgaataggcaattctcaaaagaagatatacaaatggccaacagacatatgaaaaaatgctcagcatcactaatgat

SEQ ID NO: 201304 - DNA, 500 bp, Homo sapiens
tgcacttgcaccctgccatcattctgacctgtgttaaccaagaccccttgaacttccacctcagtttacccgcgtgctgccatcaccgcctccactgtacaacagtgtcccagttaggatgaagttcagctgcgtgtgtccaaagagaacagaagaagaaaacagtgacctaaaataagagagggctttatttctctcttacataaaagaagtccaaagggaggccacccaggctaggtggggtggctttatgatgtcaggatcctgagctaaatctggcttgctactagggtctcttcaatatccttctcccatctcctcatagaccaagagagctattcaagctccacccatcacctctgcgttcctgcagatggaagggaaaggaaggagagagggagggcttgcctctgcctgttaaggacccttccccaaagctgccgtagccacttctaatgtacatcccattggctacgcctgagtcacatagccaaccaagc

SEQ ID NO: 201305 - DNA, 474 bp, Homo sapiens
gactctagaggacccccacgccgcaccgccggtcaaaatatatagaaaagtcttctacgaactttcagagtctgtccaacttatgaaacatgaaacctaagataattctaaaataaatcctctgtcatctccatgtctctatctggacttggtgcttctatctccagccttccacctcgctaaggtcccacttcacctgaagttcagttcaaatcaatccagcttgtcttcatttaatcatctagtgcccagctagtactcggggaaaaaaggatttaaaatcattccatatactttttttttgctaatacttagaaagtacacaggaacgttgtccgatgctgagaatttatagagggcattctcttttaaaatcagtccctgaaatcagctgggggtggtggcgggtgcctgtaatcccagctactcgggaggctgaggcaggagaattgtttgaaccggcggtgcggcaga

SEQ ID NO: 201306 - DNA, 324 bp, Homo sapiens
tgtagttcctgaagtttggataaattttaaaagccagaaggtaaagatataatgagaaaccccacctggaatgcctagggtgatggttagactggttaatcaaggtagcacttggaaaaaaggccaaagtctcctggcctgaaccctgggtggaaacctgaagacatctgcacaagaaagggtaaaatggtctggagagaagagtcctgggactacaacataaagtaaaagttgacaggactatgaaagttggaatgttaaacatgcttttttttttttaagttgtactaccaataaactgagttctttccctactttgtattg

SEQ ID NO: 201307 - DNA, 471 bp, Homo sapiens
gtaaggaggtctgcagggttttgtaaaagcttcaacatattcactagactcaataattaggtcatttccacgtgcagaactaaacacatgttcaagaaagaattgagaaggtcctaataatgactcacctctagcttaccttgaggttcactacaagcaagaagttaaagtaaggcagagttgtaaactctgcaacagagcactaaaaacataccccactatgcacacagagcccctcagcaaaagctgggagacttagtggttcaaggcacttaagataatgtttgatcactagctgaccacaaagctaactaatcagaaacttcaagggtaacacaaggatacagacttaacagaattagttcagggaagccattacataaacaaacaacagatgcaacaacaagtcttggggaagggggtggcatcagatttccagagttgctacattatattattataatatgacca

SEQ ID NO: 201308 - DNA, 398 bp, Homo sapiens
gaggacactgcatattagagtcaggcgtcgtcattactccttggatgctcatattgtccctttcagattggctcctgtgtctttttgccaagaccccattagttcttgagtgcttcattgctttctggcacagaaatttgtcccaggcctactttgtacttttcctgcctcagatctgaaatcattcctctcaggagccctggtttcctttagtgggaagtggcatttagaaatcagcatttggggctgggtgtggccactgtcacgggggtagcatctggttgttttttttttttttggggggcagggagtttggctctggtcccccgggcgggagtcacgggggcacgacctcgactcagggcaccctcggcccccggggttcaagcgaatctcgg

SEQ ID NO: 201309 - DNA, 567 bp, Homo sapiens
ctgatacttgctgttgttgaatttctgaaggaaattgattagtcaactctgtcatctatgagtagcatgaatatgacacagaggtaactgatattttctatgcttcatcaaatgatagtgtacatggtttcatttaataattttggggaaatatgatgtcttgcattatctgtttggcaaaactctgttgtcttcctttggttgaagacttcaaatggttgcttgagatgattgaataataaaatatattatgaaaatgaatttatttctctcttacatgctgtaaagtaatagattctttatgaatggttctcaactagggcacccccaggggatatgtcacaacttcagaagacactgtttattttaatgacttggggtggtgaggtaggaaagtgctattggcatctagtggttagagaccagggataatgataaacatgccacggtgcactggatagcctcccacaacaaaaactcatacagcctcaatgtcaacagcactggggttgaaaaactctattttatatgaataatcagaataaataaattacctcatatgtatgt

SEQ ID NO: 201310 - DNA, 462 bp, Homo sapiens
gaagtcaaggctgcattgagctgtgatcaggcccctgtactccagcctgggtgacagtgagaccctgtctcaaaaacaaaacaaagcaaaaaaaggaaggaaaagtacctaaaaatatcatggagacttgtcataaggacacaggagccagctggaaggaactcccactggctaaatctgggtcaatttgagtgctaaacaagtacattaatgaactgtgaaccactggaaggaaaatgaatcatgagtagaatgtcaagtgccaactggtaaatgtaggattgctggagttggcagcttatcattctgcaaccattgtgttaaggattggatcaggcaagaatcatcaaaggatcctaaatctaggggcagtttcaatgaggagccaggatatttgcatgccttccacatatctcaagggaaaagttagtaattataaaatgggaaaaatggacaccttga

SEQ ID NO: 201311 - DNA, 776 bp, Homo sapiens
tccagtatccagaagcatatcggatgaggaggagaatgcaatagaaattagtcgcagaaatcaatcatggagaaaggaaatgttctcagtgaggtgtttcaaatatgcagcgtacaagacttaagtggaagactcacttataaagtagctgactcgcccagcagaggcacccatttttatactttcccctttcacctttcttgtggataaagccagtgtgatggctggagcttcaggagccacgttggactatgaggcaccttgaagacagaaaggtgtgcactgaaaatgctaaagctgaatgacggtgggaaggtgggtcctgggaagtgatggaaaccccgtgccagccttggaatgcccacatctgtctagtttcatctgagagaataaaacattatatatgttccaaaaaaaaaaaaaaaaaaaaaaaaaaaggggggggggttaaaaattttccttgggggggccaaagtttagggttccccaggttttttggtaaaagggggccccttaaaggggggagtcggattattaattcaagtgggcccgcgggccgcgtggttttaaacacaggtggggaagtgggaaaagggttcacggggggaactctgggggaaaggaacacctaatttgctgggggtgcatctaatgtggacaaattcactcaggaaattaaaggtctgaggtaaatttaacttctaagggtctcggggtcaactagtgtatatgtagcgttggaaaattgggtaacgaatatatttggaactttttcc

SEQ ID NO: 201312 - DNA, 176 bp, Homo sapiens
cagatgttagacaacaagccatgcagaactataatcactgagaatggaagaaaatgaggtgagccacacaaaggtctcagggatctgaatggaggcatgttccagaatctgtagcagggaaagggagctgaagcacagcgctgtatctgtctctgaactaaggaaacactgtcgag

SEQ ID NO: 201313 - DNA, 670 bp, Homo sapiens
tggaaatgttactaaaccaaatgaataggccaggtgcagtggctgaagcctgtaataccagaactttgggaggctgagggaggaggaccacttgaggccaggagtttgagaccagcctgggcaacatagtgagattctgtctctatttaaaaaaaagaaaaagaaatgaataatttcagccttcaagcaagaataccaaacaattaaggggcaaaaatctgatttccagagttacccagttataacattcaaatgtctccttttcaatacccccacccccaaaaaaccccagagaaataaataaaacagagaaacatgaaaatacgactcattaatggaaacaatttgagataaatctgagaaacctcagacactggatttactgaataaaaacagtaaagcaactgtcttaaatatatttaacttagtaaagacaataataaacaaagaactaagagaaaaccagaaaattgatgtagggataaaataataccaaatatgttaaaaattgagccatatagaatttctgcagctgcaagatacaacaacttaaatgaaaacatcactaaaggtattcaacagatgtgagcaaccagtggaaaaaaaaaactaaaatgaaggtaaaacaattgaaattacctggtctgagttaaaaaaaaaaagaagttca

SEQ ID NO: 201314 - DNA, 713 bp, Homo sapiens
tgaataacagagctaaccttaatgttccttctgataaaaatactgtcctatagacccaaattagcatatttgcttttgattaccttgcaaaactctatttgctctcttttcttaaaagcttaataattcatataaggcttcagaggaataaaatcactatgtgcgggtgaaaaatcctaacttccctgctgaggttaaatggcagccttcaaagaattttttaaataaataatggaaagagatactccatcttgcctctgaactgctgcataagcaattccttatcgccggaatttgcagagacataagaaatcagtagtcatacaggcaggtactagaaaccaggaagcaccaatatcctaactgaagggcagagactggaactgctctgcttcagggctttgtgagactctgggaatcaattcctcaattttcaatgcagtagcttgcttttgcactcctaaggcatgaaattggatgagcggaaaaaatgcattcttttcaggcagaacacaggtttaaggaaacaagaggggaaaatgtacaggtgccctggagaagggacttcttctcttggaacagtctactgggcagactaggaaaggaatcagaggaagtttgagggtgagcttgttgctggggtatggcatgacatttttgctttgtagatcatagaggaagatgggcaccactgccccaactcatttcctccc

SEQ ID NO: 201315 - DNA, 335 bp, Homo sapiens
ctgaatttgcaggcattaaatacaaaatgaaacactgatgaggctgcctctgcagtcaacaaaacaaaccctgcaaagtttccttcttgttctgtgtggcagtcagcgtgggggctcctcacttccatgccatccctgagtacccacgctcaagtctgggaaactgacctcggctccagaggaggcatggctaaatggtttgggggtgatcctatttctcttgccagtgattggtttaggagcaggcacagtatatcaaatctgaacaggaagtttgctggaagattctaggaaagtttttcttctgctcctaaaaagaaagcaaaaagggccgg

SEQ ID NO: 201316 - DNA, 640 bp, Homo sapiens
gatctttagtgacatctcttaaagatatcaacatgtaattaaagaattgtgtgaattactatttttcactctctcaaatccacaggatcatcaaaataaatataagcaagggataacagaaaaccgcaaatctaggagattcaatattaaaatcagaagtctacacagtgctaatagtgaacactgaactcagatcttttgttttttcaataaacaactcctaatgcccatttacatgtaaacaattatactaacatttcataattgatttatatgtatctatacacacagccacatacaaagtagagttacatggtatatgtgtttaacttaagtgaattagtcactcagtcaaaaaaataagtaaacacagggaagcattttaaatactatgagaaattatgcccaccatttaactcaataaatgtatgtcccacagtgagcacaacacggaaaagacataaatctgcgattggtcttgcatgatttgtgttgagaatgcctgacagcactgagtgtcattagtatgtcagtcagtacacatttactgagtgcctattatgtacaaggtactattccaggcactggaaaaacaggaattaacaaaaatagacaagaattcctacccttatgaaacata

SEQ ID NO: 201317 - DNA, 694 bp, Homo sapiens
cactggtccaaggaatctgcttctgctgaccagagtggttccttagagagcctctttatgctagttttctttgaaggatttcctgaaagatagacttttgtcctagcctattctacaagacctctgtcattcccttccttacaacttgccaccaacctgattcttctttacagtctttggcgaacaaggactctggagccacacagtcatttcagtaagttccttaatacctctgtatctcatcagtaaaatggggatagtaacctcacacggttgttataagaaatacgtgttaatacaagtaaaatgcttagaacttaactgagactggcacatggtaagcattttcgttactacagtagtagtaaaaataattagtatgactaagtagagacgatggtgcatatctcttctccctccccattcaggggcataacctaggtagcttgaaatcaacaaagtgggagtatttacacctgggaaattagcaaatactacaaatatgggcctttgcttccacagatccttctgataaatgtttaccagtgtatcactgaatgcaactcttggataagaagtggtaaccactagcagccagtagaggctcaataggaaattaaccacctttctttagcaaataaaataaatgctgaggacatgtcttattatcagcaaaaatttaacatcttatgaa

SEQ ID NO: 201318 - DNA, 201 bp, Homo sapiens
agcatgggcaacacagcaagattccaactccaaaaaataaaaataaataaataaatagaaagcatggctctggatatggagaagctaacctaatatattatgacacattcaggaggtggttgagtggatggaattaactggcactggtggctttttagatgtggtggatgaagtggggaatgggggcgttcaagaatagtg

SEQ ID NO: 201319 - DNA, 442 bp, Homo sapiens
tggttgataaaaacagctttccaatttagaagaccattctctgaagattacagtacatcttaataaggttgctatgaaatacaaataagaacacaaagtacattgcattgtgcctacacacagtgggctgttaatgttaacctttcatctttataatgttaataactataataatgatagtaagaggtaatggaaaaatctgagaaatagtcaaaatatgatgaggctagtggtcagattggactcatgggatcagggcattggtcagatcaccatagtctggagtttgtcttcagcatgttggttcagaagacacagttgatcactactagggaatgattcacaacgaccaaactcacaaacagatgtaatcatttaggagaaaagtcattctcacacgcaaagatcccgatattttcaattcaactcaccagaaatatca

SEQ ID NO: 201320 - DNA, 345 bp, Homo sapiens
tctttcccccttccaagctcttcaccatactgccaccagtgaagtttgaaaacaatagttggccggacgcggtggctcacgcctgtaatcccagcattttgggaggccgaggcaagcagatcatgaggtcaggagatcgagaccatcctggctaacacggtgaaaccccatctctactaaaaatacaaaaacaaaattagccagtcgtggtggtgggcacctgtagtcccagctactcgggaggctgaggcggaagaatggcgtgaacccaggaggtggagctttcagtgagccgagagcgcgccactgcaccccagcctgggcgacagagtgagactccatctc

SEQ ID NO: 201321 - DNA, 171 bp, Homo sapiens
tataaaaccatggacacttttttatccagagcctaggactgaaacatttatagcatatgatccgcacctgtacgaaacttggtaagattttagagacactctggcttaaatctattggaaagagaactggagatagccggtgttgtctgttaaaataaggtggtcagcatc

SEQ ID NO: 201322 - DNA, 386 bp, Homo sapiens
gagtatgactgtattcaatgaaatcttatttacaaatacagaagaatggctggatttgccccatgagctgtaacttgccaacccctgttctaaattgtcactgagatgtttgtatctggcaaagcactcctaaatgacgtttattttttaaaacagatgtttcagtttccacggcaagcatctctaagggttccatgaaagaaaatgcagtctcatttaatttatgttcgctgcatcacattctgcccctattccatcgccatacccagggtccaaatgtttggacatgacaatcagtgcttcaaacctacctgaaaccacctttatacacttgaaaaccatttacttaaagagtaatggcacacattgcagcaacttttctttct

SEQ ID NO: 201323 - DNA, 630 bp, Homo sapiens
gctaagaaatttgcaccttagctccttaggtgaaccaaggcaggtggtctagggtaccccaaccacaattgtgaacacttgaaaatgtgtcttctgcttgtcccataataagtgagtcactactgggtcgtctgccttgttacaagccaacctgagtcaatctgtttgagcacaattgttgggtactttttagtggttaatgatagagccaaggaagcttgagttgggtgaggttagctgttccttctcatccctgccagcatcttctaatgaaaataagtctcagaccagattcatacctacgatgattaaataagcattcatgatcaaacaggcacctgctttgatagcttaaataagtccctgatctctgtccttgtagatcctcttaccttccaccagtttattcaaggcagaaacaacacaattccaaaggcaggagctggttaccctgattattggcattaggcaattaaagattctcttgaccaatgactggacacaggactgctggtgggtcgagttccagaagccatcctaggtgcagcctaggtctccatgggttcacatccagagtgtttctaaactgttttggccaatgtacatattgtgaatatcattaatttcaca

SEQ ID NO: 201324 - DNA, 428 bp, Homo sapiens
gacaggagggcagcaagctaacaagccaccttctccaccctgtgtagatgacacagctaatgctcaggggatttaagggacacgtctcaagccagccagcaaatgaatgggagagcagagcccaggcctgggattccggagcttgtgccacttgtcaacatgacaagaggacccactgggggatggcacttcttgtgaatgccacccttagcgcctacttggtgcagctttaacttggagaaagaaagatcccattccccttccttgctgttgagaacatagtcatggggcaagactgggcagcccccttatttcagtctgagctatccttggggttcccagcaagatcccaaatacctccaagtccctaatgcgtctttcttggttgtcaaatgccaccgtgagtctgattcctttctgtgtttttc

SEQ ID NO: 201325 - DNA, 506 bp, Homo sapiens
aaagtaaaaactggaccatatcaggaaaggctaagagcagggaaacttaaaaaaatgggactgcatgacagcagatccaccaatagcaccaataacaataggataaaagcattcctagggaagagcaaatataacattcatcttttttaaaggaggggaaaagaatttgccttgtgactttagggtaatatattaaaagcttagaaagataatttaattgcctcaataattgctcaatcaccaagaaatgtgcaaggcactgggaaacagtgtacttatctgcttagctttctaaagagaaaattgggtaggactaactttttctataataataatgggatgattagagaaagggaacatctaaatatccattttagggtatttgaatttttccattttcaacagatatcataccctgctagccagctggataaagggtcttaaagatatcatctgggataatgaaccaaatattcatggatgtttcaataagaaagaggtcatag

SEQ ID NO: 201326 - DNA, 548 bp, Homo sapiens
tgagcgtgcatgtgggtacatgtgagtgtatattcctgagtgtgtgtgtgactgtgtgtacaaagtgttggcaactacagcaagatgatggctgaaccctgtgtgggttgtacacatttgccacagtccatgccctttgtcacgtgaaaatactactactcgtaagtgagaagagtgaatgccagcaactcttggggactgttgtggctgggttgtgtctttaatcatttcatctgccaaggtttttgcaccactgtgttgagagctgtggggatcacagagacatacaaggcacagcctgacccccaagggttccccgacttgttggagaggcagatatgcaaggcccaaatgcagtgtgcacagtgagtgaggcagctgagaggtaggttcctccggggattttgaggaaggttgatggttgatggagagggtttttaagctggatctttaagggtgagtaggagttttccactgcaggagaagagtgtcatgaacagaagctcagagatgtgcaagaacatggtgtgggtggagcccaggctgtg

SEQ ID NO: 201327 - DNA, 497 bp, Homo sapiens
gatctgcaatgagtagcagacacatgtgctgtgaggggaagcacttcatggctgtgatgtgcccataatggtgaaggtttatatgagaattggctaatgttgaatttgattattctcaaccagagaagcagacaggatatcagaatcagaaggaatttaagaaagtaattgctactccccgccgcccccacatttgaacctctgattcagactctgcagaggagattgaatgaattgatttaaaggtgaggtcacaaactggccacttttcagtggaatctaagccaacatgttttactttggccaatgcagtatgtgtgtgttttaaaaaccacatttacacacttctagtgaggctgaaaactccaatttgttactcttccattccctaatttcttaaaaccagcaacttcacacttaagttaatgggcctctgaaggcaattgagacatcagttttagacacccccccgccaaacacacacccaacccgatcta

SEQ ID NO: 201328 - DNA, 220 bp, Homo sapiens
cctctccaaattctcatcctgggcctctactttcctgtttctaaattttagcagtgccttgcacatagcgggcctgcaagaaatgcctgctgattaattgaactggctgcccccgaagccataggactggcattaattgctatggctctttggtaagagacggggttttaccatgttggctaggctggtctcaaacttctgacctcaagtgatccgcctg

SEQ ID NO: 201329 - DNA, 608 bp, Homo sapiens
ctgctggttggttgacaagggatactcactagcaaactaatcacagacaagcaagttgaatttttattcagcagttttttggatatggatttagtagcaccgttattagaatgctgttaatgaaaggtagagtgatcatatgaaataatctttagagaccttttaaaatgactatttttcaggagtagaggtaagcaagaatgagttttcaggctcctaattgaaattgtggtttggagaacattttaatcctctagggttgtctttgtaaaggaagttgctgcagagtagctccctttgtattaacaggcagtagagttagttgtttcaagtgagttagaattttagaattggaacgacagcatgtaattagttggagagttcctatgccattacgctttataaaaagttatctagatgtgatatgaccagttgatcccctgtaataaaaacaattaattttctagagaatttttatctgctgtattcaattttcatagcataatgctgaagaaaatgtaatgagtttttcactgagtttcgttgttcccattcaaaaagaactatttaaaaatccatgttgctactatttgggatgttatagatcc

SEQ ID NO: 201330 - DNA, 357 bp, Homo sapiens
tgatagtgccactattctccagcctgggcaacagagtgagaccttgtctcaaaaaaaaaaaaaaaaaaaaaaaatatactacacacacaaaaaattgattgagtgattgatagagatgggatcttgctgtgttggccaggttggtcttggcctcccaaagtgtgcaaaaaatatatatatatatatgtattttaactcagttctgttcttgatcactgtgacctttcatctttttgtttaaaactgtaatctttttcctgctcacacgtcttctaccactcttcaaagcaattaaaaaatattctttgtttagttgctttcttttgtctgtcttcatcattaacaggctttttcctt

SEQ ID NO: 201331 - DNA, 136 bp, Homo sapiens
ttatcaaaacctgtagtttcgggaaagcagctataaaaaagtcctacaaggaaagaagaaatgctaaaattaataaactaagcatcctaattacaactttatcaaaataacagcagaatcaacccaaagtaaagaa

SEQ ID NO: 201332 - DNA, 502 bp, Homo sapiens
ttcaacctgctcttctcctatttttccaatcccaataataattgttcaggctaaaaatcaaacaatcatccataattcttctcttctcggcaaatgctcaacatgcataataagtatggattgtctccccacatttctccactttacattgcttacactaataacaccccaggcctacctactaccatctcttggttggattgttttgatgctctctgaatgatatccttgcatttacatgtgacccctgaagtttattctctacagagcagccaaggcaatctttaaaaaaaagtatctaattttgccagtccttcgttcacatctttctgataacataccattatatctaaaataacaatcaaagctcttagtatgtcttaaaaaacagccacatgtcctaaaaaatgttttaagtatgtcttaatccccatggcccccccttctcatatttttctctttactgttctcttacccctttcactttcactgcacccccgac

SEQ ID NO: 201333 - DNA, 402 bp, Homo sapiens
aagtatttcttccttgctctgattttttttccttttctactttactagtttttctagttctccttcctggggctttctccaaggtattttagattctttttttttaaaaaaagaaaaaaaaagtactcttataaaatgagtattttgaaaactgtagctgtccctccagaactgaaagaaacacacatggactatttcagttatctcttgcagtatagcaaaccaccccaaaacccaatgacactcctgtggacagaagcgggaccgtggagtggaggggaggcaggaagtgatgcctgggctgctcttttatttattgttcatgattctgtgggtcagggcttggtggggatggctcatctctgctccatgtggtgtcagctgggcctgcgtgactggggc

SEQ ID NO: 201334 - DNA, 998 bp, Homo sapiens
aaggttttttcctagtgtccaaagagctgttcctctttggactaacccctataccttctgcgataatgaattaactagaaataactttgcaaggagagccgaaagctaagagccccgaaaccagacgagctaccgtaagaacagctataaagagcacacccgtctatgtagcaaaatagtgggaagatttataggtagaggcgaccaacctaccgagcctggtgatagctggttgtccaagatagaatcttagttcaactttaaatttgcccacagaaccctctaaatccccttgtaaatttaactgttagtccaaagaggaacagctctttggacactaggaaaaaacctagtagagagagtaaaaaatttaaggacccatagtgaggcctaaaagcaggcaccaatgaagaagagcgtacaagcgcaacagccactacctaagaacaatcccaaacatataacggaactcctcagacccaatgggaccaagtcatatcaccctatagaagaactaatgtgagtataagtaacatgaaaaccattctcctccgcataagcctgcgtccgatgaaaacacttgaactgacaattaacagcccaatatctacaatcaaccaacaaagtcattattacctcaatgtcaaccaagaaagggcatgctcaataaaggaacggttaacaaaagtacaaggacatcgggaaatcttagccgacggtgaaccagaaaaaatcacctctagcatcaacaagaataaagggaccagatgcccagtagaaacctggtaaaaggccggcggaaccctaacacgaagcaaagggaacataaaaagatgatccgtaaaaaaggaagccggacgacagagccacacacgcgataaacagagcaataaattaaccacacggaaaattagaaaccgcaagagggcaaacacacagagcagcaaagcacaacgagcacacaccgcacgaccaccaccaaacacagagacatacaa

SEQ ID NO: 201335 - DNA, 458 bp, Homo sapiens
tcagctcggtccctccttaatgtgtgcccaggctgggcggatggtggtggtgaggatagggaggtcatggctaaaaggtacaagggcttctttttgaggtgataaaattattctgaaattgactgtggtgacagttgtacaactgcatgaagatactaaaaaccagtggagagtacacactacacaggcgtattgtatggtatgtgaattatatctcgataaagctgttacaatacggttcaaaagaagataatgactctgtccatcctcaacattaaaccttccttgcaaacgtcagtgtacaaatcaagattgcacaaacgtgaagtaatcttgctgtctagacagagtgaaaaattcctctacacaataactttttttttctttttcagacagtcttgctctgttgccgtggcgtgactgacaacctgtgtggtctccaaaatgggagccccagc

SEQ ID NO: 201336 - DNA, 611 bp, Homo sapiens
tcagctcggtccctccttaatgtgtgcccaggctgggcggatggtggtggtgaggatagggaggtcatggctaaaaggtacaagggcttctttttgaggtgataaaattattctgaaattgactgtggtgacagttgtacaactgcatgaagatactaaaaaccagtggagagtacacactacacaggcgtattgtatggtatgtgaattatatctcgataaagctgttacaatacggttcaaaagaagataatgactctgtccatcctcaacattaaaccttccttgcaaacgtcagtgtacaaatcaagattgcacaaacgtgaagtaatcttgctgtctagacagagtgaaaaattcctctacacaataactttttttttctttttcagacagtcttgctctgttgcctaggttggagtgcaacagcgcgatctcggctcactgcaacctctgtctcccaggttcaagtgattttcctgcctcagcttcccgagtagctgggattacaggcatacacgaccatgcctggctaaatttttaggcagagtggtatagatgcttgcccgataacactaataaccgcagttgaaagacgcaggggatcctct

SEQ ID NO: 201337 - DNA, 581 bp, Homo sapiens
gaggatcccgcgacgatggttggcaaggccaaaggagacagagtgaagcaatgacaagccaagcagccagtggggagctgctcctctctcaataaaagcctgacggtgatccaggaaaggccaggaggctcatgtttcattctgggcccttaattcccaaaaggcccattttttaaacccatgtatcttagtttttatctggtggaaaaaatgagaatcgtctccttccttctaagtaaatgccatcatccatcaagtgcctgctcggtgtggggcattagttggtccttctggcaacacttgaggggagatactatcacccttatctttgtagggaccagccccacagggtcggtgggtttttctccctgtgtgtggagacgagactgcagaaataaagacacaagacaaagacataaaagaaaagacagctgggcccgggggaccactaccaccaaaatgcggggaccggtagtggccccaaatgtctggctgcactgttatttactggatacaaagcaaaaggggcagggtaaagagtgtgagtcatctccaatgataggtaaggtcacgtgggttat

SEQ ID NO: 201338 - DNA, 352 bp, Homo sapiens
gtaacagacctttaaagaaaaaaacataggaggaaagaagtacacgactcaatggcatcaggaatctttgagtaagatcaatttctcttctgcttacaaaatgccaagggtcagagacattttatgaagttactatttcaataaggaagcttcattttaaagtttcatgttgtttggaaaaggagggttgcaggtgaataaggataaaggaaattaatgtttactgaatacctagcatgtactgggtatacagctggccctctctatctgtgggttccatattcatggattcaaccaaccatgcattgaaaatacttaggaaaaaatactgcatctataccaaacatctaag

SEQ ID NO: 201339 - DNA, 488 bp, Homo sapiens
actctgtattttaaaatatgcagttaagtttttattgactatagtcaccctattgtgctatcatatagtaagttttactcattctttctactttttttgtacccattaacctatccccacctctgccccaccattatctcagctgtctactacttttttcagcctttactaaccatccttctactctatatccatgaattccgttgttttgatttttagatcccacaaataaatgagaacatggcaatgtttgtctttctatgcctggcctatttcacttaacataatgacctccagttccatccatgctgtcgcaagtgacaggatctcattctcttttatggctgaagagtactccattttgtatgtgaaccacattttcttcattcatctgttgatgaacacttagggtgtttccaaatcttagctgttataaacagtattgcaacaaataaaagagtgcagatggaaaattgattttgatggct

SEQ ID NO: 201340 - DNA, 505 bp, Homo sapiens
gtgataggaggtgcttttgagaattttggggacagattcaaggctgtacttctaggaatgatgccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacacccaaa

SEQ ID NO: 201341 - DNA, 235 bp, Homo sapiens
aagtctctgtcagatgtataagagtgctctggtacaataaggactgaaggaagcaaccaaacaaattaagagactttctctagaggcagagtaatgctaagggcagtggcagtgacaaaagcggaggaaaaagtctgtgatcatttgggagacagatgaggcttgtgctgtgtcccaggtgaaagtgatgggcccatttcttgccctattctgaagcagtgttgtgactgactag

SEQ ID NO: 201342 - DNA, 1047 bp, Homo sapiens
ggctgtgcaggcctctggcagtcccgactctcggtgcctcaggaagatgataacacctgccaggttttgagactccggtgaattgaaccacaaagatagctaagctcagttcctggaatttgtgaagccgccaataagtaactattgcccttgcctgaagcgtggggtctgtcttgcttttctaatgctgctgaaacaaatcgccacaaacttaagggcttaaaaccacacaaatttattctcttatacagaaatctaaaaaggatctcggcccggctccatggctcacacctgtaatcccagcactttgggaggccgaggcgggcgcatcacctgaggtcaggagtttgagacgagcctggccaacatggtgaaaccccatctctactaaaaatacaaaaattagtgggtgtgatggtggacgcctgtaatcccaggtactcgggaggctgaggcaggagaatcgcttgaacctgggaggcagaggttgcagtgagctgagatcatgccattgcactccagccctgggcgacagagggagactttgtctcaataagtaaatacataaataaatagattaattaaaataaaaaggatctccagggctgcattgcttctggaagctctagggcaagcttttccagcctgcggccatacggcccaggactgctttgaatgtggcccgacacaaatttgtaaactcttaaaacattatatatttttcttttagttcatctgctgtcgttagtgttattgtattttatgtgtggcccaagacagtcgtcttcttccagtgtggctcaggggagccaaaagatcggaagcccctgctctaggggagtgagttcattttattgccatttccagcttccaaaggctctctgcattccttagctcgtggccccatcctctgtcttcaaacctaccagtgtagcatcttccaagcagtccctcaccactaccctgtctccccggccctctcactccccttctgtggccacgatgcctcagggaaagatggcattttaggcagcaggtaaagaacga

SEQ ID NO: 201343 - DNA, 375 bp, Homo sapiens
ttgccactctgtacattttgcttataataaagggttggttaaaggaaaatagatgtaatttttggcacttgtctgctctaatatcgtgactgacactcataatgtacatccagttctcttaaatcccataaaaagccattgggaagaaaatttttgagataatataaatataatcttacgtaagacctgtgtagccacttcttatagacagcttaggaaagaaagaagccttcaaataattaccaaagtaggaagaaaactaaaaacctctcgtattaagggtaataattgcaaaatgacacccacatagaaaaagtcccttcctttcattttcttgaaatatattgaaacaaaaagttaactaacatcatttgg

SEQ ID NO: 201344 - DNA, 809 bp, Homo sapiens
gcactctctgtcccttctcccacttgtttacttgtatatgtgttcccactagaatgtcaactccaggagagcagagactcttgtcttattcactgctgtgtccctggtgcctagaacagtgcctggcacctgctaagtgcatattaaggagtcgttgctcactgggtagaagcattaaaaaaaaaaaaaaaaaggtcggaggtgatccacggcgccggggccaaaaggagggattggggtggggcactgggcctacctgtttgccatgcagcgcagattaggtccgtctcaaagttggtagagctgccggcccccctgataaccccaggccgtgaaagatgcacggaatagacgcaaaggatagactctggctgtcagtcgagccaactcccctgctcaagcaatcctcccgcctcagtctcctgaatagctgggaccacaggtgtgcgccgtcatgctcagatactggcatcagctctttggcgtgcatgttgtggtagtttttctacaggcgacctaggccatttgtcctggagttttgcagtctggggccagctgatacatccttgtggtgtcattgcacgtgttctctgtctctgtgcttcctgtaagttaggacttaggtctagaagctcgatctgatgcaggttcagtttcttctggcaagcacgctttcttaggtggttgcttggatgagcatcagaattacttacatgtctgtatgactgtcaagttcagttttcaagtaaaaattaagttttttttaaaaaagcgagtgggttgagaagaacactctgaagtcactccta

SEQ ID NO: 201345 - DNA, 659 bp, Homo sapiens
agtttcctaggctggtctcgaactcctgacctcaagtgatccacccgcctcggcctcccaaaatgttgggattataggcgtgagccacggcgcccggcccatttgtttgatttgggtctggacaaggtctacactttgcatccggttgataggcctcttttttttgttttgttttgttccctttgttacccaggctgaagtgcagtggagcgatcagagctcacgtgcagccttgacctcccctgctcaagcaatcctcccgcctcagtctcctgaatagctgggaccacaggtgtgcgccgtcatgctcagatactggcatcagctctttggcgtgcatgttgtggtagtttttctacaggcgacctaggccatttgtcctggagttttgcagtctggggccagctgatacatccttgtggtgtcattgcacgtgttctctgtctctgtgcttcctgtaagttaggacttaggtctagaagctcgatctgatgcaggttcagtttcttctggcaagcacgctttcttaggtggttgcttggatgagcatcagaattacttacatgtctgtatgactgtcaagttcagttttcaagtaaaaattaagttttttttaaaaaagcgagtgggttgagaagaacactctgaagtcactccta

SEQ ID NO: 201346 - DNA, 672 bp, Homo sapiens
atctcaacaccagaaggaatgaaaatgtaaatctgaacaacttactttatttctccaatgtaacagttcttaaatggatgatttctgacccttggtacaagacaagagtttgaaataagtacgggaaacaaatcaatctcattttgcctgggttcctggaaacatcttttgatgtgctcagtgcccttaatgagggtagagatttttcattttaatccgtgatggattgagtttgaaatttgtgactgcagagaggacttagatctcctctgtcttcacttctgtagactgtcagcatgtcaagttcaagccctgctgtgtaacacgctgctaggatcgcattagtcccaggtacacactgatggacaaatggtgtaactccaactcttgcccttaaaacaaaagccagccgggtgcggtggctcacatctgtgatcccagcactttgggaggccgaggcaggcggatcacgaggtcaggagatggagaccatcctggctaacacagtgaaatcctgtctctactaaaaatacaaaaaattagccaggcatggtagcgggcacctgtagtcccagccactcgggaggccgaggcaggagaatggtgtgaacccgggaggggagcttgcagtgagccgagatcgcctgggcaatagagtgagactccgtctca

SEQ ID NO: 201347 - DNA, 459 bp, Homo sapiens
tatattgtaggatgtttagcagcgtccctggtccctacctgctagatcccaaaaacaccccctatccaggatgttaaaactaaaaaatgccttcagaccttgccagaggtcccctggggggtgcaaaatgctttctaccctcctgcctgagccccattgagaatctctgagtgtgatgaaaaacacatggaaaagtagatggattttccacactgggaaaagatgcttgtttccacataaggggctaggcttctggctgtccagccagctactcaaatttgacctatttcccaatttttctataaacagattatttttattctcagagtagtatgagtctttgcctgggggaaaaaatgaacagaagtaaacaatatactcctgtatgccctctctgctaacctcatctgtcactgctggcctgagatttagagaatgaggcactcagacatgatcttc

SEQ ID NO: 201348 - DNA, 285 bp, Homo sapiens
gccagttagctgagcgttcaggtgactaggaagtcaggccatcttccccttacgtaacagacataattgtcagctttttctaaatcgagctcagggagcttgctatcggtgccacctcccttcagcatctcagacttcagagacattgcgaatgacttctcctagaataattagatccaagacagaatttgatgactggaggtatcttataggttatcttcaaatttaaaacatttgtgctttcagggactttctctcctagtacaggtggccattataatgaaa

SEQ ID NO: 201349 - DNA, 124 bp, Homo sapiens
catgccacaatgtagataaacatgaaaacattgtgctaagtgaaacaagtcagtcactaaagaccaaatactgtatgactctacttatatgaaagtccggggtaggcaaacttagagtctagag

SEQ ID NO: 201350 - DNA, 272 bp, Homo sapiens
tcattagatatctgataattttctagtattagtagacttcagaattgtacttgtagacttcataattgcatttaccttttcaaatacttagggtcagaagtagagttatttgaaatgataaatcatcttgtgggtacaatattttgagagcagaaacacaatgaagagagccagccttgaatttttattttggtttaagctgatatttttatgaatgcttgttatgtatggcacaatcagcacataatataatttggtcacacttataattg

SEQ ID NO: 201351 - DNA, 711 bp, Homo sapiens
cccatggagctgagtgggccagccacagcctctcccctccctgtccgtgatgcggtcaacccaggcgtggcaagccctgctgggccaggccaggtaagcacgctggaggggccacagacaaaagggacatccgtcctacagactttaaaaggtaactccgaaccatcaggcctgccaaggcttcccacagccacctggcctcagctgcttcccacagatatgaggtgtggccctttcagggagaagcttttggaagaggtagcaccgtcacagtcaaggggggcccaactgggtggaagaatgggaagtcccggaggctggaccatctgccagccgaggcagtgactctgcttctcctaaaggtggtgaccagtagggaggacggccaccttcttcctgcagtgggcactgtctgtgctctggaggcagccgtgatgacaagtatagacagtcaaagccacaccaccaagggtgaaggccattccaagaggcgagcagctcagagaggagactgagtctaggggaggacggctaggaaagggggccaaacttgtatataatgatgtcttccatgtctggctccctggacagataaaggcccaatagagcagggaccctatctgtctggcaccgtccttagggcctataagattgccacatagtagcagctccacagctctttgttgaataaatgaatgaactctaacaaga

SEQ ID NO: 201352 - DNA, 1084 bp, Homo sapiens
ctggggtttcaggtatgtgtcaccacacccagctaatttttgtatttttagtagagacagggtttcaccatgttggtcaggttggtcttgaactcctgacctcgtgatccacctgccttggcctcccagagttctgggattataggtgtgagccaccgcgcctggccatgaagaaacacttgttcaagaaaatctacaaaagtcagtaagaacattgggtctgtggtatttgaactaaaagctcctccatccctccttttttgcagctagtgagatagaaactttactctagagggtgtagccaagaacacagggctccagctccatgtattccacctcatagcctcagtcagaaggttttcatcctaggaggaggagtagcgtaccaacatttctcattttgcctcagatgcctgtcactgaggcaaaattctaggtaattgtggctgagtggtggtggttcctttctttcacccagtccctactcctaggatggagacttgaccttgggcaaggcactgctgaaaatactggggctctgatctcctttacccttgcttttcaagccgagaagccctaagtctacagcctcccttcccgtgggtactccacttcgtaaagcagggatgccattcagataaacacaccattgtccccactctagctgtagagagtggctcagatgttttatctggaagcagaagtaggctgtaaaacaggtagctcctgatcttttcctaaaggaacaaagtatggagaagctcaggagtgtggagaaagtcaaaaaaactgcggaggttgttgtgcaaagcaatagggaagagactggttagattcactggagatgcaggataaactagtaggccagctagtttgctggagagaaccaggaaaagaagaagctaggaggagccctttggtatcagaacaactctcaaacactgaccttgggaactaactgtccctttagagggacccaaatttgatctactcagtctgtggagcaaggtaatagcataggtgagtttattatactcgccaagagcaatgctcatgaatagttagtgactcattactgacaaga

SEQ ID NO: 201353 - DNA, 494 bp, Homo sapiens
ttcatgtcgaggcttcatgccaacttctcctcatgccctctttctgccggcaccactagcactgattgctgcagactttattttctctctggtctccaagatgactttatttttgaccaaggaacttatcctacacttcgctacgagtcctttcatgcccagtcaggaattaaacttataccaatgagagcctcacacattcaaggatgtactaagcactacaggcctcacagaaacagagatcccatctgggagttttcagtaccacatggcatgaaggccctggacatgaaactactagtctttgtatttcatttttatgtacttaaagggcagttctaaagtgagggagaaccccaaattactctctgcaataaaaaacaactggtaaactagaatatgattcagatagaggaaagccacagggttttagaattacaggcacaaagcactttactgtattttttttaaggcatgaagttagatgattttgt

SEQ ID NO: 201354 - DNA, 478 bp, Homo sapiens
aggggtgtgaccctaccatgaagaaggacatgaaaacattttgggattctaccaactccaaaaaggttttaacagactgtgatggttaatattgagtgtcaacttgattggattgaaggatgcaaagtattcttcctgggtgtgtctgtgagggtgttgccaaaggagattaacatttgagtcagtggactgggagaggcagaccaacccttaatcagctgccagcactatctaatcagctgccagggtggctaggataaaagcaggaggaggaaagtggaaggactagactggcttagtcttctggcctccatctttctcctgtactggatgtttcctgcccttgaacatcagattccagggtcttcagcttttggactcttggacttacaccagtggtttgccaggggcttttgggcctttggccacagactgaaggctgcactgtcagcttccctacttttgaggttttgggact

SEQ ID NO: 201355 - DNA, 154 bp, Homo sapiens
tctgccagcctccgcctcccaaagtgctgggattacaggtgtgagccacagcgcctggcctgtatcacttatttctaggggaaatggaaggaccagtatacaggatttatatactgattcaacacaatttcccagtctttatcttttttcttct

SEQ ID NO: 201356 - DNA, 837 bp, Homo sapiens
ctcttctttcacctggagtatgtttctgatatgctatctagtcatcatccttttttcccaaggcctagcttaaggattctttttttttttcccccgagacagagtcttgctctgtcacccaggctggagtacagtggcgcaatctctgctcactgcaacctccgcctcctgggttcaagtaattctcctgtcttagcctcctgagtagctgggattacaggcacctgtcagcacacccgctaatttttgtatttttagtagagacggtgtttcaccatgttggccaggctggtctcgaactcctgacctcatgatccgccctctgcggcctcccaaagtgctgggattacaggcgtgggccactgcgcctggccaggattattattcttaaagccttttctcacaaatgtagtctccattgttgtcacaattctaaaattccatatatgtcttttaactataaatttcatgcagagaatagtgttctgtttatctgatatcccattgcaatagtacaagggccatttaaaacatgtccacctattaatttcaggaaatgattaataggaagttaccttgcatccaacaaacatgaagacttactatgtccatgcactgatggtcacaggtagacataactcctgtcttttctaacatttagactagtgaaaatgacaaatcaaagccaggcatggtgactcactcctgttgtcactcaggaggctgatgcaggagtatcagttgattccaagagttcgaggctgtagtgtgctgtaatggcattgcactctagctctagcctgggtaacatagccagactccgtctcttttttattt

SEQ ID NO: 201357 - DNA, 593 bp, Homo sapiens
gaatgtattcaccattgaggagatattaaaaaaaacctgaccatcttcacactgaatactaggcaagaaagattagtaccatggaaaaaaaatgctagttttgtattcagatctgagctcaaaccttagctctgctatcatagctctgtaactgtaacatattctttaagcttgttttgtcatgttacatggtgataaagaaaaatacttgttacagggttgtaataaggataaaacaaagtgaaaacctctagcacagttcctgactgcattttttctcaatgtttgttgaaaatgaaaacattttaaacatttaaaatgaaaattttaaacactgtaattttcaggtaattaattacatgtatgttgagcaaaagtgaatacttttcttataaaagtaactttccggccgggcgcggtagttcacgcctgtaatcccagcactttgggaggctgaagtgggtggatcgcctgaggtcaagagttcgagaccagcctggccaacatggtgaaaccctgtccctactaaaaatacaaaagttagctgggtgtggtagtgggcacctgtaattccagctactctgaggctgagg

SEQ ID NO: 201358 - DNA, 487 bp, Homo sapiens
tctggcacacagtgggcctgataagtggtattgatgcctgagatattgtattaacttaaatgaccaggttgaagagaaggtgtcagaaatttacgttcctccatgtgtatttgattatataaaatactgttggtcacactttccctacgtcatattaggtaaagttagaaagtgaaggcttttccactgggcacggtggctctcgcctgtaatcccagcactttgggaagccaaagcaggtggatcacttgggaactcaggagttcaagaccagcctggccaacacggtgaacccctgtttccactaaaaatacaaaaattagtcgggtgtggtggtgggcgcctgtaatcccagctactctggaggctgaagcaggagaatcgcttgaacccggaggcagacgttagttacagtgagctgagatcaagccactgcactccagcctgggtgagtgagactccgtctcaaaacaaacaaaaacagaag

SEQ ID NO: 201359 - DNA, 471 bp, Homo sapiens
gctctgtgtctcacaagtcatcaaagagaggacttgacattgatgatcgcttccctctgtgacatttccagactctatacttacttcgaaactcataaaaataagcattgacaaggatatgagggtgtggtaagcgcattgcttccccagacttgaaacacttaacagcagcgtttcctgcgagtaacatcaaagacacctttgaattgcacaggcagaaattgagtcccttttccagttctctttcaaatcttctggttacttcaagggatcactttggtttggtgccagtgtgtctttaaacaattctatttatttatggacggtgtgtgtgtgcatataattatctatttatttacacatatatgtataaaattatatgtacgtaattttagtttttaaaggatcatgcagtaaaattgaaatttttagagttcagttcaataaaaattttaacataggtaaccacta

SEQ ID NO: 201360 - DNA, 305 bp, Homo sapiens
agaccatctctgtagtgtctagtctcataaggacactaatccctttcatgggagccactcttatgacccaattatctcccgaaggctctatctcctaataccatctcaatggggatagggcttccacatcaccatttttggggaacacagcattcagacaatagcatccacaaaactccttcgttactttagtgatttcctcctcattattcaaggctcagggaagacttcattgactgtgcaccaccccctcagccctagaccaggttaggttcattcttgcagactctcacaaagccttgtgc

SEQ ID NO: 201361 - DNA, 235 bp, Homo sapiens
aaaaatgttttttgaggtcaaaagctaaattttcaaattggcattacaaagtcctgatttgtgaacttctcactgactttaggcttccaactttaagcaactctaacaagaatcttaaaatcagtcacacacacacacacacacacacgcacacacacaaacctgttttctaaatttcttagctaaaaacaaaaacaaaaacaaaaaacaacccctcacttctttatcagactct

SEQ ID NO: 201362 - DNA, 527 bp, Homo sapiens
gatgactcgggccacaggagcatggccctcccctgtcaaagctgacttctcgtttctcaggacaaaatccatacgctttaccgtgcccttcaaggccctggctgaccggccgtggcccatctccctggcctcacctcactgcccatggggctcctatggccgcctcagcttctttctgctcctcagactcccagactggagccgttgctgcctcagggtgttgctttatgtgttttcacagatgcctttaggggagatagacctaaaagagtctgggcaacatgcacagcctccaagcagttcactcatcactcagctactatggccagactgcctgctagtgcccggtaggtgccaggccctggggaaggaagcaatgccctgtggcccttgttcccaaggaccgagcacttttccacgcagttaaggtgcacaaacacaaaacaccgaataacgctgaaagagcccaagagaggaccagaggtcactgggctgaatatgatgaaaagtcaactaaaaaccagaaa

SEQ ID NO: 201363 - DNA, 279 bp, Homo sapiens
caataagtgggtccctctgtaacctctgtaactctgtgattccagaattctaaaaaggcaggctatgtggtttttcctcacaaccccacatgtggatttattacttgaactcaaatgccagcctgtttcactagtagggagagaagaaggctcttctttataaacgttcagtgttttaatggcatcgggaaaagctaagacttctgtctttcagtcaaagcaagtagagaaggcaatgagactatgttgactatgtagagactgtcatcataataaaaa

SEQ ID NO: 201364 - DNA, 589 bp, Homo sapiens
gggtgctggcaaacaaatcagatggttccaggcagtcaggatggacgtgctgccttctgcctcggaaggtggtggggtggcccaggtgcccgccgtgccctcggggatcagtctgcataacccgtctggaattatgtcagcagacctcacaggtcttctcttgagatacaacctcctcgcagggcaggtcaccttggcgatggtggtctgggaatggctgtagtggctcggcttgcaggtcatccgctcctggaggcctcgcagaagtcaccttgtgccatccatgctgagccacgctggagtttctccaggcccaaggtgtgtgccacccttctcctgccccaccctgaagagctgcaggccagacctacctccttccggggtggtgaactccttggtctcactgcgaggcccatcacctctcccattgaccacaaccatctccagcttgtagttactgtaggggaagaggcgggacaccacgccacggaggcggtcaccagggaagctggcttgctgtctcttctgagacacccacaggttcttcagcaagctgctctccctccagtagtaggccttcgggacagag

SEQ ID NO: 201365 - DNA, 366 bp, Homo sapiens
tgcccaccagcgaggctgggatttgaactcaaactaatcaggagctccagcgtccacccccatgaccacagtgccgtacagcacgaacacacggctgtgtcacccacagccacctttggcacacactgtcactatgggggagatgagtcaaaatcagtgaaagcaatgtggttacagcgtggctgctgagggtggagctctgtgtggtctaacagcccagaaggcttgaagcaaaggatcaggaagcagccctgccagaggaaggctgccaagaactgaccgcctgccccacacacccccgggacacatggccacggctgccaggagctcctcttggccatcaaagggcagcagcaccagctttca

SEQ ID NO: 201366 - DNA, 370 bp, Homo sapiens
taaattccctttgtctagtatctgcggggtgaagttacccctactgaaatggtccttgaatcatagatttacagatggaattaacaagtgtggcttttttctctgaaccactttttgtgcacattcaacatctcggaaagaaaaatgatctatttttatacggtacatacatagattggtattagctttactgaagaacacaaggataagacaaaggtcagttttaaaaaaaatcaatctcaggccgggcgcagtggctcatgcctgtaatcccagcactttggggaggctgaggtggaggatcacttgaggccaggagtttgagaccagcctgggcaacacaccattgcactgtagcctgggcaacaag

SEQ ID NO: 201367 - DNA, 694 bp, Homo sapiens
ggcgtcttcctttgcccagagcaaattgagacatccccgtgagagcccgagggtcgcttccttttgggtttaaagtcgtcctgaggctggtctcgtccccggtctttctgctataggtcaatgtatacactttctgttgcgtagttttcctgctgaaaaccttgttctgactcctcgcgccccgcgctttttaaagtcttcacccgcgatgtggattcttgcccagggcgcctcccagcctccccctcctcagccccgggagcgccgcgccgcagccccagtcccggggaggccgagtcctctgccaggtcctgggatcctgcagaccccatcctggtcctaaggcgccgtcgcgccccccgccccgcaccttcctcctcatgccggggcctgctgctccccaggtctcccctccgcagtcaccgctttcattgaacctgcactggggaggtcccaggggcctgtcctgcggcacggggtcttcttgcctgcggagctccagggcgtggaaaatgcgctcctccgggatgcaggcgtcttactccaaaccgtgttgcgattgtgtgggccaaaggaatcaggagacagagagcagtagaaaacctgaggcagagaaaagaagaataagaaaggcccataacagatggcaaaatagaggattggtgagggatatgccaagagatggcagaagtga

SEQ ID NO: 201368 - DNA, 773 bp, Homo sapiens
atagccctatttgtctttctctttagctgtacttctctatctttctgcatttttgtctccatctctctttttctctccatgtatctctgtgtctctgtctctctctgtacctctccccatccctcctcctccaccccacctggtgcttttggatatctctatccagttcccttggactccctagggttttgcacctgcctctctgccagcccctccccctgggagcaggtgtctgggtcctttgcagaaatgagctcattagattgagatggaggtggtgaggggcggtggatgttattaagagagtcctcaaaaggggactgaggagctgtggctcaggcctgtaatcccagcactttgaggcaggaggattgcctgagtccaggagttcaagaccagcctaggcaacaaagcaaggtcccatctctacataaaataaaaagggtggagggtgacccttagggtcatgtattttaaccttcaccccaatttacagatggggaaactgaggttcagagggttgtaacagcttccccaaggtcccactgatagaggcagtggcctggccatggtggagggaaggaagaaatgaggggtgagaaagcagaggggtgaagtggggtaggatggaccccgtctcttcccatctgccagggtcactgtgttcccacctcggcttctgggtgcggtgctttggcgtgggagcggcgggcaggccccggccatgcttcctgttggcatggacttcggcggccccaccccctcagtgcccg

SEQ ID NO: 201369 - DNA, 342 bp, Homo sapiens
atggatatataatatgttttgtttattcatcagtcgatgggcattttggttgtttgcaccttttggctattgtcaatagtgctgctgtgaacattgaacacaaaaagtagaaaatggttcacaaatttgtgtgttatccttgtgcaggagccatgctaatctgtgcatggttcccatttgaggatatctgctgctgaagcaagcaccataattaaggctttaaaacctttttttaaattttttttagacaaagtctcactctgttgcccaggtggaagttgcagtgagctgagatcgcaccatttcactccagcctgggaggcagatcaagactctgtctca

SEQ ID NO: 201370 - DNA, 742 bp, Homo sapiens
gtttgcttgtttggatacagggtctcactctgttgcccaggctggagtcttggctcactgcagcttcagcctctggagctcaagtgatcctcctgcctcaccccgcaagcagctgggagtacacacatgtgccaccacgcctggctatttttattttttgtagagatggggtttcaccatgctgcccaggctggtctcgaactcctcaccttaggcaactcacccatcttggcctcccaaagtgctgggattacaggcatgggccactgcacccagctaacatgtttgtaacatctgatttaaagtctttatccagtaaggtcagtgtcagcttcctcgggcgcagtttgcattgattgctttttttcctcccgtgtctgggccatgcttctttgcatgtttcagaattttgttaaaagctggacattttaagtaacataatgtggcaactgtggaaatcatattctcctccctccccatggtggttcctttttcttgtttaatgtcttttctgaactaattatgtaaagttgtgttctttgtcatgtgtggccactatagtctctgcttgattagcttagtggtcctctaaccattagatctccttaattgcctggaacccgtaagtcactcagccaagagtttataactgccttagactttacttcctcattctgcagaggctcaaggtagccagtggtgagagcttagggctttctagatcttacctgagcatgcacac

SEQ ID NO: 201371 - DNA, 1980 bp, Homo sapiens
ttttttttttttctcctagtgctttctgggtccaggcaatcttcatttgagaaccactagtttacagcactctctgagccaaggaatttggagtcaaccagtgctcatctaggtatcaaaatggtggcaagccccaagtgcaactaacaacctacagaagacggaagtctaactttagtcaacactcagggagtggggatgaagaatgtagtcttcaaagctcctggccactatggaacactgttctcctgctgcaccctacatgctcacccctccatcgtcaaagcctcctcctcctggttctggaacaggtggtaaagcttttggaggccctgtgccaaccagtgctctccgcaccgttaatctgggaaccccaaatcaagatgcttgaccctcctgggattctgagaggtcagccctgtggcaccagaggctttctggaatgattcatcatattgtcagctgaaattctactgaagtggatgcccaagactagtttctcagtactgcagtatctcactcaatcccagtgatccgaaaatccatccatcctcccaggacagtctgactgtgtagctggttcaggaaaccaaaggcaagcgggggtcactcatccctccagagcctccagactgagaataaggaaaaaaatcgctaggtgcagtggctcacgcctataatcccagcactttgggaggctgaggtgggtgaattatgaggtcaggagattgagaccatcctggccaacatggtgaaaccccatctctactaaaaatacaaaaattagctgggcgcggtggcgtgcgcctgcagtccctgctactcgggaggctcaggcaggagaatcacttgaacctgggaggcggaggttgcagtgagccgagatcgcaccacaacactctagcctggtgacagagcgagactccgtctcaaaaaaacacccaaaaaaccaacaaaaaaaaccccaaaaatcagctgggataggtcatgaggtcatgacaggccatcaactatttaagagatttttcaactaagaatataagaacatattgccataaaattttaaaatccctatattctagaggttctatctattttcagttgtatgctccttaaacttatctgtatttaggcttcccccaaaatgaattctaacagaaaaaaaaaacttcggtaaaaaaagaatccataaacactaaatattttaatacctttatttacctcctctctaacagaactaatcagcagcagataatatatttgttacgaagagaattaattttctagttaaacatgcacataaaaacataaaggtgacaatatttggcaatatatgacactaataaaggtaacatttattgggctatccactgggctaagcgcttgactcagatcacctcagttaatccttacagcaaacctataaagtaggtgctattcttatttccattttatagatgagcttataaatgaggaacctcattactgtaatttaatcttcaccaacccagaatttgagttcagtgtttactctggctattaaaaggttgaataagcaaattagaaattaaacgggatttcagaagatatatttaacctactagaaggtcgtacgttttaagacatactgaaaaacagatgctaactgcttccaacaggatgtgtttgggaagatcctgcctgacactataccacattaaaacacttgaagattcaaacttttactagttaaggttgagtgtcctctcactattatccccaatgactggtccaagttagtaaggtattattctacttctatgggtggtacagtatggtggatgtcagctgcggctcccaagttctatttccctcctaccctgacaaagtgtccagaactctacacacccccagcctccccacagcctggtgcaggagccagtctggtgcagaagccagcctgaggatgaactgacccagggaggaaggagtggagagatt

SEQ ID NO: 201372 - DNA, 138 bp, Homo sapiens
tgctgggattacaggtgtgagccaccgcgcccagctcttaataactcttataacaagaattataatttcctccacatccatcactgttgtagaagcctccatagctacctccaccacatctgctgctgctgccatgac

SEQ ID NO: 201373 - DNA, 761 bp, Homo sapiens
agtccttgttaattgcgtttattcaatggagagtttcctatcagttaacagacacagcttcctgtatgacagaagtgtcgtggctcatggccatccccgctcctattgtttacatacctgtgtgaagtcagaatcctttatagaaagaagaaaatattgtgttaaagtagaaattactcatttttcttaaaatctgtatcagagtaatatttattttgattagaagaaaaaactatgttatctttttctttttgccttgtatgtatttgcttatattttgaaaagtgcttttagttacaaataaaccttaaacctctgtgtagaaaaatgtgaaaggtataggcatggtctcttcacttcctcagttacatcctctcatgcagaggttctaatcacagttaaatttcaatgtcttcaaacacggataagtgggtttttttaaaaaggcacagtcttatacttatttctgtaaccccaatcatactttggttggctggttttaaaaaatcatgttacacaaaactgagatgacccagtttagagaatcccaattaaaataagtgctcaggtgaagacagggtagacttaatgcaaaattatgaaatgtacttttctgctcccattgtgtccggaattggtgggttcttggtctcactgacttcaagaatgaagccgcggaccctcacggtgagtgttaacagttcttaaagatggtgtatccggagtttgttccttctgatgttcggacgtgttcagagttt

SEQ ID NO: 201374 - DNA, 362 bp, Homo sapiens
gcctccttcattttcccatatgcactgtgggaaagccccatgacgtcagctgcaataagccaaggaatgattagcaggccagttctgtggcttgacaagctccccagtaattagccccctgacaccactgccatttcacgcaccatattgtctccctgtaatgggcctgcttaaaatcagagcttattcgctacttggagaaaataacactatgggtccctattagctcttaataactgaggttaaataattccatgaggtgttctgtaaggagtgccttgtgggagttaacaggtacaggtgagaagcatgagccccaggtgagactttccagtgggaaaccctgggtatctaggcctcgg

SEQ ID NO: 201375 - DNA, 248 bp, Homo sapiens
aagggccagtggatgtcaggcttctctgctaattgatagcaatactctgtcttcttgataatgatagctaacgtttattgaatacttactgtatcttggcactgtgtattttttgttcaacaattttttttttttttgtagagacggggacttaccatgttgcccaggctggttgtaaactcctggcttcaagtgatctcccatcttggcctcccaaagccctgggcttataggcatgagcctttgca

SEQ ID NO: 201376 - DNA, 514 bp, Homo sapiens
accaacctgtattggtcaaatatatggaaaagaactgtacacaagtggttttaagtaacatgcaaaaatgtactaaacacaccatgtattttcaaaaccataggtatacttccttataagtaaagataacttgactgtcattcctggctgtcaccaaaaagatgcaacggataaaaggtaacaataaagaaataaccatggagccaagtaaagtatttcagagtcaagcaactgcaaatatcagtacctttattttttggaggggggagcggggaggggtgagagggcgtggctgcagggaataacagagtctcaccgtcacccaggctggagtgcagtggtatgatctcggctcactgcaacctgtgcttctcaggctcaagcaattctcgttcctcagcctcctgagtagttgggacttcaggcatgcactacaccaccacgcccagctaatttttgtatttttggtagagatgatgtttcgtcatattgcccaggctgctcttgaactcct

SEQ ID NO: 201377 - DNA, 473 bp, Homo sapiens
gcctcaaagtggtccaaatatccacttgcagattccacaaaaagagtgtttcaaacctcctctatcaaaagcaaggttcaattctgtgagttgaaagcacacatcaccaagaagtttctgagaatgcttctctgtagcttttatgtgaagatatttcctttttgaccataggcctcaaagctctccaaatatccaattgcagattttacaaaaagagtttgtcaaaactgctccatcaaaagcaacgttcaactctgtgagttgaatgcacacatcacaaagaactttctgagaatgcttctgtctagtgtttatgtgaagatattcccgtttccaatgttggtctcaaaacactccaaatatcctcttgcaaattctagtaaaagagtctttcaaaactgttctattataaggtatgttcaactctgtgagttgaatgcaaagatcacgaacaagtctctgagaatgcttct

SEQ ID NO: 201378 - DNA, 520 bp, Homo sapiens
attttttctttgtccaacttgatcttatcatttccttattgtatatgtcttcattaagttttaacatctattctgaaaatactaatgtgatttcatgctactgctattcatctgtttcccatcttttaaataggatttgttgttcaccttcgagtgggcataagttaatcttctcttcattcagttgtgctgtagctatgtgttaaaatctccagggtccccttttgttttatttcctttacaaaaaaagcttcagcatttatacagttggtaaattctcaagtacaaagaaggaagtgaaaatcctcccaaatctgatcacctcaaataactactgttaatattttattcagcaccagtctatacctgttaggcatttaaaaaggcacgtatatacaagtgtattttgtatgtataaataagcctgcatgctcatataatctttataatgtttattttctgttgttacttgattttcgttcaatcttttcaataaaattgtactgtttatattaatatg

SEQ ID NO: 201379 - DNA, 327 bp, Homo sapiens
gggacctggcacagcctggcaaggagcagcctgggtagaaggggagaggtcagatgagtccgcagaaaaggattcaaaggactcagagcttggtgtggagactgaaggaacagacaggagagaaagaagaaggatttgggatgagtcgcattaactttgactatgcctttaactccagccacctcttcaagaggaaattgttgggcaggtggggaagggctagtcgcggaaggaaactgtaagccagaccgggtgtgaggaggggaggtgatagaaagattatagggtgggggagcagaggctgaggaagaattgggacctggcaca

SEQ ID NO: 201380 - DNA, 357 bp, Homo sapiens
aaattaattattttttgtagagagcactgttaggccaacaaagggaatgtggtaaaatgttaatatttagggaatctgagtgaagggaattttttgtactattcttgcaacttttctgttagtctaaaattagataaaaagtttaaaatataaaatgaatctccagtcccctaccctgccccctcacacaaaaggtagaactaaagtattggataacagaggataaattggaatgggatgtttggagttagtgttacttaattacattatgttaattataaaacaaaatagtaacaaagtaaacctttcaaactagtagagaggaaaatggattgaaaaaaatcaaaatatagcaag

SEQ ID NO: 201381 - DNA, 432 bp, Homo sapiens
ttatgaagctgtcaagtcttcctccataaaactcctcacagacgttttctctacagttgtgaccactgctttagttcaggcactttttttttctcacctgaactattacaacagcttcttaatcagcttcttagttggtctcctcttccagtccattctctgcaccccatccagaggttttttgtttatttgcttgtttgtttttaaatacaagtcaggtcacgttactagcctgtttcaaatccttcattaaacctgaccctgtaggcagtgggggaccagtcacttttgcaaagcatgagatgttgtccttcataatctgacacaactgtccctaaggattcattattcaagccccatggctcctcactgccctctgaacagagtacaaacatttcttccctgtaggccaaggctaccctcccttcagaa

SEQ ID NO: 201382 - DNA, 393 bp, Homo sapiens
aactcctctgctctacagcagactgactactctgttttgtgttaaagagcatttaatgtttgctaaatgtttaaagccagtcaattccaaccccaacagctttctaaaagcaaaaaaaagtccacatggactcatggccatactatctaaatcacactttttagagcaagaaagctccttgaaacagtactccaattacctaattctgcagaggttaatgtacatagtccaatgtcatgcagaactaggatcataatccaggttcttatatgaatccactcatctatttcacaactctgccttttactcaactgcttcaaaagcagtttatacctgctactaaatctcagtactgcatgttaactgtctgaagtaaaagtttccttcctttaa

SEQ ID NO: 201383 - DNA, 261 bp, Homo sapiens
atagtgaaacctcgtctctactaaaaatacaaaaactagccaggcatagtggcacacgcctgtagtactagctactcaggaggctgaggcaggagaattacttgaacctgggaggcaaaggttgcagtgagccaagatcacgccactgcactccaacctgagggtcttctaaggagtgagactctatctccatcaatcaatcaatcaatcaataattttggaataaaagagagtggaacaagaactagttagagaaaacag

SEQ ID NO: 201384 - DNA, 414 bp, Homo sapiens
ctttagtgatacattttaattaaaaaacaaatacttatttgtttatattggtagtagtcactgcatattactcattctgaccctgccttatgttactttaagagtggcataacaagtcaattaaatattactgatcacctattatgtgtgagctgttgggttaggtctgcagtagacacagttatacaatagcaataaatgtgttgagaacgctatgggaccatcttgctttgctttgttgcacagcgatgtaaagaacttttcagtgttagcaaaatgtgcacaactggacaaaaggaaaccagacagaggtacatctgtgtaaatctgccaccactattataaatcagtttttttattttgctgtttgtaggtcataggtgaattctcatttatatcttggaaaaaaaagtt

SEQ ID NO: 201385 - DNA, 304 bp, Homo sapiens
tcggtatgagcagagttgccaccccagcggggcgcgcagcccgggaacccggcagagagggagtgccggggtgcccagtgccgagccggagcccgacttggcaggtgctgctccgcctggttttagaggggtgatctcagccctgagatagtccccgcttctcccctgctgccctggccctctccgccagtcctggccccacgctgatggcgcccgggcagaggaaaagcttgcggttttatttttcctgagctagacctgaacacaacaaaagagcgcaaaggagacctgcggctcataaaca

SEQ ID NO: 201386 - DNA, 346 bp, Homo sapiens
tcatcctctccatccgggtctgcagggacatgatcacccacggctccttgggctacgcgtatgtgaacttccagtagcccgcggacgcggagcatgctgtgaacactatgaattttgatgttataaagggcaagccagtacgcatcgtgtagtctcagcgtgatccatcacttcgcaaaagtggagtgggctacatattcattaaaaatctggacaaatccattgataataaagcactgtatgatacatttttctgcttttggtaacatcctttcatgtaaggtgggctgtgatgaaaatgattccaagggctatggatctgtacactttgagacacaggaagcag

SEQ ID NO: 201387 - DNA, 473 bp, Homo sapiens
gcataccactataagagagtgcagagtccagtcttaactccagtattagtgcctcgtcataatgaatccaatcccacaacacagacttctggttcagtctaggaacctgagccacaatgaaccacacatgccacaaaatgccacgttcccagattcttcccaccagcccaacaacactccctttcccttatctccaaacagcccttatcccccttctcctgctagcaccaccaatacatgtgtggctggtgctggctggaaggagaggtggcaagaaggaggtgggcatgcttagggctggggcagcgtctggggtgacccccgaccaggaggcaggagatgggagacgtccccagaagacccacgccccatcttgagagggctgcagatttcagttgaggcaaaagttggagaaaatagttctagaaaagctgaagaactgagaaatggccaggcctaccactctagtttta

SEQ ID NO: 201388 - DNA, 784 bp, Homo sapiens
ataggttaaagggctcagtcccacaagactgccagatatatatttcttatatcacattatcacctgagacattacttaaccagagccgagccttctcccggagtgaagagagtttgcagatgcgtcagtttctttcctcttttaaaaaaattatgtacatatatggggaatgggaggccaagggagggagagcattaggacaaatacctaatgcatgcggggttcaaaacctaggtaacaggttgataggtgcagcaaaccaccatggcacatgtataactatgtaacaaacctgcatgttctgcacatgtatcccagaacttaaagccaaaacaaaatgtacatatatctgagcatgtataaacacatatgcatatacatttatatatttatgtaaatatatatacatgtattatacatttctgtgtgttttaaactgtacgttgaaaactgcttggtggtgacctttgtgtacaaggatagagggaagaatgcttgcttttcattttgtgtgtttctattctgtttgaatttccctacagtgtgcttgtattccttttatttgttaaataaaatttattttttagagtggttatagatttacagcaaaattaagtggaaaccacagagtttccctgtccccctgcccccacacttgcaccccccgccattagcactcccaccacagtggtatattgttacaatcagggaagcaacatcgatccacctattcattctttcctcccctgacctctggcaactactcatctttttgctgtcacca

SEQ ID NO: 201389 - DNA, 607 bp, Homo sapiens
caggtttattgaggcgtaatttacacaaagtaaaatcttactttttcatgtataatatgatgggttttgacaaatgcacacggctgtgtaagcactgccacactaaagatacagagcagctctatcactccttcaaaactccctcatgccctataaagtcagcctttgagaaaggaagccacaggagggttgccagcagagaagtgatgtgatcttactttacttaaaaaggatcacgctggttgctagttggagaataaactggaaggagcaagggtagaattaggaagttggaatacaagaaaatgatacagtggcttggaataaagttagtagaggtagcggcggtgaaaagttcataataaaaactttataaacttggctgagtgtggtggctcatgcctgtaatttggaaggctcagaaaggggaagtgatctcgcctacaatcccattataaactaatgggaactccagaactcctaacttgttctttttgagatagagtttcactctgtagctcaggctgcagtgaactaagacatgtgccactgtatctccagcctgggtgacacagctagaccctctcagaaaatttggaattaaata

SEQ ID NO: 201390 - DNA, 379 bp, Homo sapiens
cttggttttatgtctgtcagctacgctaagaaaaatagtagctcgggtgaaatgaaggacattagaagtccatagtcatgacatacacaacttctgctttgtaggctcagtaaaaccacttgaacaaaaaatctccggagaggagaagcgcctctctgtttattgtgatctcccctatttttggaacacaggcacacagtaggcactcaataaccacgcactgtgtgaacgaatgtgtcatagtcagtatgctggtgctctcaatgggtatgagttagtagtggtactcagaagccaggattctcacagaatgaagaactttctgctcaactgaggtgttcacatttgggctattttagtctcttctcgaaccaagcaa

SEQ ID NO: 201391 - DNA, 676 bp, Homo sapiens
cacacacacacacacacacacacacacacacacgccagtcttatcataagcctggcagagcagctcaggatggaaaaatttcataattgagatggatggaggaggtgccactaaaactggtggaaaacaagccccacctgcccccactctacgtgatgacacctttccaggagccctcagatccctccctgcttttgtccccccttgatctgcccttcttgtccccaagtactgtcaaggacctaggagatccccttgggagcactggagtttggtgacatacagaaagcccattccaccaagagtcgagatggtgccccaccagccctcaaccctggccagctacaaacatctggaggcaggaaattcacccagtgaccagaatcttggaggaggtacatgagtcttaaatggagctcccaatactactccaacttctacccagccccagcaggtcctcggggaccctccatgctccccaaaccaaacgattcctccatctctccatctctgggtgcaggaggcgtggcttgaagagacgttaagaaaaaaaatcctggaataggtacaggttaatgggcatctccagttagccctgcacagtgggatcagaaagaccactaagacccaagcaagggaggcaaacatgtacaaactgagctgcaactcatgttag

SEQ ID NO: 201392 - DNA, 551 bp, Homo sapiens
aatatacctaaacaaggatacacatctcagcgttgtttataagagtagaaaactgcacccagcataaatcagaaagatgggtaaaccatggtgtgttcatacaacagaacactgtacggcacttaaaatgaggtgaagtagacgtctaagaatcagatggagaggtctcaagaaatgaaaggggataaacaggatatacagagtatgacacctataatgtaattttaaaaaacacagaaatcaatacaatagtttatgaatacaagatgagtataaaaacataaatagaaggattcacagaaaagtcatgaaagccactgtctctaaggagagagaaagaggagtatgactcaggaggggaacccagagggtttcaaatttatgtgtcatattgtttctattataaaactatgggaaactaaaaaaagacaaaggattgacatgtgttactaattctaggcagtgagcatgcttatgtgtttctattattctctgtgctttttaattaaaaaaaataaaaaaatacataaactgagaacaacaaaaatgaa

SEQ ID NO: 201393 - DNA, 417 bp, Homo sapiens
atgaggaaagcctcttctgaaagacatcgactcagaagcagggtctccagatggaagtatcacatggccagggtgatcctcactttgcctctgaagtctgttcttgtggttggcaggtggaagatgccctctccccctttacctacatctttcataactttccaagattcgtttccatcttgaatgggggtgggaggagaaggaggataaagaatcagatgagctgaaggacagacacagaaaaagaaaatcaggtaatcactgaaaggcagaaacccagaaaaagactacatcagcccaggtgacaagtccaccaagtcactcctcctataccagctgcccctcaaaaagattctgctgatttcaaagttacatttgccatgtcttcagagcctttcaaaggtgtaaaaagaaaaa

SEQ ID NO: 201394 - DNA, 302 bp, Homo sapiens
tagcttgctcaccagaggaatagttttctagattttttgggtcagttttggcaggaagccatacataggccagtagctacatatttagacaaatatactccacattttacctggtttgtggcaatggttttttcccatctaaattctaccttttattgctttatacccgtggctgcccactgttataaacatgcatcattattctctagaaaaactaaaatgaaaaaaattattaatagtttctatgggaaatcagaggaaacaacaaatgctataagatcaaaaaaaaaaaaaaaaaaaaa

SEQ ID NO: 201395 - DNA, 483 bp, Homo sapiens
aggactttgtcttttccataagggatccccagtgcctaaaatagtgtttggcatagaacaggtgttccataaagaaagttggatgaataagtaaaaaattatgatcattctatgcaataaatgatcaaaaggaacaaagcaaagataaaaagtaaggtaggaaactagacaaagacataagaaaactacagaccaatgtatctcatacactgaagtaaaacaccctcatgaaaatattagcaaactgaggcccggcgttgtggctcacacctgtagtctcagcactttgggaggccaaggtgggtgaatcacttgaggccaggagttagagaccagcctgggcaacatggcaaaaccccatcttgtcctaaaaatacaaaaattagccgggcgtggtggtgtgcgtctgtaatcccagctactcgggaagctgaggaaggagatcacttgaatctgggaggtggagggtgcagtaagctgaga

SEQ ID NO: 201396 - DNA, 374 bp, Homo sapiens
attaattcgttaatttcagcagatggaaggggagatcggatgaacggtggcagaacagagcgctttgggcaatggaagaaggggaaataggtgggggccgtttaggttttttaagggctgtcagaaactcaatctgtgagctgtcagcagcccggacccgtctccaccccctccactccgcagactgcgggaagtgactggcggattcatatggaggcttgtcaaccgtctttaaacatcaagccagcgggtaaaccgagcccagtgtaaattaattcttgtcttacggcccccctttctctgtccccatgaatatttcatggcgggcagcataaatattaattctaatagctctgcacagtggttattatttc

SEQ ID NO: 201397 - DNA, 645 bp, Homo sapiens
agatttgtacacgcttaaagagataggggtagtgtaactgaatttaacagtagttttggagaagaataaatcacaagttcaggtttgaggaaaagctagagaagagtctgtagttctgggagtacagtctccctggtaacactaagttttaagactttttctttttaagcctttttctttttgcacaaaccagaaggacagaataaatcatctttcttcaaattctgagagcaaagctctgagcaatcagtgaattctgagggtcacagcaggccactgctcagatggctaacactgagagccttctaaggactagaagtccaaaatacctttccaaaatctgaaagccaaaaagaaattactaccttgagattaaattcaaatatcagaaccagaagtggccaccacccagcaagtagagctcataaaacctaaggcatgcacagattcacaaaaggcccaggaggaaggatcaaaggttcattccccctacaatctggagcaaggcaaggatgcccgctctcaccactccttctcaatatagtactggaagtcctagccagagcaatcaggcaagagaaagaaataaacccatccaaattggaaaacaggaagtcaaattatctctgttggctgacaatataa

SEQ ID NO: 201398 - DNA, 176 bp, Homo sapiens
caatcctcccaccttggcctcccaaagaggttagattacaggtgtcagccaccacactgggccctggcttttgtttaaaatcgaaggttaagttgttaaatgataatgaatagataggattgtgttggattgacatttaaaaatatgtattttataagccatacatttagtcgtct

SEQ ID NO: 201399 - DNA, 381 bp, Homo sapiens
cctgggaaacatagtaaaaccttgtctctaccaaaaaaaaattttaaaattagccaggcatggtgacatgcgcccagctactttgggaggctgaggtgggaggatcactagagcccaggaggctgaggctgcagtgagctgtggttacaccattgcactccagcttgggcaacagagcaaggccctgtctccaaaacaaacaaaaaacccaaaacttgtaagtagccagatagggggaaaacacctatcaagaagcaaagataagaattaacatctgacttctcagaaaccgggtatgggccagtatggtgactcacgtatgtaatcctagcactttgagatgcaaacaagaagtgagtcaagtgaaatatttaaacagct

SEQ ID NO: 201400 - DNA, 397 bp, Homo sapiens
ctcgagctctgtacccatgcatgctgggtgtggtgatgtgtgcctgtagtcccaactattcctgtggctgaggtgggaggattgtttgagcccaggagtctggggctgcagtgagccatgatcatgccactgcactccagcctgggtgacagaaagagacactatttcaaaaaacacaacacaaaaaaaacaaaaaagtttggccgcaatggctttttagagacaccacatctaaaaaaaaacaagaaaaagaagggcagggcatggtggttgacacctgtaatcctagcactttgggaggctgagtctggaggatcattctgaggtcaggagttctagaccagcctggccaacatggtgaaaccctgtctctactaaaaatacaaaaattagctgg

SEQ ID NO: 201401 - DNA, 680 bp, Homo sapiens
gactagaggaaggctgaacgtgtgtcctttaaacacggggtccagacccggcgtattttgggcgtttccaggctctctcgccagagtggccttgagtttgggggtcttttccagcctcgctagctttttcctccgtgcaattaaaattatggctcttcttccactcccgtaatcattgcacctctaccctgcagacctcctccggggtgttcagcgcggaggtgggtgttggtgtgcagcaagccgcgcccccgcagccctcctcacccaggcgaggggcggggacgagaaagtagcagcagcgccccccagtctttcctctgaagcttccgaacagtctgcttcagggagcgcagcctgaggcggtgtggtgcggtgcggctgcagggcgggcgagtccccggagctgccctcagcgctgcacagtttccagcgagcggaccccggcagatgaggtctgccgagccgggtggctcgaccaaggagtgggtgtgggtgggtctttcggggctcccggcgacccgcggtgccgacgcaacgccgacgtatggtgccaagcgaactttaaaaagctgcttcggacaaaccagagccaggatttccactgtcggggacccgggatcggaagggtctagcccgagggaaatgctggaagatcccatcggccagtgaccagcaac

SEQ ID NO: 201402 - DNA, 485 bp, Homo sapiens
caatagcaaattaggaattgacaggaacatagctaatctgttaataatatctgatccagagaatggatcagatattacagtgcatatctgatccattctgtggttttgtagacctgtgaattaagaatggcctttacatgtttaaatgcttttaaaaagtcaaaaggatacgacttgtgaaaaatatggaattggagcaaagctatgctcatttgtttatgtattgtatgggctgcttttgcactacactggcagaattgagttgttgagacagtgactatatgtggcacacttgtgaccaaatgtggcacacttcactttacactgctgtttggtccactgcaaattgcaataatacagttacaactcaacagcattttgagtgccatgaatatagctgtactatgacatttagttctattaactttttaattactagtgagtacatatcatgtcaaataataaaagaagagaaacaaaaaaac

SEQ ID NO: 201403 - DNA, 566 bp, Homo sapiens
taacgcaagaagacttgtgagttaagtcagtagtgggagttggtataagtcttgtttaggctttcgtctcttccaactagtatttgaatatctacagtgtgtgtagaatggtgttaagcattcattcattcataacttcattcaacatatgttggcatgcctgccatgtgctagtgtaattactggtgcaattactatgtaagtgcacagagtagtgaataagaaccaagaccactacctccatagatcttctgttctctggaggatttaacaaaattaagcatgcaagtaaacaggggtgtgtgctctaaaagaacaagaagcaaagaatatgatgatggtggcatattctgctatgaagaatatggcgaaaggtccggctgcatattctacgttaaagcctaatacaagttctgactctccttctgtaaggtcgaacggggctcggtaggtttctgctagggttgagaataatcatattatggctaggggtcaggatgtaaagattcttccaatgtactcttagtgtagtgattaaggtggatagagtatatgatccatttatt

SEQ ID NO: 201404 - DNA, 483 bp, Homo sapiens
catgtccatatttcataatgtccccaacagaacttattcctgaaggagaggaaatgcatcctgcaaaaacaaaatcaaaactcattaagtgaagcagttaggtcaccgaagagtaacttttatcattttaacacaacatgataaaagtaagtagctcttagctggctaagacacagagaattctccattattcaaaataaggaagacttatcaacacagtatgtattccatggcaaacaaggttttccctttcttctcaaattctaaacacagtaatcacataactgctaacggctgctgttttacagaaatctccaagaaaaaaagacacaaatgcaagtcggccctgaaggagcacattctttcgcagaagcctctcggctgctgatcctctgggggatccagcaccttgtaggaggaaggcaggcagggaaaggatggatagcagtggactctgacagacatgcacttggctccaccctt

SEQ ID NO: 201405 - DNA, 288 bp, Homo sapiens
aatagtaacaaccaagtgccaaacaaactaaagtggcctaaccactttacatgggtctacgtgtgtgatccttatcgtaagaacaattcacagtatcacattttcacagatgaggacactgaggccctaagaggttaattcataggcaaaggtcacaaagctatcaagaggtgggacaagacccatgagcccttgaaactgcactcaaaagcacctttccctgaaacatgattcaaaaggcatccaggaatataaatcatgcattagccacattgcctgcctctatgt

SEQ ID NO: 201406 - DNA, 622 bp, Homo sapiens
gggattacaggtgtgagctgccatgcctggccccttcttgctattttgaaatatgcaatacattattgttaactctagttatgctaccatgcgttagaacacgagaatttatctatctaactgtagctttgtacttgtggaccaatctctgcctatttctcttccctctgtcctccccagagttctcgtacccctattctattctctacttctgtgagaacagcctttcagattccacatgtggatgaaatcgtgagatatttgtcttactatgcatggcctatttcacttaatgtcttccaggtttatccgtgttgccacaaaagacaggattttattctttttgtggctgaatagtattctatcatgtctccataccacattttcttcatccattcgtctttctgtggacatttaggttgatttcatatcttgcgattgtgagtagtgccacaataaacatagttcagatatctttttcacatgctgatttcatttcctttgggtgtatatccagtagtgggattgctagatcatatggtagttctatttttaattttttgagaaacctccatactgttttcagtaatgactgtactaattaacattcccaccatcatta

SEQ ID NO: 201407 - DNA, 772 bp, Homo sapiens
tttactttacagacattcatatatagcagaggcacacgaacttcttctgtaaagggccagatgataaatatttcatgttgtgggtcatatgctttctgtcacatattctttttctatgtgttgtgttttcattttttaagaacccttttggccgggtgtggtggctcatgcctgtaatcccagcactttgggaggccgaggcaggcggatcacttgaggtcaggagttcgagaccagtctggccaacatggtgaaaccccgtctctactaaaaatagaaaaactagctgggtgtggtggcacctgcccgtaatcccagctgcttgggaggctgaggcaggagaatcacttgaaagcgggagatgaaggttgcagtgagctgagattgcgccactgcactccagcctgggtgacaaaacgagactctgtgtctccaaaaaaaaagaaccctttaaaaaatgtaagggtaatttttggcttgggggctataccaaaacaggtcatgggccagacttgactcatgggctttagtgtgccaacttttatatatagcatgtatataaattagttattgtatctaataggatatgtaattcattcatacaatctgcaagtatatattttgtgctcattgtgtgcttatgctgctctagcactgggatacaacaataaagaaaacaaattcctatcctcagtgagtttacctttaatgtgggagacagataacaaacaagggaagaaatttagagaggggtcagtatttagagaaatac

SEQ ID NO: 201408 - DNA, 736 bp, Homo sapiens
aacccttaatggatgtcgttttatgaagttagaagatagatgtagagacagttatgtctttccattgacattgcatgtctatgctaaatttgctcttctcctctcaaattttatttgccatagtagcttctgacttctatactgacataaatatatataaatagagattttgccttaatcttctttggattattgcccttgggtatattcacatttctatgcagtgtttttgagctgtagaaatgtgtctgagagctatgtaaaacatttttctgtttaaattcaggtataataaaatgtatgaattcagcaagaataagtgaaattgtatacataatacttagcatagtacacaatatgtcaagtaatcaaaaagtaactgccattgcatttgttgttaatctgcatttctcctgagttttgtgatgtaaaatatttcagatttgaaaattaaaatatgtggctagggcagtggctcatgcctgtaatgccagcactttgggaggccgaggcgggtggatcacctgaggttgggagtttgagaccagcctgaccaacatggagaaacaccatctctactaaaaatacaaaaaattagcgagacatggtggcacatgcctgtaatcctagctactcaggagtctgaggtaggagaattgcttgaacccgaaggatgttgtgagccgagatcgcgccattgcactccagcctgggcaaggagcgaaactccgtctca

SEQ ID NO: 201409 - DNA, 1060 bp, Homo sapiens
ccttaaggttaatacttctgcctccagaagtattatgaggtggagccattaggaggtgattaaatcatagacattggagatggagccctcataaatgggattaatacgcttgtaaaagagaccccagagagctagttagccccttctaccatgtgaggatatagtgggaatgcaccgttatgagccagagtgtgaaccttcaccagacattgaacctgtcagtgatttgatctaggacttcccagcctccaaaactgtgagaaatacatttccgttgtttataagccacccagtttatggtgttttgttatagcagcccaaaaagactaagataatgccattgaaggtttcctagaggaagtgaaatctgagctgagctttgaaggatgaataggaggtagaataaataggtagaaagtggatagggaaaggaaatattctatgcagaaggagaaactatggagggaagacacagggaaaggagtatttcaagaactttaaataattgtacataactggagcaagtgagaagacaagtgagaggtaagctgttttgagaataggtgtctgattgtgccagctttgtataccattataaggaacttggactttgtcctgaaggtaactgggcaattgttgaggtcaccaccatctactgtctggattaccgaggaaactttctaaatgtcctctccacttccagtcctgctcctctcattcaatctcaacctaataattcagagtagttctgaaatagataattcaacaacaacaaattggcaaataatgtagcctcttaggtgcataagactgtggtggcataaaaagctttaaggagcttttaactgaataggcaaaaaccacatgtgcataccatgaccaatgtgacctttccaagacataaatttaatcgcaccatggcagagccatttaagaagctttgcaatacctttaggagataagatccatactcctaatgtggccatcaaagccttttatgatgtaacctctgatttctcccacactcatcacccaccaccattccttaacttcattcatg

SEQ ID NO: 201410 - DNA, 581 bp, Homo sapiens
aagttaggtagaaattgaaggaggggaatagtggcaaagagggagctatgggagatggggaggggcataggcccacaatctatttgagcccctttcagatctttgtgctcacccctgacctgcacatgtttagggaagattttatagggcatagtggaaagcagtaattggaaggctgaaagagctgagcagagaagatcatcattgcctaatgcagggaaggcagaatttggagttcgaattccaactagacttggcaaaaacctgagggctttgattgaaaccaataaaggctcacacttaaagagttaaagaatgtttcccaggacgaaggcattcaccataggattaaggagggaaccaaaatagactccactatgcttttataaaaacaaaactagctccacaaaatgaaggtaaccaggtagtagtagtatgcctgctagaacaaaaatcaacactctttaggaaaagctaactaaattcagagtctctataatgtattgcatacattgtctgtatataatagaaaattaccatacatatgaataaacatgagaatatgattcttagtcatgagg

SEQ ID NO: 201411 - DNA, 136 bp, Homo sapiens
tggtcttcaacttatttacttagggctctactcatagcttgtgtgatttcaaataaacctagattttattattaaacatacatatgccaaaagtgttatggtcaggaaagctattaaattaattaattaattttgg

SEQ ID NO: 201412 - DNA, 906 bp, Homo sapiens
ctattaaatagagtagtctgcagagcagccctaaggggcagctactgcctagctccgatgaggaaactgaggcccagagaggttaagtaacgtacccagctgctaggaggcagggctgggcttcagaccatggagtctggacccgggacctgggctgacagttgcagcataacaaggattaggtgagatgctacatcagtgaggtgaccacttgtcctgttttgcctggacagtcccagtttacacttgtagtcctagtaaagtgatcagtgacgcttcatttcattcatagattacatggtcaacttatgtattgagtattcaggacaatcctggggacatggtggcactgcctccatgtgagcaatggagggggaggtgacatggccacagagcacccagcctggctcgcctgggggtgcctgggttacccgcagaacggagatgtcctcgttcattaactcattcgctcagcgatccatgggcctgtcacgtgcgccaggcatttgggcgtcatgctgatggctgggcgaggatggggaggactcagacaaaagaagacagccagcaggctctgggaaatgaagtcacatccaagacctgcccttgtgagaaatgtcaagtgttaccgttatcatcatattcccattgctttgtttggcaaattatgacaatatggctgttaactaagcagattctgattacctattgtttgaatgcaaaaaacaaaacaaaaaaagaagcaagaaaaagccttctggctatgtgaccagtatttagaaatttccattcctgaacaggcctcagggcagagccagtccccaggctgtgcggagccactgctgtccctgcaatgccgggtaatcactttgtctttgctgctgcatccatcacgccctgtctctc

SEQ ID NO: 201413 - DNA, 377 bp, Homo sapiens
gagaatctttccccagtcttagtctctccaacacagtaggcaacaccgtcctgtcagtaatccctgactaacaccaccccattccacccctagggggaaaaaaaagacgcacatatgtacgcacatcaaaaagttacagcaacaataaccaaaaaattccttgctttcattttcaacactggctagtaatttttgcctttgggggttggaatcgctcaatatgcatatttctttccaacgtgggagaaaagaatgcacacaagaatgcagcaaagtggagaggatgcgtagaaataatgaaagaagtgtacctagaggtgattatatatggaaagacaacaagtgatctcagagtggcaggtagtgacaaggatgca

SEQ ID NO: 201414 - DNA, 181 bp, Homo sapiens
gtttggagtttagaggtacaactattgctcatgaacctctcagtgtggaaggcctcacttcagtcatacagaataggtaaatatagaaatatgctgagtgttttttatatttaagactttggtgtctggaacatcagtcttcataaaccatgacctcctagattgaagaagcagtggatca

SEQ ID NO: 201415 - DNA, 211 bp, Homo sapiens
tatgataatagtagtagcaaacagatgactagtgtttgtcatgtgccaggcgttttcagagtttccctgtttattaatttcatttaatcctcacaataactgtgtggctgtaagccacatttcgaaccagacacagagagattagataacttgtctgaagccactcagagaaacaatctgactttgagtctagtaaatgtaattgctgtga

SEQ ID NO: 201416 - DNA, 185 bp, Homo sapiens
gttttgtcactattttatgggtaaggaagttgagcttcaaagagagaaaatgatttatccaaaatcacactgctagaaggaaatggaaccaggacacaagcctggtcttgctgaagctaaggcccgtgttctttatgccgtgctaattgttcatcctgtgcagttgtttaaccacagttttcttg

SEQ ID NO: 201417 - DNA, 343 bp, Homo sapiens
ccacagaaacctcagaattaacactgccattatttcttctctccacttcaaacctgttcctcttcctgtgatttctaacttaatgtcatcataagcaaacagttgctcaaactagacatattatctttgacttctcactctcccttacctctagctggtcataaatgtagagattttaacatctaaaaatgtctccaaaatctatccattcccattgtccaacatttctcacctacactctagtctccctgcctctctactctaatgcaatctgcacacgaactgtcaactttctgattattctaccttctatggctctccactgccaatggatgggaggagt

SEQ ID NO: 201418 - DNA, 759 bp, Homo sapiens
taaagcaaacaatggcacggttcttctcccggcccagcctgagcctccgctgagcgaaaggccacagctcccaccggcggaggattttaaaatgatctttgcctgggtcggcctgtgggttcagggaagtgttaccaaccattgcgcgcaggtgggcgcgctcgcctgccttctccgaagcaaacttttcccagcaactgggagcagctacggagacttaaaagatccccgcggggtcgtgggcaccgcacgtgggccctgcagggacctccaccgcgggagattccttgacgtttgacctgtctaatggagtgtggtcttcagccgcccaccgcaggtcctgcgagtcccgggcatgcaagggcccgcagaccacccaaggcaggccttacaggtgcagttgaggtcctttcgaccggggacccccgtatgaccgtcgcctgcttcgctgttgccgtgtggctcaggccttggttttgagcccatctgggtggtgggtggtcacagctgggtttgttcctgacttgaagttgtggaggtgccgggggtgaccccgggttttcaggttttctgagagatgtagggcccgatgaggatttatgaccaatgttcagctatagaagctgataaccacccagagcaataacacttttattttaaacagagactttttctcttaatttctttctgggtagtaaaagaacatgtttcattctttgcataaatactgactctaagcatgaccttgaacgctatatt

SEQ ID NO: 201419 - DNA, 443 bp, Homo sapiens
tgacaataaatacaatagatcaaacagtgattcttaatacctccaaatgcagatgaaatacatcaagcaaatgaagagcaaaactgacacaggcgacaatgattcatttcaatatgtaaaggcctggcagggacttctatataaaagcaagtctttagcagtcagcacaagagtctttgattcactgccactaaacgatgggaagtgccagttttaactctcccaatggtggggagcaggggcttccgtcccattctcctggttcaaactcttacttctacctatgtccagcagtgttggaatgggcagcccaaaataatgtgcacattaattaaatcttcaatagggatgggcgggagggagcctgctgggagcccagattgctttcatcctttctagggaatatgaagagttaagacatttaccaacccagcctctaaaaa

SEQ ID NO: 201420 - DNA, 387 bp, Homo sapiens
cctggtattgactctgttaccaacataaaataaagaacattaatatatgtgtctcaggaaaatagtatgttttcaaaaattaagacattagaaaaatgctaactggaagaaagaaatatctatggttctaaaattctggaaaagttctaaattcaaaaggtctctgatggcagtcttacggtagctttttgaaaaacttagatatccaagtattcttagaataacaagtcaaaagcttgctattctacatcagaggttgaaaaactatggccatctgtttttactggatcactgccacactagtttgtttacacattttttcatactgcaacagcagagatcaatagttgtgtcagagaccacaggactctccaagcccataaggtt

SEQ ID NO: 201421 - DNA, 317 bp, Homo sapiens
atagctggaaaaagaagagccaagatgagcagacaatggatttggatgaaacttggaatttaaagaatagaagaatacataaaatgtattttaatcaatgattccagaagtgaataaaataagaacagatcactatccaaaagaagcaatgagagaaagagactttttattctttttagtttttatttttttaaattttattttaggttcaggagtacatgtgcaggtttgttatataggtaaattgcatgtcacagaggtttggtgtacagattattttgtcacccaggaaataagtatagtacccaataggtagg

SEQ ID NO: 201422 - DNA, 340 bp, Homo sapiens
tctctccctaatcatcagcttttggcatttctattctaagaatccaaatcatgcttatcctcaaactcaaagttcatagaaaagctgtcatattacattgttccagaaacattccacaatgcacattattccctagtttataagtaaaataagtccctgagaaacttttcaggtgagtacctactcagtatttttcataccatagaacacccatatgtacctcaatattatctagtcaatgtagtcacaaatctcacaaaatttaaggattattgattataaataatgaatacaatctttttttaaaaagaggttcatattatgggtaccccagtttgaa

SEQ ID NO: 201423 - DNA, 494 bp, Homo sapiens
agtttttgacatgagaggggacccgaagtgggtaacccatatctgaaggtgggtagtcccaacatgtagctgagtccaggggtttcatgggctcagaatgggggagtgtgtgctgattggtccataagcagtcctggaaaaagcaccatttgactggctataaaagcatcaaggaagttctcactcaggtcatggactctacctggagctggctgcctggttttcaggcttcaggctgtctatggcttgaagatcaggtttcattggggacctgcccctgtctgcctaggaatttgtctgccttctactgctatcaacactttggctcatcagattgttgtaattatgcattcagccttccatagaaagatgttaggccaggtgcaagcggctcacacctgtaatcccagcactttggaaggccaaggcaggcggatcatgagctcaggaggtcgagaccatcctggctaacacggtgaaaccccgtctctact

SEQ ID NO: 201424 - DNA, 443 bp, Homo sapiens
ttctaatggttataaagtcagttgttaaggatattgtaatcgattgatcaagcagtgtgtgttttagctaaggtttatttataacaggatatgatagtaggaaaatgaatccatttctgatgagatttttgcaatttgtccttcactctttagaaaagatcgcaatctcagatataaagtatttctaactttaagtagcttctaaaaagtgatctctagctaggtgtggtggctcacgcctgtaatcccagcactttcggaggctgagacaggtggatcacctgaggtcaggagtttgagaccagcctggcaaacatggtgaaaccctgtgtcgggtgttcttggggggtgttgcttgagcccagaaagtcgagaatgcagtgagccacgatcacgtcactgaactccagcctgatcaacagagcaagaccctgtctcaaaaa

SEQ ID NO: 201425 - DNA, 544 bp, Homo sapiens
ctcctgcctcagcctcctgagtagctgggactacaggcgcccaccaccaggctcagctaattttttgtatttttagtagagatggggtttcacagtgttagccaggatggtctccatctcctgacctcgtgatccgcccaccttggcctcccaaagtgctgggattacaggcgtgagccaccgcgcccagcccaaatctccagtttctaaactggtaagctcaagttgctatgcctcaaggaatttgagagaatatttaatgtaagattcaggacccaatagtaagaattctactcaggacatctgatcttcattgaaacggattctaatccaacttcagtcctcatagcaaggaagtactatttcagaaagtccctagattctcagatgcattggcaagaaccatacactgaagaattcacagaagattttagtcacttgctcactcatccacttgaagtaagaaaaatcaatcactgcatgtttattgttctataataaagcaaatgttagaaataaaagttagaaatgtcaaacacactaa

SEQ ID NO: 201426 - DNA, 492 bp, Homo sapiens
gctgatgaaagaacgataggagcagagagtatcttctgtgatcagcagtttcacagttgcattcaaaataaagaggactaagtctagtatccacaggaggaaataactgttttctggttcaggggccactggtactggcttaagggagttctgctactcctttgagacattttacattctttttttcctttatacaagcataccttgtttttttgcgctttgctttgtcacacctctccgtgggttttttacaaattgaaggtttgtgataaccctgcaatgagcaagtcatcagcgccatttttccagtggtatgtgcccacttcatcatgtctgacattttgataattctcacaatatttcaaatctcttcattatatctgttatggtgatcagtgatctttgatgttactattgtaattgttttggaggcccacgaactgtctgtataagagagcaaacttaataaatgtgtgtattctaactgctaca

SEQ ID NO: 201427 - DNA, 515 bp, Homo sapiens
cctgaactcggctttgcaatgacctgtgtatcatctgctcccacttaggctccgcgatacaggttcaccatctaccacgattcctggctccagcaggacttcaatgttggttgaaagaaccaccaactgaacgctgggaattgtggaaaaggagtggaaaattcccaggtttttactctggatgactgggttagggaaaatacttagaaggaacatatgatttggtaggaaaaagggaaagtccattttggatatgtgggaaatatatcctggaaagatgaaaatgtccagcagacagctggaaatgtggatttgaaatctggaagacagatctggactggggatttgaagagtattattacaggtgacaaatgaagctatgaaagaatcaataacatcacccaggggaaaaaaagagtgaaaatggccagggatatagttgcctagagaacactaatatttttaaagtgcaaagaaagtttctcaagccataaaactaggaatttcccttgaat

SEQ ID NO: 201428 - DNA, 462 bp, Homo sapiens
aaagatgacagtaactcctgtttagttcaggatgttgcttagatccagatgtgtccccagcatagagcctcagtacttcaaagatacagccaacctcaaacttcttttctgtgttaactatatatgatctgtatgggaattccagctggtctctttattgactctgatggtgggagctgttatatatagctttattagcagtagcccaagcgttagagaaaattgagaaataacatgttaatagtttgagtaaggtgcaaaagtgaatccataaacaatgaagtcattcagtgcttagtataaaagaaaaattaggctgggtacggtggctcatgcctctaatcccagcactatgagagtctgaggtgggcagattgcttgagcccaggagttcaagaccagcctgggcaacgtagtgagaccctgtctctagaaaaactttttaaaaatagtttattaatt

SEQ ID NO: 201429 - DNA, 370 bp, Homo sapiens
agaggaagatgtaaatattcagagcaaaatattgcatacctggcccacatgagtcacttatgaggaagagggagttagttctaagaataataattatcttttgggtgagatttaaattcaggtccagagcatctcttagaaaaccatggatacaagcagcttgttaacagcagtatcaggttcttggagtctgtataaaatctggcccatcgattcaaacaaaactggtatgaaatagcatttctcttcatgtctgaggttccagtggtggttggcttccttcttatttcttgccgtgtgtggctgttttcttgccagcctcagattatgcacttacgtgttttccaaaaaatcaaaaccatttccaata

SEQ ID NO: 201430 - DNA, 438 bp, Homo sapiens
catcctccaaaacaactttatcaagttcctgactctgaaagccagcttattgccgactactgagaacgaaccctgcggtctaggaaatttccgtgcttctcacatttgagttatgcgtctttgctttttttcacgtttgttgcagaggctagaacttaataagggatcgcaaagtatgttgattaacgtacggaaaaatatgttgcaaacaatttaatgttttaagcactagaaactagatattttatggtaacataacctctgggaagttcttatacttctcaaggtacaatattcctgagacctcccttgcttgataatcattagacgtattacggattttcagacatacggaagtggatttgtgggagacaggaggggacacccaaacaatagcatctggtgtcacaacaatgcaataaagtcacaagtcttgtt

SEQ ID NO: 201431 - DNA, 401 bp, Homo sapiens
cctcacagacctcctggctcacctcacccccaccttatcacccctctgacctcccctgcgcttactcccttcaagccaaggctcttctttatttttcaattgctgcaggcatattcttgcctcagggcctttgcgtttgctattccctctgtctggaccatgcttatcccagatagccatatggttctttctcttactgcctttagatctttctcaacctcacttcataattacgtcacaccaagctatttaaaaatgccacccacctaacccaccactcctctccataacccccaggcattaagcacgctctattctctttttgtactacatttttctccatagcacttatcaccatagatatgccatatgttttacttatttattcctgtataatctcc

SEQ ID NO: 201432 - DNA, 516 bp, Homo sapiens
tcgtcatctctgtatccccagtgtcttgcataaaatctgcccagggaagatggcccataaatgctggataaattgaacgaatgtataaaagaagcaagcctacctacagtcctctacacaatactcactctctcctccatctttcccaatgttcatcctttttccagagtaacctgaaaaccacacacctaccatgagggcaggagacttatctgttctgttccctattgtatccccagtgcctagaaccctgcctgatgtattgtaggtgctcagtagacatttgttgaccaaatgaatgaattcttcaaacttatcgttcaaaacccacttcctctacccagctctcaccattcccagaggactgtcctccatctactcccctcctcctttctgagggaaaactgctttctgtaaatctctactcatcacaccatcctgtcttttttttttcctttttgatttttttgagacagagtctcactctgttgcccaggctggagtgcagtggcacaa

SEQ ID NO: 201433 - DNA, 642 bp, Homo sapiens
tgaatcacattcgactaaatattgtgctttttaatactcactttaaaaacaaaattaattgggcaaatgttcatatccattttaaaaaactatcctcttaaaactagattgatagtagacattaataggcttgatgttgtttataatattttgctatattttaagagcatgcttttgtatattttctgttttagtgaagcattttaaaaatgcccccctcccacaactgcaggaataaatctaacagattttgaccaaaattactctaattttgaatttcttgaaactgggtatggaaactagacattaaaaaaaatctttatttttaagcacggtttcttggtcagtagcttctgtattacgggagaacacaagaaggggccttcttgacactcaagaaatgctctttttccatctacaaataggaagacaccctttgtggtatttttgttttgtgggccctgaatgaaaacgtattatgatcagttttaaaaattgctgcccctttaatatctgaatatattcgtggctagtgaagcacatgcatctgtcagatcatgggtgagaattcacttttctttttgcgatttctccagccacaaggacaaatttagttttgcagagcagtttgacacctctaga

SEQ ID NO: 201434 - DNA, 502 bp, Homo sapiens
gatagacgtgagtaagagcttcctttaggcagctcccactccagtggaggaaagagcaggacagagggagataactcaggctgggaagagatttctgggagaatgacccttgcactggtcttcgtgtgtttaggtcttctgaatggctttcagtgaagttcagctttctccagaaaggttcaccacgtcagggagggcatacaaggcagagcgcctgataggagctgggagtagtaaggtgggtgtgttcaatattggtagaattttctatatattttaagactctaggtacccattctttttcatttacaggaaacttctccctgtggcttatcttttttttttaactctttttttttttttttttttggagatggagtctcgctctgtcgcccaggctagagtgcagtggtgctttctcggctcactgcaagctccgcctcctgggttcaccccagtctcctgcctcagcctcccaagtagctgggactacaggtgcccg

SEQ ID NO: 201435 - DNA, 345 bp, Homo sapiens
atatatggtattactcaggtagacatttggaagaaatcttttgggagcaatgtcttatttatggcaaagaaaaaaaaataaaggggattctacatccttaagggagatcggtgaaaacctacaatagcaagagtcatgcagggccttgtggtcatgtgcttacagtggcagtgcttagaatacaaactctaaacagaagaggcatatgatggtaaaagaaaaaaatcatgaagaaaaagtaactgtgtaaaagactgacaggtatagggaagtcccttcagacgcaagaacagacaagaaatcaaggatcatgggagttgtagaataaagttgacagtttaaaag

SEQ ID NO: 201436 - DNA, 634 bp, Homo sapiens
tgcagatgctcaggtgtgaagtatatttttggcctgggccctgagtgttgataaaggaagagaaatatgttgaagtaacagtcataattttgtccaagtcagtgtttcctgtgaactttttgataatctttatgactgaatgtaaaattattctctgtcactccttcctgtaccctgattttttttcgcccaacttgttatgctgtatttgaagagaacttcctctgaagaggatccccactgtcttcttctttttcctttacttaacactcatacctagaggcaactaatgatatgggatataaaacatggacctgttttacaaaatcctatcacaacaccatccaaataacaggaatctgtgaaacagtgaaaagaattctctctttattcttaaaggtagtgataacagcacattttttctatagctgtttgtatctatttcaggatgaagacaatatatctttgttaatcctattggaaacaatggtgtgctcttaagtatagcactgacccttttgtgcaaattaatgcatagtaaaatttatccttccaaactgcacaatgatgtgcaacagaaggccatacaagtcttagaaaaattagctggctctggttttatcatcacacgagc

SEQ ID NO: 201437 - DNA, 458 bp, Homo sapiens
gagttgtggtttctgtcttgcacaattatgaaaggtctatttcttaaggaggtacaatttttagtcaagggattgtttgatactctttaagttcactgccaggcctaccacttatctctgtcgtaggaggagagttcctgtaatgagaggtttttaagacgtcctttgttctgggatgaatcagagggaatgactgccttggagctcaggatattaaactgagtggtgtcaaatattcccaggatcaatcgacaatgccatgtgtaccatctcctcctacagggattaaaggcctgatatttagatatgattctagttttctctcaaatccatactttaagagcttatgggctgggtgcggtggctcacacctgtaatcccagcactttgggaagccaaggtgggcagataagttgaggccaggagttcgagaccagcctggccaacatggtgaaacc

SEQ ID NO: 201438 - DNA, 218 bp, Homo sapiens
ccttccacatctcatttctccgaagcgctaggtaatggtaaaaccccatctacaaaaaatacaaaaatcagctgggtgtggtgatgtgcacatgttgtcctagacgcttcggaggctgaggtgggggattgattgcatgagcccaggtgttcaagcctgcagtgagctatgatcaccactgcacttcagcccaggcaacagagtgagaccctatctcc

SEQ ID NO: 201439 - DNA, 520 bp, Homo sapiens
tactttggcttcagtattgtgggacaaaatctttgtagagaaaatcctgaggcttagagaggtgaactaagtttaccaatgtcatacatctaccaagaggtgaagttaggatatgtgtttagaattacgaactctgatttatttggggctgagttcttgagagctctttgaatactaagctaaaaaggttggatttcattctgtaggagtttctgaactgaaagggccatgtcaaagtgataatttaaaaatgaatggataaatgaatctgatagtggtatgtagagtggattagagcaagggggaaaatctgagaagatgatgatatgtgggggtggagaggaatggagtgaggtacctgctaagctatgtcttttttgttttttttgttttgtaaagatgaggtctccctatgttgcttaggctgttcttgaactcctgagctcaagtgagcctcctgccttggcctcccagagtgttgggattataggtgtgagccactgttcctagtctaagctat

SEQ ID NO: 201440 - DNA, 602 bp, Homo sapiens
cagacatgtatggagagaagatcatgcaaagtcacagggagaagacagccatctacaagccaaagtgtgagaagaaacaaaccctgctgacaccttgatcttagacttctagcctccagaactgtgagaaaataaatcactgttgttaagccacccagtctgattcctttttatgacagccctagcataccatacactaggggtacaccttcatcctttagcacatggctatctacttgtccccataccatttgttgaaaagactcttctttctcctttggatggtcttggcatccttgtcaaaaatcagttgaccatggacagttttatttctggactctctattcccttatctgtgtgtctgttcttacaccagtaccacagtcttgattactctagctttgtaataagttttgagataaggaagtgtgcattctccagttttgttcttctctttcaagattgttttggctattccaggtcccttgcattttcatatgaattttaggatcagtttgtcagtttctgccaaaaaggcaataggattttaatagggattgctttgaatctctgtatccatagaggagtagtccatctgaatg

SEQ ID NO: 201441 - DNA, 226 bp, Homo sapiens
aaaatgctgaaagcaaatctatactctctttttattgaatttattactgtaaaattttatggctatagttcagaatctccccatgcaaattctctgtatttatttgcctggtactcatgctaggcccttaatttttttgtgtgttttatatattttttgttgtatagtttatgaagtattcattatgtgagctggtcagagattataataaattttataaaattga

SEQ ID NO: 201442 - DNA, 647 bp, Homo sapiens
tcattgtgtttttatcaactttgttgaagaccagttgcttatagataggtggctttatttcaggttctctattctattccactgatctatgtgtctatttttgaaccagtatcatgctattttggttacatcagccttttagtatactttgaagtcatgtaatgtgatgcctctggctttgttcttttgcttaggattgctttggttatttgcacttttgttttagtccatataaattttagttttatttttgttaattctgtgaaaaatgacaattgataatttaataagaattgtgttgaatctgtatattactttgggcagtatggccattttaatgacattgatccttccaatccatgagcatggggtgtttttttcatttgtgtcatctacgatttattttatcagtgttttctagttctccttgtagagatttttcatctccttgattaaaggtattcctaggtattcaattttttttgtggctattgtgaatgcgattgaattcttggtttggttctcagattgcacgttattggtatatagaaatgctactgatatttgtacattgattttatatccctatcaaatacaggagtataaatgatactggtttcctattatcattctaattctcactgcat

SEQ ID NO: 201443 - DNA, 335 bp, Homo sapiens
aggtggaacctaggaggagcccagcagatttctggaactcaagagatagagctgagagtttgggaaaatcaaggtgactagagttcacaagacacagtactggagcggagagagctacacaaagagagaagcaaggaaaactgcagaggttccctcttgagtattcagaaaagtaccaatctgtgcatgggtgtgatgagactatctgaggccagtgaaagaatcacctaaaggagtcaagggaccagaaccagcactcaaaaagggttagaaatacattagccaaaatggaaaacttcataattcatgaggcattgggtagaatactcaatggt

SEQ ID NO: 201444 - DNA, 498 bp, Homo sapiens
atgaactgtgggaggatataatgactttttttggattaattttggcacagagctagagattttgtatgattctgaggcaagatagtaaaggtgcactctgctgtcttccagattgtagcaaactgcttctggtcctttctgcttttgaaaatttacatagagaaaaacatgttttcttagattaaaagttatatatgagctgctaaggtctacatgtatttgcttcaagaagaatagcacagctaaaaccgtattttcaagtagagcaaccaactgaggaagctaacgtgtaaccactaattctctaagaaccacatgtcttatgcacagactaaactgaatgcttaaatggaattgtctattcatttgtttcacaaatagatattgaatgccgaagtgccaggttctattttagacctgaaacacataaatgaacaaacaaaggttcttgacatcatatagttcatattctaaagaatcttgccctttgcaattttc

SEQ ID NO: 201445 - DNA, 492 bp, Homo sapiens
aaacttttcaaacacacaccaatgctttttctacagaaaaataaaagacacccactcagtcagtttgaacttctatcctttcaaaacccaaatccaagcttctcctaccttcaggaggtatgcccttttctattcagcccccaaggcgcctgctgctcaacaacagttgcacaaaagaataaatcaaggtatcactgtgggcttccttaaatgtatttattttaacctcctctggattgctttatactcatttacacagctgttactgtttgcaaattgcatcatattatattggtctccccatataaacttgggaatatatgtagggaggaagcaagactctcatggaataacctaactgtatctagtacaaagttctgtgcattgtccatactcaataatactgcaagcatttaaggaatcccagtgtgccagtaagggtgtgtgtaacttactttttttttttttttttttgagacggagttttgctct

SEQ ID NO: 201446 - DNA, 163 bp, Homo sapiens
acctacctcataggattgattgttttgaggttaaatgagaaaaatacatatactgagcctggccctgcaaagtgctcaaaaaatagtagctgtaattatgttattaatgttgttattttgctgagtgagtacagcatgaaaagcatgtcttttcccagctgtt

SEQ ID NO: 201447 - DNA, 541 bp, Homo sapiens
caaatatagtaaagcatatctatctcataggctgagagattgaaaatacaaactttgcaggtaaaataagcaaataaaagaagggcttttattttctaagtcgggcacaagcagcaagcccagctgatgcagcccagtggcgcctgtttgggggttgggagtggggggttgtttaaagggaagagttaaaacaaatcccctgggaagtagctggttaccacaagagttaaggatcttgctaaatattcaaagaagagtggccagccaagagaaaaaaagagagtagccaaattgtcaagaagttaattttaaattgatggatgatggcgaaaataccagaaaggtgttattcgacccatttagaaaaatgacaggcagcttcctcctaccttctgagaatgactgcacagtaatgttcacaattcatgacaccacatgagccatcccagtgtgcgaatcttgtagaacatacgaggcacgtgagcagtttgctggagcttgaaccaaatacagaatggggtactgttcctcccgacacaga

SEQ ID NO: 201448 - DNA, 813 bp, Homo sapiens
tcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccgttgtgaaagggtcatttttaatctctgtggtgaggattccgagaatcattgtcatgtacatgcaaaacgcactgaaagaacagcagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaaggtgttagtggtgtgtttcactgtttttggaggactcatggcttttaactacaatcgggcattccaggtgtgggcagtccctctgttat

SEQ ID NO: 201449 - DNA, 253 bp, Homo sapiens
agcaatctcaatgagaatatttataatttattgaatggggactatttcaggctgtgttatatatcatctgttgtcacaacagctcacatttcacatctgggaagatagaggctaagcaaggtctgctctttcactgggcatgtctcttgagtgtctgtgtgtgccaggcactgtgctggtctctagggttacagtggaggctgggatatcaccagctcttccttaatgttgttagccagtgggtagacagaca

SEQ ID NO: 201450 - DNA, 427 bp, Homo sapiens
caagatgctgagaaataatcactaactgtttgaaaataatcaaaggcagattttctataggaattaatatttaggttgagttttgaagaatgagttaaaagtatactgaaagaatgaagtagagaagagcagtaggaatagcctatgcacaggtgtataaagaaagcacacctctggggaaaaacaagttgttaggcataattgtaatacaaggaagatggaaggtagctgtaggggtaaaactggaaaggaaaagggtcagatctgtaagctttgtatttccaccaacgtgagaaacttggctatcttggaggtgatcttctagaccaccttctccagctcatccatgtcacctttacgcgtcttgtagtgcttctgagcattctgcagagacttcttggctgcttccagcttcttgattttgtgg

SEQ ID NO: 201451 - DNA, 440 bp, Homo sapiens
tcctgggattacaggtgtgagccactgtgcccggccccatgtgataagttttagtagattctgctaaagttttgcaaattggttttacaaatttacactcccaccagcagtgtgtaagagctccagttgcttctcatctttgctaacacttggtattgtcagtctttttatttttagttattctggaagggtgtgtagtgatattgtagtgtagttttaattcatattttcctgatacttaatgaagttgagcattttttcttgttagggaccccatgtttattggccattggatttctgcttttgtgaagtgtctgttaaatcttttgccctttttttctactgggctgtttatttttttcatattgacttctagttcttattctggctacatttctttgttaggtacatattgcatctatcttctgcccttttagaat

SEQ ID NO: 201452 - DNA, 291 bp, Homo sapiens
ggctgatagtaccaggctagttctcagatattagggactgcatgcctttttctctcaagtcagctagccagcaacctattaggaaccacttatgcccatacattttatccagtgtggctatgcacataatatatatttccttttccaaaagttatagtgaagcatagttcattctcaactctatttcaaaacatatttaagatggactaaatttttaagtattgaaaaaactaagatttataattgtatctttgtcaaacctctctggagtgatgatttatttcatgtttt

SEQ ID NO: 201453 - DNA, 884 bp, Homo sapiens
attgtgtatgcggtatgttcaatctctgcatggtaagacaggtaattcacttcaatactttcctgaatttttcaaagtttctacaatgatcagggactgctacttttgaaaccagaaatttttaattgatggtccaggcttaagtgtataaagacagttactactcacccacggcaagaaaatgcaaattaaaaagtacattagaatgcaatttttcacctattggatttgtaaaaattcacgttttaatagtttcccacgtgttctcctacatgctcatggaaaggtaaattgatacgctccctctggaaggctatccagctttctgtatcacaattacaaatgatcttctgacccagcaatttctgcttcctacagaaacacttgacccatgcaaaacaaccatgggaaacagtctaaatgtctatcaacaggggtctagttaataatagcccatccatgtttaaaaaatatcctagctatattacaaataacacactagtaacagtgtttagttctatgggagggaggacgactagatggacaaaagtcaccggtatagactttatattactttggcatttcattttttgcatggttcaaaataccatattaaatacaaacgacaaaaatctaccccagtgatttctccacccaagtaccagaaaacaaactgtgggtccctaaatctgtactgtccgggagtcaaaatacctctgccatacataaggtaacaaaatttgaaaagcgagcaccactattttcccctagattcaggggagaggtattctctataggatttccactctgaaattcagagtgccaattaaacatcaaatcagctattcttcaagatgttctataggacagacaagggaaatgac

SEQ ID NO: 201454 - DNA, 207 bp, Homo sapiens
aaatctgccaggcccttgaggatggaaacagagattgatctcaatgaagaacgagtctattggtcctcatgcagagatgcattaacgtctctctgtgctctggaaggggttcacttccccaggtggacctgagcaggctggatgttgcagcctgttcagcggcaggatcgggccctgttcctggaagagatcatgggtaccttgtta

SEQ ID NO: 201455 - DNA, 243 bp, Homo sapiens
cttcatgtggctcatgaatgcatttttttaaaaacatttaatacttaaaactgatggtaaatgaaaattataatgggattccaaagatagaggcattggcccctctttggtctgtgttctctccaaaaatctgacctcacctgaaattcatagaatctgtctctctctctctctctctctctctctcacacacacacacacacacacacacacacacacacactcacacacacacagggcaaa

SEQ ID NO: 201456 - DNA, 463 bp, Homo sapiens
gatctgagagacaagtagatgttagctactcaggcagaaaggagagagaaagagccactagcagaagaagcagtgataagtagggccccaaggctggagggagaaggactatttggaaagtccaggtggctacaagccaggagaaggataggcatggccagatggtacaaggccttgaggtggtgtgaacactaactttctcctgtgtataggaaaaccactggaaggttttaagcagagatgagaggtgctgagatctatgtttttaaaaggtcctgttgacccagcaattcttcttctaagtatatacccctttgggcgatggtttcttccagactaattgtctttccacccatagcgcaacttaacaagggatgacagtgacagccagcatcacacagtgctgtgtgattggggaagcctctcccttgtaaccatctcactccatcctcacctccacctt

SEQ ID NO: 201457 - DNA, 222 bp, Homo sapiens
agggagagagtgaggtagggagggagggagggaggggaagggaggaaaggaaaggaggaaggacagatcctagaatccagataatataaaggtaccaagatgccaagtgtcaatgtcttcatctacaaaaatggaaaaacagagctcgcctcttcgagttgttacagactaaatgcaatagtgaatgagagctcctagcacacaggaagcccacctgccagc

SEQ ID NO: 201458 - DNA, 144 bp, Homo sapiens
gaggcatggggggtggaggtgggagaggtgtgaatgggggtgagagaagtctctgaggaaatgtcattcgagcggaatcactctgagcttggcaaggttaccctgtcttactgacgggaaacctagaccagagaggccaggaag

SEQ ID NO: 201459 - DNA, 196 bp, Homo sapiens
tcactgatagtggatcaccattacagatataataataatgaagaagtttgagaaattgtgagaattaccaaaatgtgacacagagacacaaatgagcacaagctattggaaaaatagcaccaatagactcgtttgatgtatgattgcctgccacaaaccttcaatttgtggaatatgcaatatctgtgaaatgcaa

SEQ ID NO: 201460 - DNA, 228 bp, Homo sapiens
gtcgcatcagcctactgccgagcataacacacaagggcaaagaagacgggggtctgggattggagggcttcttaaaattctgacactagaccaactttccaagttgttaaagcctgcagaccccagatgtaatctgtcagtgtgagaggagttaaatgtcagctccaatatctacattataataattgatacatattacctaataatcaatatattgtgatgttatat

SEQ ID NO: 201461 - DNA, 304 bp, Homo sapiens
tgagaagcccccatgcaggtcggggcaaaggagagggctttatctgccttgagggcagcgctccctaagtgaagcaggcctaccccagaagcacagggacttggctggcgcctgaacttcctgtgcgaagcagcacctgctcttggagccccttagcctgctggtgcacacctggtttccaagtcctgcctggggacttgctaggtgggggacggacctggaacaggaccctaagcccaccccctccgcatacctggcggtccagggctccccgcccagtggagccagcacaggctagccaggc

SEQ ID NO: 201462 - DNA, 383 bp, Homo sapiens
cggatcacttgaggtcagtagtttgagaccagcctggctaacatggtgaaacatcgtctccactaaaaatacaaaaattagctgggtgtgttggtgtatgcctatagtcccagctgcttaggagaatgaggtgggagaatcacttgaaccctggaggttgaagttgtggtgagcccagatcacaccactgcactccagcctgggtgacagaacaagactctgtctcaaaacaaaatacaataataaaaaataaaaacaaactctttcatacactggcatctactttcctttctagcctcacctccaccagttttttttttttttttttagtaacctacatcccagcccaaaaagtctgtgttttccttaataccttgtgcttt

SEQ ID NO: 201463 - DNA, 674 bp, Homo sapiens
  misc_feature (166)..(166): n is a, c, g, or t
ctcacaatagcaaagacatggaatcaacccaaatgcccatcaatgatagactggataaagaaaatgtggtacatacacaccatggaatactatacagccatgaaaaggaatgagatcctatcctttgcagggacatagaaggagctggaggccattatcctcagcnaactaatgcaggaacagaaaaccagataccacatgttcttacatttaagtgggagctaaataatgagaacacatggacacatagaggggaacaccacacactggggcctatcagagggtggtgggtgggaggagggagaggatcaggaaaaatagaggtgtatctgtcaccagagttgcctcccttcctttttctgtatttcctttagtgagggatgatggtgggtgtggcaccagcagtcctaaagagctgctttgagatcacacttgtctgagacacctgtgccttttcaatatagagtcagctactgtagacagctaacaaaagatgaactaaaactcaattcagaaaaaaacaaaacagcattctcagagtaaaaatattagacctggaagcaaccttagaaatcatcatgctttagcagtggattttagaaataggaaactttttattaggtgagatgatttgcctgggattatgcagtagcaaaagcatttaagaatctgga

SEQ ID NO: 201464 - DNA, 424 bp, Homo sapiens
cagaatttgtttcttatgttcaggtttgctaagcattaagcttaaatatcttacacagtcatgtagctgcctgatgaggtttcagtcaatgattgactgcattatatgacagtggtcccataacagctgaaaaattcctatcacttagtgctttgtgttacaaatacctactgtattcaacacagtaacatgctgtacaggtttatagcctaagagcaataggctatatcacatagattactatgtagttgactatactatctaggtttgtgtaagtactgtacactctatgatgtttgcacaatgacaaaactgcctgatgcatttctcagaatccatcccagttgttaagcaacacaggagttaattccttcacaggatcatgtgtgaccttcagacaatgctcaagtgacagcaaaggcac

SEQ ID NO: 201465 - DNA, 673 bp, Homo sapiens
agaaaaattagccaggtgtagtggcacacgcctgtaattccagctacttgggaggctgaggcacgagaatagcttgaacccgggaggcggaggttgcagtgagccgagatcgcacccctgcactccagcctaggcgacagcgtgagacgcggtcttcaaaaacaaaacaaaacacaagggcaaaccaagaataggaagacacggattcatagcccaaggggtctgccagggaaaggaacaaagataattcccaggatgacaggaaagtgaagtcccaggaaattaatctaagaaacaggccacagaagctctgggataagtaagtatagactatatgtttgggtagaataatgtattgagaagttgctgaagaaatagaatagtacatagaaacaaagcaaatagaggtgtggaggaattgataataaatcattaaaaatgaaaacttaaatgttggaaactcctgtttctgggaagatgaagtagacattcttttccctgttcttctagttaagtgcatctaaaatctaaaatccttggacactatatgcaataacgtaagaacactctgaaaggtaaagagaacgcagaccacccaggacccagaaaatgacccagtagtgatttcttcaggttgtctttttgcctcatgtagcccagactatgagccgaa

SEQ ID NO: 201466 - DNA, 709 bp, Homo sapiens
ggacaactttcaacctaaaggcagagctcaagacaaatacacaaacatgaataaacagcaacaatgcagaaaataggggaagaaatgtaaaagtatataatattttcagaaagataagaggaaatattgttgcagtgagccgagatcgcacccctgcactccagcctaggcgacagcgtgagacgcggtcttcaaaaacaaaacaaaacacaagggcaaaccaagaataggaagacacggattcatagcccaaggggtctgccagggaaaggaacaaagataattcccaggatgacaggaaagtgaagtcccaggaaattaatctaagaaacaggccacagaagctctgggataagtaagtatagactatatgtttgggtagaataatgtattgagaagttgctgaagaaatagaatagtacatagaaacaaagcaaatagaggtgtggaggaattgataataaatcattaaaaatgaaaacttaaatgttggaaactcctgtttctgggaagatgaagtagacattcttttccctgttcttctagttaagtgcatctaaaatctaaaatccttggacactatatgcaataacgtaagaacactctgaaaggtaaagagaacgcagaccacccaggacccagaaaatgacccagtagtgatttcttcaggttgtctttttgcctcatgtagcccagactatgagccgaa

SEQ ID NO: 201467 - DNA, 865 bp, Homo sapiens
atggggataataacacacccagcactgaaagcaacacaggatgattcatggccaggggttagcacagcagctagcaccaggcgacagccccatgaaggccagctgttgttatttttagaggagaggatctattttcatccaatgggtcctgggatatgaccaattggtttgtgccgtagtttaggaaaggtcagtgaaagtgcagtgtgagcaacgtgtgtgtgtgtacatgtgtgtatatgtatgcatgtgtatacatgtgcacatgcacacatgtacatgcatgtgtgtgcatgtatgtgtgtgtgcgtgtgcacatgcaggttgagacgcagggcctgacttccctggtgctgatggggaagaaagataaggaagcaaaacagtgggctttggcaggctgaggcctccccctggtttcacatttgctctcaagcctttggtgagactgacatctggctgcaaatagggtgtgccttccagcacctccgtgggtccagactccatccacaggggcctgggcacccatcagaatgcccaggacacctgtctctccggtggaggcctctggggcagaggggatgcttgagaggtcacatggaagggggtttcctctccaggtgctggaagatcgtctcttctcaggacagatgctaacttcacacaggaggggagtgggggcctgtatttaagctgagaacagaacaggcccagtgtgtggctgttgcctgggatgatttgtttaaaatattaacaatcaaggcaagagggttgtttgaggcctggagtttgagaccagcctgggcaacatagtgagacctcatctctacaaaaaataaatataaaatacaaagtagcttggcat

SEQ ID NO: 201468 - DNA, 368 bp, Homo sapiens
tagactctgggggaggggaggccaggagagagggagggaccttctgaatgggaaacagcccaagacgagcgcctgcagttgtggttggccagttctccaccaccttcttatcaaaggaaaactctgttctacctttattttcatttcctcaggtagctctgattttgatagaatttattctattttaaagtcacataggtcttcatttagaggaaagtgtatttggagtctaataatctttacacacacacttttctgaaccacttgagagtaagttgcagacatcataccctcttatttgtaaatacttccgtgtgtatttcctatgaataagacattctcttataaaaccgcagttgaaagacgca

SEQ ID NO: 201469 - DNA, 329 bp, Homo sapiens
ttgaaattttgctgattacttaaatgttaacttttctggatttaaagaaactgttttgttttgtttttattttaagctatctatttgttacagcaatttggtcaaatatacattggtaaatagaatgaaaatatttattcttctccccatctgatatctccaaaatttggaaattatttgtgagtattctcatttttatggcaatgtagttattcacataagttcaataagaaaatattctctttgtaataggatacaaggggaaacacttcttaacttacaaatgcttgactggaatgacatattttaaaatatgaccagacaacttt

SEQ ID NO: 201470 - DNA, 333 bp, Homo sapiens
tgaagaagatcagtatgtaaagagcaactgaaattaaggaaacaattccatttacaacagaatctaaaagaaaaaagtcttgggaatacatttaataaaagaaaagcaatcacactaaaaacaacaaaacatagttaaaagaacttaaagaaagctaaataaatggcaagacaatccatgttcactgatcagatttatattgttaagatggtaatactctctagatcttatctacatattcagtgcagtccttactgaaattcaagctacatttattattttttgcagaaatttataagccaattctaaaattatatgaaacataagatgaca

SEQ ID NO: 201471 - DNA, 251 bp, Homo sapiens
ccaagatcttcaactggccttcctggtttcttacaaagggatcattctgaaggtgaagaagggaggtgtttggtgcaccaacacacacaagcaagaatgaagtggagcccataggtcaacatgcctggtcacctgggctgcttcatctgggagaggatctcctcccagttctccccatcctggctggcacacacagtctttaaaagcagcttgctccagggatatgttcatccttggcagagaccttcctc

SEQ ID NO: 201472 - DNA, 214 bp, Homo sapiens
aagccaaaaagagaacaaagcagagactccctcttagtaacaaatgagttaaacagtgatagctgcactctgaaatttgttcactgtgcttttttttttcccaagtcgaggaagaaaactacatttacaggtgtaagtggtagaggagataaagttagtattcagcatctctggttgaattccgaaaatatttgttcagttgtgggcgctcagt

SEQ ID NO: 201473 - DNA, 711 bp, Homo sapiens
ttcactaacctttctcctgtggtcacatctccctctgaccacaggcaggaaatgtcctctgctggcaagaactcaagtcattacattggatccatccagataatccaggataattgctcccatgtcaaggtctttaactccatctcacctgcaatgtcccttttatcatgcaagctaacatattcatggagcagagacatctctgggaggtcattattctggctaccatgtaagccaaatagtcttcagagtgaccatatgactttaagcttcataatgggaaatattaactatagaactgagcactggatgcattgtcattgatgatatgctgaagagttctgggcatttcaattttttcatgttttaaagaactttttaaaatctgtgacatggcaaaattacttaaattatcttttgaagctcctagaggatgcctaatatcatttcttttccttttaaattaagggtgaaatagattgctgtggttgatgagaaaagaattcagtggcactcatttccttgggattatttgtcatttagtctgatttatcttccaagttcagtcagaagcttggcaatctgaaaatcgcattatagacatctcctgattgcagggtgattaagtggaagaaacttttaagcttgactgtaggaagtttttcagttataagttaaacataggaacaatcaattggaaaactacttagc

SEQ ID NO: 201474 - DNA, 865 bp, Homo sapiens
caccgcgcccggcatcattatgcgattctgtgatcaatgtctctatccctagttttatttcgggaaggcccgggattggtctgtctttcctattcttcacctcttttcttctagcaaagacccttacctgagcagatacctaataaatgcatgttaaataaacaccaaagagcattagatgtgaattttcttgataataatgatgacagagtaaggaagtgcatagttccaggtataaatactgaagtcttatcatgatgttgtaggtttgtcttttgaggccaaagatttctcacttcctctgtccttcctgttagataaaacatccctgtgtttgactttcataaataaataacttcaataaaatgcagttgtaaaataaacaataataggaactgccacaggactctgagatacgatatttcattaggttatccgagcaaaaaatattttcaagaggggaaaagccaatatataacattggagaactgatgaccacatcatccgttgtcacatttaatcatcacgacagccctatacaggtgggattgttattattctcattttacagatgggaaaactgagtctcatgaggttaggtcacttgccctacatcacccagttaggcagtatcaaggcggaatttggagcaggccgggtgacttcactgggccctgtcccgagcaccccgtgcttaggtgacctacatgcttggcagaaagagctgcccctaccaggtatggccaggccaggtgtggtggctcatgtctgtaatctcagccctttgggaggccaaggcaggaggattgcttgaggacaggagttcaagatcagcttgggcactatctctacaaaaagtttcttt

SEQ ID NO: 201475 - DNA, 703 bp, Homo sapiens
tgcgatgctttgccacactgcaaaatgattaaatcaagctgacacacacgtccgtcatctcacatacttatgcttttgtagtgagaacatggaagatctaatcttagcaattttccagtatacaatacagtttttaactgtagactccatgttgtacgatacatctccagagttcattcttatagatttcactcaaaggccagtagcttcctcctgagaggtgagtgcatcatgtcatggcttctgacaggcccccgggtcctctcccagcccagcatccccaaccctctcccaacatctcgcgaccctgtgctttggtgttgagggagcagtggcagtcaggagggactgagcacctgtgctgggcggccagggccaggctcttttgctggtgctgccagagacgcctcaggtcacccaagagtctcaggttcctctccttcctccagaggcggggctggaaatgctgctggctctgctcacactccagggctgggttgaggttggtgttgggagataatgcatgtcagtgttgttttcttcatctgtgaaaaagcagtaacatacacacaacctaaaatttatcatcttgacctttttttttttttttttgagagtcttgctgtgtcgccaggctggagtgcagtgtggcgtgatctcagctcactgaaacctccaactccctggttcaagcgattctcct

SEQ ID NO: 201476 - DNA, 823 bp, Homo sapiens
ggtggcaggaaagagagcatgtgaaagaggaactgtcaaacattataaaaccatcagatctcatgagaactcactcattatcaggagaacaatatgggggaaaccacccccatgatccagtcacctcccaccacatccctccctctacatatggggattatggggattacaattcgagatgagatttgggtgggacacagagccaatccatatcaccatctgacataggtgtgtggtgttcttgtttggtagagatgcgggtcttgctaattgccctggttggtcttgaactcctaggctcaagcaatccttctaccttagcctcccaaagtgctgggactacaggtatgagtcatcatgctcagcctagatggatttttttttttaatctatcttccagtagaatgtaagcctcatagccgtagggactttttccttttaactactatgatctccccagcacctagcacatgaggcactcagtaaatatgtattgaatttgttgataaatttttagtctgttaggcaagaaaagaacttggctatttgcatctttactctgatccctctttagtttttaattatatcattttatcagttgtgtttaaggcattacctgatcatcctgtatacaatttcaaattgttcccttactccctcttacttttccctgctttacttttcttcatagcacctatcttccaacatagcacataattttcttaagcattccccaattagaatataaactacatgaagagtttacagtatttttgtatatttgggttattgttttatccgcagtatctacggtagggccact

SEQ ID NO: 201477 - DNA, 600 bp, Homo sapiens
aactttgttattcttttttctttttattggagacagcgtctcgctctgtcacccaggctggagtgcagtcgcataatcttggctcactgcaacctccacctcccggggtcaagcgattcttcctcctcaccctcccgagtagctgaggagggaggatcagttgaacccaggaggtgttctcaactctggcacatgcttgtagctgaattattgatgatgcctttgatttgttttcttgggattcattgtgccctagtgtctcctgtatgtgccgtccctcatgccttcaactttctttgctcaaaatgaaaccaattgatgataaatgaaaggatcagtaggctttaaagcagttatttacaactgagcatttagagttcccacgcttaaaaagtgggagctgttcccatggctgctgagagtgctgcggaagctggttctctttgtccttaagttgatcgatagcaggcatcagcggggaagatgctttgtactttgcttgttaaacaacgggaacccccggttgttccctttgtctccactaaaaaattacaacatatttgcccggtcgtggtgctgggcatctgtggtcccagctgc

SEQ ID NO: 201478 - DNA, 434 bp, Homo sapiens
actgcaacatttgaagcactggcaatgatgactcctttaacactagtttaactcagtggccattgttgttaaactgttcataatttatattcctcagtaatatgacccaatacttcatgttaccttgtgtattatgagtaaggttatataaataaaacagcaagataattctgaaaatttcttgcctcaattctaagggtaaatacagctatgaattactagagatactaagaattactagaataactaatagttactagagatagtaagaatatcttaagtttcataactggttaagatgttttaaaaattaaatataaaattatgatctattggattctaaaggtatagtctgaaaggtcatgtcatttggactatgctttgttagtaaagcaaaaaaaacccctaatattaaacaagaacttaaattttca

SEQ ID NO: 201479 - DNA, 708 bp, Homo sapiens
tgctacatttcatcaggaggatgtactaccatttatatgcccagttcccaagaataaacagttgggtcattaccatgcctttgctaaaaactgctgaaacagactttgcatccacagtctgcacacgtgaacatgtttctagatgtggagttgggggccaaagagtaaatggattttcatctttgacagatttgccctccaaaaaagacaacactagtttccattcccaacaaaactccgtgagcttacctgacagcctttggtaaacagtatctatgtatattaaactcctgatctcagttgctggcacaggtgaaaaatactatctctaggtggttatttgcatctgtgactgagactgggtctctttttaaatcaacacatgccatttctatatttatttcttacggtgtcactgtgttttgcacattattctatttctcagggtcttggcattcttcttactgatttctaaaagtacacactcaatgttaaagaatttatcctttgttatgtgtgttgcaaatatgtcctccctccctggtcctctgtctctggaactcaaatgaagtaattgtttttgccacacagattattttgtataatttttgtgtagtcagtggtcaaacagaccattctttaccatttctaagttttgtgtcttgcttagcaagatcctttccccttcaaaattatcattctttcaaa

SEQ ID NO: 201480 - DNA, 288 bp, Homo sapiens
tttagcgagatgtatatttttggaaaattcgaaacttttcaccgacgccttgccaagataatagacatctttacaaccctcaagacgtattcagtcctgcaagattccacaattgaagggctggaagacatggccactaaataccagggcattgtggcaaccataaagaaaaaggaatacaatttcctagaccagcggaaaatggattttgaccaagattacgaagagttttgcaagcagactaatgaccttcatgtaggttgtataataaaattcctgttgacagtc

SEQ ID NO: 201481 - DNA, 471 bp, Homo sapiens
gagccgcacggcggtcaaactacagtcctgagccatatgacctgaaaggactatatatacaaaggtggtccagaagattataatcctgtattttttcctgtaccttttgtacgcttagacgtgttcagatacacaaacattttccattgtgttacaacggcctatagtattcagtatagtgacctgctatacaggttcgtacctaggagcagtaagctgtctatatcatatatcatatctatatcacatagtgggctataccattgagcctactatgtacctgggctgtatgtaagtatttaggtttgtgtgaaatatacagccaggtgattttggtatttaggtttgtgtaaaatatactatgatgcttgcacaacagtgaaatcatctacacatttctcagaacctctttttttcttttcttttccttttcctttttttttttttttgggagactgagtctcgcgctat

SEQ ID NO: 201482 - DNA, 555 bp, Homo sapiens
aaccaaaaaacaaaccaggagagaacataggcaggtacgggcgggtgttaattcggacgaggggagagaggagccaggcctcaccgtctcctcggaaggagctgcacagcctgttctacaggctccgtttgctacagcccctgaacgcccttccaggagggggagaagtcccactttcagaaaactgtttcttctatctgataataataacgcatccttgtttggtggcctctatggtctgaatgtttgtgtctccccaaagtttctgtgttgaatcttaacccctcagtgtgatgatgttacagggcagggcctttgggaggtgggttcatgagggtggagcccacctgagtgggattaatgtccttataaaagagaccccagagagctccctctcccttcctgccatgtgaggacacagtgagaagatggccctccatccatcaaccaggaagcgggccttcaccagacaccaaatctgccagctccttgatcttggacttcccagcctccagaaccgtgaacaataaatttctgttgtttataagctacctg

SEQ ID NO: 201483 - DNA, 931 bp, Homo sapiens
ggttaggtttgcactctgaacataacgaacgagggtgtgaatcttggctctcccttttagggcctgatagtctgcaaaacagtgctctgtgggcctgttttaagatttagtacagggaacagtcacaatcagtcaactgactaatttctccttaaccactgccacattctttgacctaaaggatattttaaagataataaaagacccacaaatccattgcaagcactttaaagatactgtgcattggactgagcccaacaacttagcctggtcatgaacttctgccctcttttcactccctacctatcacctatgcaagctctctgctctactcagcactggagagtccttctttcccaaaaatgtcatgccccttcccgcatctgggatattgagtctgccattttcctcacttgaaatgcttcctcctctttccataactcttctttcagcctaactcgaattctctttcttcctgtaggaccttcattgaacattccaacacatacttagcaatttctccctttcttttgaattcactagcacataatatctgtacctttttcttggcacttggtctgttatcttgtttgttattccactttcttagtattgtatttattttcctctaactggataatagcctctttcaggaattttatacatctttgtgtttctagcacatgctatgacctatacatagtagactttgtacagatgcttgctcttatgtgagagcagaagcacatggtgatcaaagaatgtgtggaaatggtctcaagtcaggtcagccggtctaccccaaataatccatttaaatggacaggagggtttgagcctactggcagttctgtaatgcacatgacaggcagctctgtttgtctgagaaagcatcttgagttatggtagaacctgatcggtttatatcaaa

SEQ ID NO: 201484 - DNA, 526 bp, Homo sapiens
ctctcaataataattctttttcttttcttttttttgagacactgtctcgctctggcgcccaggctggagcgcagtggcgcgatcacagctcactgcaacctccaactcccggattcaagtgatcctcccgcctgcctaagtgctgggattgcaggagtgagccaccatgccctgcctgtcttcggtttttcaaagcactttcactttgcagtatttcatttggttttaacaccagcctgtgaggcatgtcccatgctaaagaaacagctttagagaagttaaatgggaggcggaggcgggaggatcgcttgggaccaggagttccagaccagcctgggcaatatagtgatactacgtctctacaaaaagtagaaaaattaggcatcgtggcttgtgcctgtagccccagctactccggagggtgaggtgggaggattgcttgagcccgagaggtcgaggctgctgtgagctatgatcaggccactgcactcaggcatgagcaacagagcaagacattgtcaagaag

SEQ ID NO: 201485 - DNA, 499 bp, Homo sapiens
gcctcgcactctccgtaacagggtgtggggggaccgagacatgtgggctccagacttgaccatctttacctagttatgggatttcaatcatgtcttttaaattctttgagctgcagttttcacatatataaagtggaaatatttttaaaattttaatttgtattataaccttgtgtaaagataaaatagtacacttgaaagcattttagctgaagtcaaacgttcatgtgtgtgcatgcgatggcttaattattttagggcttatcctggttttactggtagtgttactagcactgctacttctccatatctctgaagactatgaaatacttagaactgaagcaacaagaagcacctgttaaagggttctatggccgatgacagatttgacacaactggatataataatatgttagatggtgactagagcactgctgagcagagacttcatgctgttcaaagtcgaaggtgtccctagaattctgaacctgctgaagca

SEQ ID NO: 201486 - DNA, 183 bp, Homo sapiens
ttaacttagttgctaacgaggagattcaaaacctaaatgtttagaatatattttggaaatccttctaaccatgataataaagacgaggtctcacttgtttgcctatacactactggtatcctattctttctttgattttgaatgttatatcctggtatagatagacccgtgggcataacagtg

SEQ ID NO: 201487 - DNA, 124 bp, Homo sapiens
ccctgttcccttgcttgactggccatgagttcgtcagcatgagcaagctgttctggggatcctgaatcattagtaggaatccatctggcttcagttactgcttggttttgaaaaagttctcaca

SEQ ID NO: 201488 - DNA, 121 bp, Homo sapiens
agtaagaggctgtaacacagcaatgtcctaacaacaagctgagcagaccttggtaaaccagctgtctgtgtgttcaacagggttctagctgggtatgggatgtgggcactggtactgacct

SEQ ID NO: 201489 - DNA, 559 bp, Homo sapiens
ttttgcaagaaaaccttattgagcacgctttgaggggaggcgttctctgcttgttagaagttttttattagactccacagttctgaagagttgattctgacagtttttgcagcttactcatgcagtgttggaaggagtgagttttggggctgttttcagtgacatccccacctggtgtgttttgaggtttgtccatgatgtggtgcgtgtagctcctgtgtggtttttcttactgagtagcttatatagctatgtgggctctgcactgctgccacagcacttaaggggagatagcatgaggaaccctaacagcacccatgggagcagcttgaggaaccctagaagcacccagggaagcagcttgaggaacgctagaagcacccaggggagcagcttgaggaagcctaacagcacccaggggagcagcttgaggaaccctagaagcacccagggaagcagcttgaggaatgctagaagcacccaggggagcagcttgaggaaccctaacagcacccaggggagcagcttgaggaaccctagaagcacccaggggagcagc

SEQ ID NO: 201490 - DNA, 622 bp, Homo sapiens
gtaccagcaatgggggctgctgtctccaaggatgaggtgtgtgagcaggtaagttcctctccacagctctctcctgcccaaatcgagcagctttttcattaggcgttctctgcttgttagaagttttttattagactccacagttctgaagagttgattctgacagtttttgcagcttactcatgcagtgttggaaggagtgagttttggggctgttttcagtgacatccccacctggtgtgttttgaggtttgtccatgatgtggtgcgtgtagctcctgtgtggtttttcttactgagtagcttatatagctatgtgggctctgcactgctgccacagcacttaaggggagatagcatgaggaaccctaacagcacccatgggagcagcttgaggaaccctagaagcacccagggaagcagcttgaggaacgctagaagcacccaggggagcagcttgaggaagcctaacagcacccaggggagcagcttgaggaaccctagaagcacccagggaagcagcttgaggaatgctagaagcacccaggggagcagcttgaggaaccctaacagcacccaggggagcagcttgaggaaccctagaagcacccaggggagcagc

SEQ ID NO: 201491 - DNA, 286 bp, Homo sapiens
tccaagaaatatgggactatgggaaaagaccaaatctacgtctgattggtgtacctgaaaatgacagggagaatggaaccaagttggaaaacactctgcaggatattatccaggagaacttccctaacctagcaaagcaggccaacattcaaattcaggaaatacagagaatgccacaaagatactcctcaagaagagcaactccatatctatgtttttgaatggtgtcctgagttccttgaaagaaatctctattataggtttcctataaatctaatgtattgat

SEQ ID NO: 201492 - DNA, 194 bp, Homo sapiens
tacgtcttcccaaactttcctgagaggtgagtggcctggtactagtattggagctgggctgcaagggattttcaatatggaatccaggagctggtcaatacatccatggacctgtgagattatatgcaagattgtgtgtatggatgtgtgtgtgtgtgtgtgtgtgtgtgtgtttaggtagggcaacatctctg

SEQ ID NO: 201493 - DNA, 265 bp, Homo sapiens
actggaaaaagatggacaatgcaaagttataaataaaaatgagattagtagacaatatgaattttggcatattctcagggcttcggagatttgggtggtttgccaagggatagaaaccaatcaattctacaacactgggttctcagaagcctacaaaagtcaggaggaaaatgtgcctttcaacactttgcctggggtaggtctcatacctatgaaagagatctacctacagagcctatgtcattttctaccttcattactctct

SEQ ID NO: 201494 - DNA, 282 bp, Homo sapiens
gctgaattgtgctgactggcacatccattgtgagcggatgtgttttccttctgcaataattttggctacattaaattcgttttgttaacatcttcatcaccgccttttcagtttcagcgggaattgattatgaacaaagtgccatgattttgactattcaggcgagcaactgcatcgagccagcactgaactggttttgtaacaagcttggtgtccatatcgctcttaataacatctgcaggcacaggcgacgatagcagttgtgggccagccgtcaggaaa

SEQ ID NO: 201495 - DNA, 359 bp, Homo sapiens
gtagaaggcaaagatacttgttcaggtccaaaattgctccccatccccacctggcctggataaacacaggagaaagctttctccttatgagatttctaatctaagtttggagtttcaaggagtaagggtgggggtggataccctcccacttctttggttcatccatcagcaacaacaatgccatctggttaccggggaccagtgaggcataaaaaccccagaaaagcagctgtcttctcctttacctgtgtcagaattactaattaaatgacaaatttgcctttagccataaatgaaattttgtgctgctgaaactagcacagctcttactcttaattaactatacttttttgtaacta

SEQ ID NO: 201496 - DNA, 383 bp, Homo sapiens
ttcctaattctctcctctatatttcttttcttttcttttctttttttgagacggagtctcactctggagtgctggagatcactctcaggctggagtgagactctatctcaaaagaaaaacaataacaacaaaaatacaaaacaacaacaacaacaaagaaatagggaacagtatgcagttacgtaaactcttagccaaagcagaatgttgttacccgtgagtaccaaggatcactttttttttaaagcaatacttttttttctatcttaaactgttaccaaaagcccccaataaagacataccacgtgtacaactagtgtatctggtttaacattatctattccaagagacccagatggttccaagcaaatatagctgggtgc

SEQ ID NO: 201497 - DNA, 507 bp, Homo sapiens
tggtgtgcaggcgtgcttctgtttctgtcaaaataaattaggctgctaagtcgtaaattaggaaaatattttgctacttgtgtttcttatttagcaagtagaataaatagctggcctcaaaacaaaacaaaaacccaaaccaacctcaagtcgattgacagaagatgattctgcctttgccaagagtgaggacgtaccttctctgggagacaggaagccttcatctgtctccctctgatttgactcagtccttaccttccatgtacctctggtcaggtcaccttgcccatttctcccattgcccttcatattgggttggggtttgcaggcctaaggaggaagcacgggaggcctatccatatctgaactctgtttcctgtctctcttccaccaatgtgaggtttctcctcacattgcttttacccaatacatgaaagatttcctttgtcaagcttattggaatgccctgtgggagggatgctatgcaaaaacataaatgtattgcat

SEQ ID NO: 201498 - DNA, 739 bp, Homo sapiens
gctaatagtccccagtggcatccttcctctgagaaccgtcctagcatataggaaaatacctgggagagtagcgcaccctccctttggcgtgcatcccccagccaattaattaacagaaatccaaaggctggctcctcaacttgaggtgagataaacctgtggtaccatgcagactccaggtatacctgtaggatcaggtacagtgaaaacagatgtcagttaaagcaggtcttcattgaacaaacttctaacctggaagtacaagtatttcattttcctcaattccttactgttttttatctatatattaaatatatatatatatattttcctaggccctctcccacttggacaagtacctatctctcaaaccctgcttctgggaagccttatataagatgcactgtcttcacatttgctgccctgtagcataagtaaatacagttatttaacttaggataatgccatatgatttgccaaaattgtattttgaattttgttctagacagaagaaattttatatcattaagatgagtgaaattcctattaaaaaggataaaagcgcaactcgatttctgacttcataaagattgaatattgtttcttactcattctacttggaaatagtcaagaaactctctgaaagtagaatatttcaaaaaattctgagaaaattaagatatttagaaacaaaaaggatagctgttttgaaaaataagtaaagtaagggaaatcaaaa

SEQ ID NO: 201499 - DNA, 283 bp, Homo sapiens
caggacaccttgggccagcttggttttactttagatttcactgttgtcccaccccacttcttccttcaccaacatgcaagttctttccttccctgccagccagatagacagatgggagaggcagtcgcggccttcgttgtcagtagttctttgatgtgaaaggggcagcacagtcatttaaacttgatccaacctctttgcatcttacagagttaaacagctaaaagaagtaaaataagaaggcaatgcttgtggaatgtacagtgcatattgacggcacacg

SEQ ID NO: 201500 - DNA, 482 bp, Homo sapiens
ctcttggccatttgtatatcttctttaaataaatgtactgttttttgtgtacattttgagttatatcatttggtaccccgtagtccttgaaaggctctgaaatttttaaaggtggttagtttagaagtagaaattaggaaaggcttttatttcctctgcataccctgtctaaatatgacaagaaattgggactttaacaaatataaacccaaaagagtgtctatgagatgtattaaatatattcagtaaatctgttaatcaagcatctaccatgtgccaggtgcttttctagtcactgggaatacagcagtgaagacataaaatgatgtccccattctcctggagctgtcagtctagcaggaataaacaacacaaatacatatataatgtgtcagatggcaaaggctacaagaaacataaattacagaggggcaggcatgttgctattttagatagggtagctagtaaaggactctggtgac

SEQ ID NO: 201501 - DNA, 397 bp, Homo sapiens
cccctgacttcacttttctcagaccattgcttttttaaaacttgcaattgtgagttctttctctgcacttttgagaagtaaatcttctataccaggaaaagtctttctcccatactgcaatagtcttgaataaagtcttccttgcctgcttaatctgcctggtgctattgttctttaacgttcctaacccatagcttccagaaaatccttcaggtagatattatggttcaataaataatcacatttctccacactccctctatggaaggagtaccccttctattaagtttgaatttagccatgtgacttgcttcagttaatggaaagcatttatgtgaacagatggaaataaaccatctctaaacagagccttaaaagtgtttccatggtttggctt

SEQ ID NO: 201502 - DNA, 169 bp, Homo sapiens
aatggtggcctttgatacctttgtctcttctttgtatcatgtggcatctggatgacacattgttgctagaaatctccaggagccgcatagaattctccccatctccagcccagcccagggcctcttgagctacctagcactgaggtaccagaatcaaatccttcgccca

SEQ ID NO: 201503 - DNA, 248 bp, Homo sapiens
caggcttggtgggtttcccccttctttcccttgtcgggggtgcaggcctgtcctggccctcagcagaggcctccttcccagcccctagcagcacctgcatgattagggcatctcattgtctactcaggaggctgaggcagaagtgcttgaacccgggaggcagaggttgcagtgagctgagatcctgccactggtctccagcctgggcgacagagcaagactctgtctcaaaaaaacaaaccacccca

SEQ ID NO: 201504 - DNA, 627 bp, Homo sapiens
ttccatttctgtattactttttgttttcctgggattaataattgcctctctttttcaattgcttgaaatccctcctactaaatctcataaccttcagcaatcactcagtgtaatttttcacgcaggaaaacataccatctattttccctcttagctctagctctctattctagaacagctgttctcttggtctgttgtgcagccttccactgctgtcatcctgggagttgtctttacttctctcccttgtttctgtcctcccagatcttctttctagggttaatatttgtcagtagcttcctgcaatactaccacccctgtttttgctgagatattggatgccattctaagttcagatcctttgaaagtaatctgttgtcccctacctcccacccctagggaggcagaaacttctctttaactgggtgctctgaaatttcattatgttgtgatttgacatgggtctttttttatttcatttcttaagctggatattgataatggactctttcaataaatatggttactcctgtctgtcagttcttgggaaatttctggcattatttcctttggtaatttgttgactgttgttttctcattgtggcattcctactctttcgatcttgg

SEQ ID NO: 201505 - DNA, 906 bp, Homo sapiens
ggcgccatcataacaggggagaatggcaagaggtgagaccaaaaaaaaaaaaaaaaaattggttgggccaggtagtcaaagggccttgaatgtcatgctaaggatttgaatttattctgaaggtattctaagacattccaatacccactgagctacaacttcaaagtgccatctaactttccagcttgtggcttcagagtcctgacaataagtagaaatggaaccagtagagtatgttggaaactggaagtcagaaggtctggattctagtctgactttgctgtctgggtttctgttttcttctaggtaatgtgaaatggtgagacatgattcctcagagctctgttatcccacaagtctgtgtctaccagccgcacaaggaaaatctttcacgaggttcctctcagttcctgtggcagacagactcttggggaagttgctcaccatcccacctgctgatgtcatggctttctgtaattccttctgtttgagtggtgggggtgggtggctgcagtggtgctgtgacttgcttctcactggtagaatgcagcaaaggtgatgagataggtgggatagatggtgccatgtcagcgatgacatgggtatattatgtgacagtgtggggccgggcacggtggctcaagcatgtaatcccagcactttggggggccaaggtgggcggatcaggaggtcaggagattgagaacaacctagctaacacggtgaaaccctgtctctactaaaaaatacaaaaaattagccaggcgtgatggcaggcgcctgtagtcccagctacttgggaggctgaggcaggagaatggcgtgaacctgggaggtggagcttgcagtgagccgagatggcgccactgcactccagcctgggggacagagtgagactccgtctcg

SEQ ID NO: 201506 - DNA, 387 bp, Homo sapiens
tgtatccctcctcttaatcttcacaaagcctctgtaaggtagatggccttaaccccattttacagaagaaaaaacaggcttcagattaaggctgggaattttcaaaggctgcgtgtctgcaggctgctaggagggctctgtgaggaagactggctaagccttcatttacataaaaaatcaacaactttcttaacattcatttaggaaacagaggtgcattgagtggcttccctgtgccaggcggtgcactaggattaatatgagatttataatcatagtacttccgatggtcttaacccaagtgacagggttaagatttgcgaggccatcagaaactcctgcaattgcctcagttcctggcatcaaatttaaatgggcttatgatgc

SEQ ID NO: 201507 - DNA, 343 bp, Homo sapiens
ttaccccaagaacccaatagggaatttgctttatatttaaaaaccagagtcaaatcagcacaatcgaagaagtcatcagattaaaggtgtcttcacatctccaccttttctagctttgaaaggggagtggtgaattctacctaaagagagcattttaacttatgactcagcgttcagttgagacacaaagttattttgcttttcttcgaaggagctcagaatgaccctgtgcataaaattaatgtaaaggaaacaagactaaacaagaaggctaataagcagcctagtggaatgaaaggaaatctttatttgtatcagtcaaaattgatcaaatattaccatt

SEQ ID NO: 201508 - DNA, 490 bp, Homo sapiens
agcacaactcttaggacatcagggacagaaatggagagatgagataataaaggggttcttggcagatggggctcaggcacttggctactgctgcttctcaggcatgcgggcctcctggtgtcctctgagaatcgccaaaacctcttgttaaagaaaaatagtggcttccacctaatgtagaccactgacggcactggggtttcagttgcggaggttaacgtttgatgatttagacaatgtggtatggacctgtattccagggacttgggcctttgtcaccctcatttacctgtcctccaaaaggaaagcaaggcctaggagagcctggaggcccgagaaccaagctctttgctatagtggaggaagtgagggctctggaggcccaggggagctagggccgaatttccacttctacctctgacccacgtgagaccttctgccagccgccaacacccccattcccttccatttccttgtctggaaacacaga

SEQ ID NO: 201509 - DNA, 440 bp, Homo sapiens
ctcagcctcacccccagggaggagctggcccggtgcttgtgggcccctcccaggtgcagcctgccctggcgctagcgatgcctccgggatcttccagaggaaggtgagacaggcaacaggatggagtaatcgcagcctctaaaaaacacatttcacagcagattaggaaaacagacgtggcaagaggtgggccgacagtgcgggaggcggttccttcccaccgtgggcttcccgtctgactttacagcaaggccgcttccacacgggggtctccaagcccaccctggtgccttgctgcacgcaggctgagcgctttcttccaaggcagacagcggtaatttaattttctctttttcagtcgtgtttttgttatttagaaaacacttttctttcaacatttgccacatcagtagaagtaaattaaaacgttcgttacctca

SEQ ID NO: 201510 - DNA, 645 bp, Homo sapiens
ggatcttagagcaatgggtgaatattaaataataaaacaatttatttcttatttattcaatgttaagtgaaggtattattttcagcatttctcagctactttgtctttattagtttgagattttagtccgtcacttgccgtttgaagtaaaagaattcgaatggaaggcaggcatgtgctcccactgttgacgtctcttatttcatcaaccatgtcttcttttgggtttcagcacaggcttttaattaggttaatgttcttgttgggtacccaaagtagtctgggctaggtgctgaagaaattagaaacagtttccttactggccaccagagggaagcactcccacgtatggcggatgacgggcgttccctcctagtgaaaggaagaaaatgtgtgccgaccaaatctgtgtgtccttaccagtgtatctgctgttcggtaaccttctgccagtttcttccttgtggttttcctgggtgcccgtcatcctgacatgaagtttcccaggggtctgacaaaataaacaagtcaggttcaccggaggtggcacaggtcaccatgcataagatgtgtggtgtcacgtcttatgacaccaagtgttacgataggtcctgtctgcgccttcttggttctgctgtgtctgtt

SEQ ID NO: 201511 - DNA, 173 bp, Homo sapiens
aaatttctttatcactattttcattgctgcataatagacgtacacactttcaggatacatgtgatattttgataccttcatataatgtgtaaagatcaaatctgggtaatttggatatccatcaacttcaatatttatcttttctttatgctaggaacattcaagtgattctc

SEQ ID NO: 201512 - DNA, 252 bp, Homo sapiens
ggtatggtggcaggtgcctgtaatcccagctacttgggcaactgaggcaggagaatgtcttcaacccaagaggcagaggttgcagtgagctgatatcgcaccattgcactccagcccgggcgacaatgcgagacgctgtttcaaaaaaataaaaataaataataataataataataataataataataattggatggcaaagaacctttatagaatgcaattagatgaaaagacaagattttcctttgttta

SEQ ID NO: 201513 - DNA, 305 bp, Homo sapiens
agacgtgaaacttgggtcgtggcgctttcaggctttcatctggagaatgaattgactatagcaaggacgaaaaggcttcctgggggcccagaatagcgatttgcctatcagtgtgacctaaatagaacgtgtaattaacaagtctcttacatgcatcctgtgtctggtcagactgctggcttgccttcttcctaacctcttttatcctccactttcattcctattacgggggaaacaggttgcagctgcagctgcagccgttaaatttaggcactgaaggaagcgggttcaagcagccgctggaa

SEQ ID NO: 201514 - DNA, 501 bp, Homo sapiens
agggtttgtcaaaacacagatcacagagacctacagagtttctaaggcagtaggcctgacatgggccccaaggcttgtatgttgaacaagtttccaagggatctccaggggtaaaagacagcacatcctttttggggcttaccaaaatacaaaagcaatgataacagcagcagcagcctggccaaggaatgacatcacttaacatgttagtcaacactgattttggcactatcacatcagttttctatttaattttcacaacaaccctgtgagagtgggattattaaccccattttccaactgaacgaaagctagctcagagattgacttgcggccaggtggggtggctcacgcctgtaatctcagcaatttgggaggccaaggtgggcggatcacttgaggtcaggagttcgagaccagcttggccaacgtggtgaaaccctgtggctactaaaaatacaaaatattagctgggcgtggtggcgcacacctgtaatccca

SEQ ID NO: 201515 - DNA, 456 bp, Homo sapiens
caaatagagagcttttgccgggtgcggtggctcacgcctgtaatcccagcactttgggaggccgaggcgggcggatcacgaggtcaggagattgagaccatcctggctacagtgaaaccccatccctactaaaaatacaaaaaattagccgggcatggtggcaggtgcgtgtagtcccagctactcgggaggctgaagcaggagagcttgaaccaggaggcggagcttgcagtgagctgagatcgtgccactgcactccagcctgggcgacagagcgagactccgtctcaaaaaaaaaaaagctcttatccagagctgcctttgaaaaatatttttgcttatgactgtaatcctgtggaagctgcaggtcaccgagaaggcccacagggggcagcactaggaatgactctttccctctagtcctctatgcgctaggggagagagttcttggagatg

SEQ ID NO: 201516 - DNA, 486 bp, Homo sapiens
ctaccagaacagctaaaatcaaaaaggccgaggataaaaagagtggaggaggatatggacctgcaactttcatgcatcactgttatgtacacaattatttgcacactttggaaatgtgaatgtttcagcaatgtttcatagcttgaaaaacaccgtataatttggtcatctaacacctagttattgattcaagagaaatgttattctgttggcactgagaaggctgttgaatgaggaaggattagatacatattttatgaaggtcatctttataacaatacataggctgagttaagatactggatttgaattattgaacattactgggtatcacaaaataaaagtaatgcttctgggggactttactaaaaatacaaattctcatttatatttgtatttgtattgtagttcaaggttggaactcagaagtgtatattttaacattggtggcctttgataacattgtaaaggaaagacaagttaaag

SEQ ID NO: 201517 - DNA, 363 bp, Homo sapiens
atctttaactttttaaagatacctgtaattaatgtagggggtgtcagattgctgaccagttattgcaacactatttattgaaaatttccccttcccctccttcttctaacattaaattaccttatatattacattagattcatttttgagtcagtgtatcctgtagtggtttgacaggtctgttcttgtgttcacagtcttctaactagtttgcaaataaaaattcagaaaattaatttagaaaatcaaaaaataattgagtctgtttatttttgctgacattcattttgttgagttccaaaaagtcttgtgggatttttatggccatttgtagtaaacttacacattttggaatgtttgaca

SEQ ID NO: 201518 - DNA, 290 bp, Homo sapiens
ctcttcacacggacgcgcatgaaagttactccattcagaggcctttcccatctcttaatctgattctgcactaatatgttagctccaagccatgtgtggatatttaatatctgaaatgtggctagaccaaattgaaatataaggtagctgtaaaatgcacattggattttgaagacttggcacaaaaaagatgtacaattatctaattttttaaacaatgattacatgttgaaatatgttaaatagattattaaaactgatttcacctgtttctttttagtgtttttttt

SEQ ID NO: 201519 - DNA, 384 bp, Homo sapiens
atctacctgtctgacaagctaatatgcagaatctacaatgaacttaaacaaatttacaagaaaaaaacaaacaaccccaccaaagagtggccaaaggatatgaacagacacttctcaaaagaagacatttatacagagccaacaaacatgcaaaaatgttcatcatcactggtcctcagagaagtgcaaatcaaaaccacaatgagatatcatctcacaccagttagaatggtgatcattaaaaagtcaagaaacaacagacgctggagataaagtcatactgtagtagggtgggctcctaatcccataagactcatgtccctataaaaggggacatctgaagatagacaaacagggagaacaaacacttctcaaagaagacat

SEQ ID NO: 201520 - DNA, 300 bp, Homo sapiens
aagctgattagggaaataataaaatgtgggacatagaataattacagatgcaagtgaccttgtgttgtatgtttataacagtagttcagggaagagacaagttagataggactggagttattatggaaggcttgattcaggaggtgtacatttaggattttttcttgtatgtcaagggggcaacaagaacaacttgatattttacaaaaagaattctggtgcattaagaaggaaggtttcagaatagtaaaactgagggtggaagaaacatagtctttttcttgacaataatgttctctt

SEQ ID NO: 201521 - DNA, 456 bp, Homo sapiens
ggagagaattgctggtggcttacagcaggtaataatggtagaggtagaagtggtcacattctggatatgtttatttttggtttatttttttttaacttggggtaaaacttacataaaattaataattttgaagtgaataattcagctctagtacattcacaacggttgtacgacattgtgaatgtactagagctgaattattcacttcaaaattataaattttagaaaatgacatagaggcaggagaatggcgtgaacctgggaggcggagcttacagtgagccaagatcgcgccactgcactccagcctgggcgacagagcaagactccgtctcaaaaaaaaaaaaggaggaaaattaattggagagacaaagggagaggtgggtgccatttacagacagtgacaaaagcaggcctccctgatgggggtccttggcccacagccctgaaggagac

SEQ ID NO: 201522 - DNA, 561 bp, Homo sapiens
gcaaaactctgtctcaagaagaaaaagaaaaaagaaaaaagcggagtcgttctgtgagtgaaaacactgaattccaccggttcctgatcatattgcctttatttcattcattcattcattctggaaatggggataaatagcccgtttgtctttcctgcaggtttgttacgatggtgaaggcaatttagaaggaactatttagtggaggataaaagtgttttgtaaatgttaagatgcattgttttgtttctgtcctgttgcccaattttctctcagcccaacacctgcctctatttggttcttaggttacacattaattccatttgcttagtaatttaaagaatgtactgtagtacaccaataagctaacaaactcgggcccttgaccccaagtcaccagtgtcacctagattcaaaaaccaatataacgagtcaagtatgaatgcacaatattttagctaagcccttcctgtcccacctctaatgaatccacatgctgccccagggcttggtacatgctgttaagtaagcagctttgctccctcctgctccctgtttttg

SEQ ID NO: 201523 - DNA, 108 bp, Homo sapiens
taattcttgccacagaaccaaattctgtcaatacttagtccctagaatgggctcctctggcctctcagtacaccagaagaaaaaggctagaatcttgacatgcaaaat

SEQ ID NO: 201524 - DNA, 591 bp, Homo sapiens
ggaactaatacaccacttagaaaaaatttgtagaaaacttttctcccctttaccctgaggaatctattttggttaacaggtcaaaatttttttccaggtagtaggggaggaaggaggagcagtgaaggttttgactttgactgcctttacttttttaaggtgggggtagatttgcatttttctttgtgagcctccatttttggcaggaaaacttcagggaggagtaggagcccctaatccccttccagtggacttgttttggaggaaatctgaaaataagacttaatcatcaagtcacttataaactgatgaaataattaaggaatataatggcctggcaatgactaagtccttctatctcctcattgcagatacatgctaatcacttttttctctcttaacaacatttattatgaaatggcatgtttttgccacagcagggtagccatttcccaaccctggagcactcttaattctgagatgcctgattagagcctcaggggtcccaaaagatgtgctgttttcccactttataaaattacattcttttctcacagttgtcacaaacatgatattggttgataagaactt

SEQ ID NO: 201525 - DNA, 395 bp, Homo sapiens
agactacaggtagcccaccatgacccagttactctggggtatctttagcagagacagaacttcaccatgtatggccaggcttgtcttgaactcctgacctcaggtgatccacccgcctctgcctcccaaagtgctgggattacaggcttaagccaccgaacccggcctaaaatagcttcccagcggtcctttaggtcccagtaggtaaagcctcaaggcaggctctagagtgccaacccttctgacccagaggtgagggtaaatgtaaataggatccctttcagcgaaagttagggccacacttctcatgtccctaagccattggtacttgtataaattctctgacccacctatgtatgtggtgcgtatgtgtgtaatgtgtagctataattctt

SEQ ID NO: 201526 - DNA, 592 bp, Homo sapiens
acgtgaatgaaaaattattctgtttacagacactttctacagaaactacttttttaacatttttttcaaatagtcagttgggagaatgggaagattttcttaccccttagaaggagactttaatgtttttatgcaaaaggcttttaaactgaaaatccatgcatcaaactgaagtatgaaaacacagctttccggatcctttaagaattcttagctctttagtttccagaaaacttcccaaacatttttacttttcattctttttttaaaatgtacttttcaggtttaatattctgttaaccacgggagtgagtgggggtgggggtgagcttcagctccagctttgtgttctgcaaagaggtcagagttctaaccagatacttggtatttattctcctttgaaaagctggaaagctcagattaatatggaaaagaactttacaaacaggtatataacaaaagtacaatcatatccaacagacacagaaaggagaatggtggttgtagggctgggggtggaggaatagagagagagaaagtgcgcccaaggtggttgggttacagttgggttaagtatatcccagggggacta

SEQ ID NO: 201527 - DNA, 482 bp, Homo sapiens
aatagttgataggctgcagttaacctgcaggactccttggtacagggtgcagtgttgagttcaatccaaccaagacaccagcatacactgggtggggagagcagctatggcctgggagcactaccaggggaaaggcagctggtggagcaccttggaggaaattcaagcctccttggcaattagggaagatggattgtgtgtttacagccgtgatcacccatgtgctctgtggtctcagacttccatgtccctgcacttatcgcacaggggccctgcaacatggcagtcactgaggactcagtctgcagtcgagatagacattagggagtggtgaggtttgtggtgaaccaaaggtgcagatgccttcggaaggagaaggtcacccctcaattttagccagttgttgtcatgtcagaatattagcaaatcatcttgatttttcaaatatgaaaagtaggaattctgtggagaacttcccagtt

SEQ ID NO: 201528 - DNA, 790 bp, Homo sapiens
tatgggcctttggaaatccttaatcctttggcctccacgattctcttttgaaaatattttctgtttctttatactgatcctttcccatattgtctggttcaggtaatcacttgttatcagagttcttccaaaatgaaaacgttctgatttgtactttctctcttgaaggtgacttgagtagtcttgaattctccatctgttctggagactttggttgaatacaggcactgaggacacaaaagtggacgggggcttctggttcctgccagggagctgctcccaattgttccacggacccccatgagattcctgaaattgcgtgcaaattattgtgcatttaaacatttttcctagggagggagagtgtttttattcagatcgtcagtgggattgaaactcttaacaaggaagaattgatctagcacacatctacatagttcttcagtatttacccaacctcctagtggttacagtaggagggactctttgaaaaaggtttcttggccaggcgcggtggctcatgcctgtaatcccagcactttgggaggccaaggtgtgcagatcacgaggtcaggagatcgagaccatcctggctaacacagtgaaaccccatctctactaaaaaagaaaaaaaattagccgggcgtggtggcgggcacctgtggtcccagctactcaggaggctgaggcaggagaatggcatgaacccaggaggcggagcttgcagtgagccgggatcggcaccactggattctagcctgggtgacagagcgagactccgtctcaaaaa

SEQ ID NO: 201529 - DNA, 508 bp, Homo sapiens
caggaaggtgcatgtgtgagaacctatggtatgcccgcttagggccagggctgcagaggttgctcgctgctcaggggcctgcccggagccctggccacatgtcccgcctcacatacctgcaagggccatttccctgtagatagagcagttgcctgacacagccaccacctctccctttttcccaggcctgctggagaaggatggccctccctcctgccttgtccctcaggctgcctgagggtttcgttttcttgtggctggcatggcctttcagggtactgtccccaagcactttatgaatcataatcgcagctccagcatgtccattcacccccactgccagcaggctctttacagctgcattttgtctccacactcttctgtctttctttgctttcatcaggccctctttggcccagcaaaaagctgtaagtgacttaatacagctgggtggccagcctgggacagacagccatcggagccaagcctctggcatcaaatatagatc

SEQ ID NO: 201530 - DNA, 315 bp, Homo sapiens
atttagagaagacagcatccaaactatattattccgcccctgcctctcaaaatctcatgttcttctcacatttcaaaatataatcattccttcctaatagtcctccaaaagtttcagctcatttcagcgtcactcaaaagtccaaagtatcatctgagttaagccaagtcccctttacctatgagtctgtaaaatcaaaacaagttattcactttcaagatacaatgggggtacaggcatggggtaaacattcccattccaaaagggagaaattggccaaaagaaaggggctacaggcttcatacaggtttaaaa

SEQ ID NO: 201531 - DNA, 786 bp, Homo sapiens
tggccgggcgtggaggctcacgcctgtaatcccagtactttgggaggccaaggtgggtggatcacttgagatcaggagttttgagaccagcctggccaatatggtaaaaccccgtctctactaaaaatagaaaactcagccggttgtggtgacacatgcctgtagtctcagctatttaggaagctgaggcaggagaattgcttgaacctgggaagtggaggttgcagtgagccgagattgtgccactgcactccagcctgggcgttgcagcgagactcaaaaaaaaaaaaagtattctgttctcactactcaaacttgggagagaatactacacaaaaacaacaacaaaacaccagaaaaaccagagaccattctcacaaaaagatacaaagtccatactaaaatgtaataaatccagcagtgtattaaaaataatgtgtatacagggatgtattataggttgaaagaaaaagtaccttggagatgtgtttgatacagttcaaagtgatttttaaaagcgagatggtgtaaaggaaacaatgagtactaagcaaagaactttcagaatcattttcagtaatgagacattggagcacggtaacatcttgccataatgtgataggtgaggtaaatatttcatttgggtaaaatgggttattgtgaggttgatgaaataactaggatgcagttcagagcgtgagaagcaataatttgcattatatcagaattcatcacctctgttctcattaaggcctgaagaatgtcagctactactacaattctaca

SEQ ID NO: 201532 - DNA, 286 bp, Homo sapiens
ctagccaccattcctccaccaaaaccactcttattgaattccctgatctgtcctagtgatgcttttcctaatctgcctctcactctaggtggctcctcctatatctcccgcctgggggcccattcctcagtttccccttcccagaccagctctctaggactctgaccttgaccctctgctcttctctgattattcctgctcactggctggttcccatcaccaccagatacacctcgatgatttgacatcctgaactcatctgagccctccctgctgagccccagtc

SEQ ID NO: 201533 - DNA, 434 bp, Homo sapiens
cctggcacaggcctgcctccccctgccccagcccagggccaggccacactctgcctccaaagccaccgtccccccgaggcaccactgcatcccccaaggggcgggttcggaggaaggaggaggcaaaggagagccccagcgccgcagggcccgaggacaagagccagagcaagcgcaggccagtaacgagaaggagtcagcagccccagcctcaccggcaccttcgccggcgccctcgcccaccccagccccgccccagaaggagcagccccccgcggagacccctacagacgctgctgtcttgacctcacccccagcccctgctcccccggtgacccctagcaaaccaatggccggcaccacagaccgagaagaagccactcggctcttggctgagaagcggcgccaggcccgggagcagccggagcgggagg

SEQ ID NO: 201534 - DNA, 400 bp, Homo sapiens
attgcaggctactgagactggcctgatgatgatccttctgagaaatacttatagcagatgatttgtggatgataactacgccaagcaagacactgtctccagtaaccccaggctcgtctgacttcctcaggggattataataaagaatcacaaaaagaaccctatatggacagtctggtctctggacactaacaacagcacaatccaaaggcaaagaaaggaggaaccaccttgtttcatgtctgcaagctgctccatatgaaagcattgctgacatgttgacccaacagcaaaaagagagcagcagtttacacaccctcagctctctgtcctttcctttctattgatgttggtccacttttatgactgaatacatattaaaatcaccatttcaaattat

SEQ ID NO: 201535 - DNA, 732 bp, Homo sapiens
attgcaggctactgagactggcctgatgatgatccttctgagaaatacttatagcagatgatttgtggatgataactacgccaagcaagacactgtctccagtaaccccaggctcgtctgacttcctcaggggattataataaagaatcacaaaaagaaccctatatggacagtctggtctctggacactaacaacagcacaatccaaaggcaaagaaaggaggaaccaccttgtttcatgtctgcaagctgctccatatgaaagcattgctgacatgttgacccaacagcaaaaagagagcagcagtttacacaccctcagctctctgtcctttcctttctattgatgttggtccacttttatgactgaatacatattaaaatcaccatttcaaattataattatctgctttcattggtctctttcacaagtctatgtctatatttatgtttacatatataaacacatatacacatatatttgcttgggaagtttcactacattgctttgtatttctcttttataaggtaatgcatttaattccaaaactaccacattaattgtataaattgattattacataagtttccttgatgatttacagaagaactattgagaggtcagtgttagcacatcaaaatatagtctggtatggcattttaaattgacccaggtatctaatattaaagcctttcaaatttatctctcctgctattattttattaagatta

SEQ ID NO: 201536 - DNA, 697 bp, Homo sapiens
tagagtaccccgataatggtcgagtttaaggcagttgcaacatgaaaacattctaacacttcatgaatatcaagcagctggtttggtttttgacttgacgcttccattttgggtaatttggctatcagtgcactcaagcatgtgtgaaagactcacgcagagggttcagggttggggacagccccgctgctcctcaggaggctggccacatgacagtggtctgtctctgcactgggatgccatgtagctgtaaaaagagtccatgtggacccatctctagggctttttgttaggtgatcaaagcaaagtgcaggacaatataagtaatgtgctggctacatttttgtctaaagagggcaaaggaatttctctttttgttagcttataaatgcataaaaggagtctgaatggatgaaatttacagaggttactgtgggggtggggaggacaggagagagaattgccacctaggtcttaactctttcttaatatgtttgaactatatgaatgtgctatctattgaaaaataaaatttttaaatcaacttgagaaaaggatctgagtaatccctgtaatcctggctactagggaggctgaagtgggaggattacttgagcctaggagttcaagattatagtgagccacgattgcgccactgcactccagcctaggcaacagagcgagacctcgtctctta

SEQ ID NO: 201537 - DNA, 280 bp, Homo sapiens
attacaggcgtgagcacccagcctggttctaattctttgaggtcttccatttcctttttctctccactccccagttccagcttacacccctgaaacacggtgactccatcctcaagccttatggctttgtgcaaggtgggggtgtggagggaggtgatcactggggcagcttaggtttctttggctggaggaattccttgggagggtctcaaaggaagggcctggatcccagatctttctctggttcctaaccgagggctcaggatccatctccttatgg

SEQ ID NO: 201538 - DNA, 624 bp, Homo sapiens
acgtcgcatgctcccgcccgcaatgcggccgcggaattcgattgtgatctgagatcgcacccagggtggtttgtgaaggcaggctccgtggctctgggctccagtccaggctgtgtcctggagcttctgtgtaaggtcaggagagtcgcacagtccctgtgagcctcagtttccccttatgggatatgggtcataggaacacggcctcgaagggtttctgtgcacctgagtctcagcccacagccttgcacacagaagacgctcacattccccttggtaagcaaagggaaacggtatgagccagaccaggaggggacacccatgcctggcgggccttcgcgcgtgtgtgtgtgtggcaagggcgccgccgtgtggccgcgtcagccccacggaagcgctggacccggaacttcgctgtattctccgttcttgcgcttttatctgtagcttcccgcgttcctctttttttaatgtttctgtttttgttttgagacagagtctcgctctgtcacccaggtcggagtacagtggtgcgatctcagctcacaatcactagtgaattcgcgccgcctgcagtcgacaattggagagctcccacgcgttatgcatagcttgatattcata

SEQ ID NO: 201539 - DNA, 893 bp, Homo sapiens
ccggctaatttttttgtatttttagtggagatgggatttcaccgtgttggccaggatggtctcaatctcctgaccttgtgatctgcccgcctcggcctcccaaagtgctgggattacaggcatgagccaccgcgcctggcccatcagtctctttttctacgatagcgcctggctgcccctccaccaggtgggagaaagggcacagggcctcaggtgtcctccctggccttgccaagaagggtgacctgaggtccagggcctccagcaagcaggtgccgctgctcgtcgtcctggtgtgggtctggccgcacccagggtggtttgtgaaggcaggctccgtggctctgggctccagtccaggctgtgtcctggagcttctgtgtaaggtcaggagagtcgcacagtccctgtgagcctcagtttccccttatgggatatgggtcataggaacacggcctcgaagggtttctgtgcacctgagtctcagcccacagccttgcacacagaagacgctcacattccccttggtaagcaaagggaaacggtatgagccagaccaggaggggacacccatgcctggcgggccttcgcgcgcgtgtgtgtgtgtgtgtgtgtgtgtgtgtggcaagggcgccgccgtgtggccgcgtcagccccacggaagcgctggacccggaacttcgctgtattctccgttcttgcgcttttatctgtagcttcccgcgttcctctttttttaatgtttctgtttttgttttgagacagagtctcgctctgtcacccaggtcggagtacagtggtgcgatctcagctcacaatcactagtgaattcgcgccgcctgcagtcgacaattggagagctcccacgcgttatgcatagcttgatattcata

SEQ ID NO: 201540 - DNA, 532 bp, Homo sapiens
cctggctgggtggtggattattttcaaattttttccctgcatttattgagatgatcatgtgattttcttcctttattcttttaatacgttttattacattggttgatttttggatgctgaaccaaccttgcattcctggggtaaatctcacttggtcatggaatgtaatctttttttaatgtatgctggatttggtttgctagtattttgttggattttaacatctatactcaagggatattggtctgtatttttttttcttgtgatttatttttctggctttcatagagtaagtgacaaaacgtttccttctcttctatttttttggagaattttttgaggattggtgttaattcatctttaaacatttgatggaatttattagtaaagccatctagtcttgggcttttctttttttcttttttctttttttttattactaactcaatctctttacttgttataggtctgtttaaatgttctatttcttttatcaaattgataatttgtatctttctaggaatttatcggt

SEQ ID NO: 201541 - DNA, 451 bp, Homo sapiens
ctcaaaaagaacaaaacaaaaagctagcaaacaattcgacaggatgccaaaaagataatacaccatgaccaagtataatttataccaaggacacaaggatggtttaacatacacaaatcaataaacatgatacatcacaacagtagaataaatgacaaaaaccatatgattatctcaacagatgcagaaaaaacatttgataaaattctacatccttttatgataaaaagctgtcaacaaaccaggtacagaagaaacatatcttaacataataaaggctatatatgacccacagctaacatcatactgagtggggaaaaactgaaagtatttcctctaagaactagagcaagacaaggaaggatgctcacttttaccacttttattcagtatagtactggaggtagagccagagcaatcaggcaagagaaaggaataaaaggcatacaga

SEQ ID NO: 201542 - DNA, 135 bp, Homo sapiens
gcctttttccaaacagaacttatattttaaaagcttaccatttttttcccttcatggtctgtgtctttggtgttccccatcacaaaacccaagatcaaatacattttctcttgtattcttttagaattattaaca

SEQ ID NO: 201543 - DNA, 549 bp, Homo sapiens
actccagtgtgtgcaagagagtgagactctgccttaaaaaaaaaaaaaaaaaaaaggaattcattaaatgttcagctgtttcttcctcctcacatgtacagtggtgtcctcctccactcactgctttacctaggataagagcagccttgggtctcttcactcttggaagagtcttttcatattctacttttaaatccatttagtttccttttgtccttagatcttatttttaaagaaaaggttatgatttttaggttttctgacttgttatcagggaagtgttttggcttgttactaagatgggaataaaattctttgcatctttgtatactctaagcagaagtgggagtcactttttttcacattggtcgagacagcatcttgctctgtcacccagactggagtgtggtaacacaattatggctcactgcatcctcgaactgctgggcatgagaattgctagagcctgggaggcgaaggttgtagtgacccgagatcgtgccattggactccagtgtgtgcaagagagtgagactctgccttaaaaaa

SEQ ID NO: 201544 - DNA, 152 bp, Homo sapiens
cctataatcccagcactttgggagtccgaggtaggcagatcacctgaggtcgggagttcgagaccagcaaacaaacaatcaatcaaacaaaaaacacgaaagcagaaaacgtacaatggcaggaagccctgtgcaccttgaagacagcgttt

SEQ ID NO: 201545 - DNA, 442 bp, Homo sapiens
gtatacatggttttaaaaatagaaacaatacactctggggaatccaaggggacatggcaggggttaagggttgtaagaagactaactattggatactatactcactacctggttgatggattcttcatactttcaacctcagcatcatgctattacccacaaccattgtgggcacatgttctcaggccctcctgtgggttataatttttaactttggcaaagtaaacctctaaattgattgacgctcttctcagatactttttggtttacctaccaaaagaaaaatgaagtgttctaccaaaaagacacatacacccttttgttcattgcagcatcgttcacaatagcatatttcaaatcgctattttccccatcccccttgcgtatgtacccactgaatgtaaaataaaattggaaaaaaataaacattttccaattataa

SEQ ID NO: 201546 - DNA, 455 bp, Homo sapiens
ttttgttgattgtccggtttaatgctagtgtcccttccttccactccctcctttaaaacaaaagttctcagccttgcctgctaagaactacctaccagagtttttcaaactgctagtcaaaaccaattagtgtgttgccagtgccgtttttaaaaaacaaaatagaatagattagaacatatcagagtatgacacaaatcttttaagttagatacattgctgtatatgtttatgtgtgaatgtataccagattgtaatataaaatttatattgcttgctttccaaatagcttgaaagccgcttacctagagtgttagttaaaaacacagtttctggcctggcacagtggctcacacctgtaatcccagcactttgggaggccaaggcaggaggtttgcttgagcccaggagttcaacaccagcctgggcaacagagggagaccccatctctgcaa

SEQ ID NO: 201547 - DNA, 323 bp, Homo sapiens
agtgattctcctgcctcagcctccagagtagctgggattacaggcgcatgccaccacacctggctgatttttatatttttagtagagacagggtttcaccatgtttgccaggctggtcttgaactcctgacctcaagtgatccgcccgcctcagcctcccaaagtgctaggattacaggcatgagccactgcacccagtgaagagacctattttaaataagggtatcaagggtagtgactttgaaagtgggaatttaggatgaggaagaagtagccacaggagggtagtaagggagtaacagtgttccaggtaggagaaagat

SEQ ID NO: 201548 - DNA, 785 bp, Homo sapiens
gtatatattattatataggatgtttcttgataggaccatgagtgtcaatttattttgaattagactaaatatttatgtggtaggaatacttattcattcaaaaatttcacatttaattagtttgaggttacctaaaataaaacaagtatatattctaaattcgttgctttttcaaaacttattataaagagaaattagaattaaagaagtctaagggtcaggcatggtggctcatacctgtaatcccagcactttgggagacagaggcaggtggaccacttgaggtcaggagattgagagtagcctggccaacatgatgaaaccctgactctactaaaaatacaaaaactagctgggtgtggtggcgcatgcctgtaatcccagcttcttggaaggctgaggcaggagaatcccttgaacctgggaggcagaggttgcagtgagctgagattatgtcaccgtgctccagcctgggcaacagagcaaaactccatctcaaaaaaaaaaaaaaaaaagtctaaggataagaaatatcaatggttcagatgatgaatttacatatatgtgcttgataattttttcaaaatttttacctgagctttattgaggtataatcgacaaatattatcttaggtgtacaacatgatgttttgatatatgtgcacattgtgaaatgattaacacagtcaagctaattaacatatctaccacctcacatagttaccttctttgtgtgtatgcctgataatttaatttaaaaaaatcaatttgtattctattctaga

SEQ ID NO: 201549 - DNA, 421 bp, Homo sapiens
taagtgaattaggcatgggctagcacaatattacacttatagagccttatgtgttaaaatttatgtacttatattttacccttgaatttagcttatctaaatcatagcacatctaagattataattaaaaattctttttggctgggcgtggtggctcatgcctgtaatcccagcactttgggaggccaaggcaagaagatcacttgaagtcaggagttcgagattagcctggcgaacatggcaaaaccccatctctactaaaaatacaaaacttagacaggcatggtggtacatgcctgtaaacccagctactcaggaggctgaggcaggagaatcacttgaacacaggaggcagaggttacagtgagccaagatcatgccactgcactctaacctgggcgacagagcgagactccatctc

SEQ ID NO: 201550 - DNA, 470 bp, Homo sapiens
ttcttctttttaccttttttcagtctctttctctctccttccctctaccccgtctcagttgaatgattaatttgtttttatttgttcttgttttaagacatgttatttaatgccacatatttcctttaattgaggacagtttgattttcattttttttcctttttaagaaagaggcatttgggctgggtgcggtggctcatgcctgtaatcccagcactttgaaaggctgaggcgggcggatcactaggtcaggagatcgagaccatcctggctaacatggtgaaaccctgtctctactaaaaatacaaaaaattagctggccgtggtgacgagcacctgtagtcccagctactctggaggctgaggcaggagaatggcgtgaacccaggaggtggagattgcagtgagccgagatcgtgccagggcactccagcctggacgacagagcaagactctgtctcaaaaaaaa

SEQ ID NO: 201551 - DNA, 163 bp, Homo sapiens
ctatcacagcacccagtgtgcttcctgtgcagaaggcacttatgcaatttgtaactaattatttatgtatttatttttaatgtctcccccattagatagctccatgatggcaaagaacatctttgttcattatatcaacctcatttaccttaacacgttgact

SEQ ID NO: 201552 - DNA, 796 bp, Homo sapiens
ctaatcaggtatctttttgtctttcatatcttcctatctgtgcttaacctccccatccttgaccttttctccgccttttgcattttcccttcttactttgctcttcagagcatcggaactgcattcctaccatggggcggggggaggagagagggggaactcactcccgcaattctgtaagttgtcttagacaagtaaacttccatgcgaagtttatgatatccaatcatttggaagttacttccgtgttagtggagtaacagaaataaaacgacaaagttaggacttcacagaagaattttcagcaatacaaaattaacttaaagaatacgatgtcgtgttcaactcctaccaaataaggttaaacttttgttatggggaaaatgagaaccatcagccctgtataccaaagagcaaacgccaaacgggaaatttaaaaatatcaggatggtccatcaggtgtatgcctcacagaatttaagagctgaactgataccatacttccggggtacagaacaactctcaccctcatacaagtaggaatagaaagcaagtgtaaaatacgggtcgtcttcgcctgtgatcgcacagtaatacgggcgttttgatctttttttttttttttttttttgagagggactctcgctctgtcgcccaggctggagtgcagtggcgcgatcttggctcactgcaaactccgcctcgcgggttcaagcgattctcttgcctcagcctcggcagtagctgggactacaggcgcgtgccaccgcgcccgggtaatttttttgtattttta

SEQ ID NO: 201553 - DNA, 343 bp, Homo sapiens
ctccacatcaaagaatcttgtgggttatttatttcttccaggcttttgcctatgttatcatttccagtcatagtcccacttcctcccacacagcaacataccataaaaccttcaattacttgcaagcccatcataaatttgctttttttcatgtcttatgtacttatagtctctaccacactgcatagtacttaatgttttcaccaatttttccacatgttaatattgtctcccaaagtggagttatcactttgtggaattataaattccttgaggttgaaaattatgtatttaagtggtagtatctaacatttaataaactctaattatatactatattcta

SEQ ID NO: 201554 - DNA, 487 bp, Homo sapiens
aaagctagctatacctttgaaataggaaatttgtagttagaaatgtttgtgttctctttgtttaaattgtagcttgtggtataacaaaacattcactcaacaaattttgtaaagaattggctgtatgcagatactaggaagatggcagtaatgaaacagacacaaatccctgctctcagagagataatattctaacaaaaacgtgtttgtaagtgtgcgcagaacccatttcatgatttctgcttggtttgtggactcgactgaggttgatgtgagcagttcctgtaaaggaccatccctatcccaggttgttcagagaattgttttccgtccaagccctctgagtggctcttgtgtttgtctaccctcttcctaattgtcgcttttaaatacctcatagaaatactctgtctccatatttcaacttggtcagcatgtgtacctgactagcagccagtcaaattttggtgctggtgacatgggtgtg

SEQ ID NO: 201555 - DNA, 622 bp, Homo sapiens
cagaggttgcagtgagccaagaccacgccactgcactccatcctgagcaacagagcaagactccatctccaaaaaataaaacaacaaaaaacaaaactattgatacaccttatgaaagtaaggtcttgctaaataatgaaggtctggctaaataataatggcatatccacttaaataagcaaaggaaatctgtataggctgatatgagaagctctgtatgtagatgaggaaccaaagtacatatgtgcatacatatatgctggcatatacctaggtttttttccaccttaattagatgatagaaatagtacttgttatcttgaaggagagagattgatacttaggcttttcatctttttgtactacatgactttagctatgtacatgtaatgtgagtacatcgtaaacatgtgaatgcagtttgaggtgcctgctgagagattccatcaggcggttgggatcatgtctgaaacttaatagaggggattgctgataacccagttagagtagatatacaatgcaaaaggacaagaatgcatcagtagaaacagagaactagtggatttataatagtggaacttttacaggtatgtgacttcatagaaaattacggtaggagaaa

SEQ ID NO: 201556 - DNA, 448 bp, Homo sapiens
  misc_feature (6)..(6): n is a, c, g, or t
ggcgantccaggaggttacaaaagatgcactcttctaccatcggacgtaatgaggaaccaaagtacatatgtgcatacatatatgctggcatatacctaggtttttttccaccttaattagatgatagaaatagtacttgttatcttgaaggagagagattgatacttaggcttttcatctttttgtactacatgactttagctatgtacatgtaatgtgagtacatcgtaaacatgtgaatgcagtttgaggtgcctgctgagagattccatcaggcggttgggatcatgtctgaaacttaatagaggggattgctgataacccagttagagtagatatacaatgcaaaaggacaagaatgcatcagtagaaacagagaactagtggatttataatagtggaacttttacaggtatgtgacttcatagaaaattacggtaggagaaa

SEQ ID NO: 201557 - DNA, 270 bp, Homo sapiens
cagcctccaagcctcagcttccattgagggagtagtggagtcctggagccaggcggagcagaggtgggcccactggtgccagaatccagtggtgtaaacctagtgaaaaactcattttgttaatgcagatgcattaaacttggattggaaactgtctctactaaaattacaaaaagagtatttaagtggtgcagattaaatataaccaagattgtggagatatttaaaacacgaaattaaaaatataatagatgcactgttgcaaattac

SEQ ID NO: 201558 - DNA, 526 bp, Homo sapiens
ttgatttcatgtggtgtgagactcactaacattgaattagtgatgaagttaaagagaggctttctctatccccatagaagatattttgtcacttaagaaataattgaactttatgttgcactgtactaacagattaaaactacccttttaaaatacaggaataaataagagttaaaataagagtttttatcatatagtctttatagccatgtactactgtgtgcatactagctaggtctacctggccaggtagacctaacacgccgcagcagggctctgtacagtccggcccggtggggaggagggagggaaggcaggcacacgaagacacaggtatgtcgggaagtgcacacaaaccgttgtctttccttttaggttaaagaagaaaaactttgtaatcaatatcccgctcataaagtaaaagtggaaaagaagaaacttgatagcttacatctggcgtatcggcatactcctctcccattacatatgcacagtatatcaggggaactgctaccgacaacagcag

SEQ ID NO: 201559 - DNA, 473 bp, Homo sapiens
gtggggagtgacagtctagtaaacacacgctatgcctactaacagttagccctaattgaatacctacgatgcgccagatgctattctaagagctttcatgtatgactgcgtttaatcttcacagcaaccctaggagctattatcatccttatttacagactaaagcacatcaaatgaaagaatagggcattatcaagtacatacaaccatcggggatgacacaaaggatgcactggttagctgaagaagccttctcagagggcataagagtaagactgagtctctaagcagatgcctgtaatcccggctactcgggaggccaaggcaggagaatcgcttcaacccgggaagtggaggttgcagtgagccgagatcgcaccactgcactccagcctgagtgacagggcgagactccctctcaaaaacaaaacaaaacaaacccatgttttgcatgtttaaactttttggtttac

SEQ ID NO: 201560 - DNA, 407 bp, Homo sapiens
cattttactataaagacacatgcacacgtatgtttattgcagcgctattcacaatagcacagagtaggaaccaacccaaatgcccaccaatgatagactggataaagaaaatgtggcaagaatactcaatggaatactatgcagccataaaaaggatgagttcatgtcctttgcagggacatggatgaaactggaaaccgtcattctcagcaaactaacacaggaatgaaaaaccaaacactgcatgtctcactcataagtgggagttgaacaatgagaacaaaccaccatggcacgtgtatacctatgtaacaaacctgccattctgcacatgtatcccagaacttaaaagtaaaatttttaaaaattaacaatagtaaaaagcttatagaataaagatatgaaga

SEQ ID NO: 201561 - DNA, 404 bp, Homo sapiens
ccgtaatgttgacattagcaagcttccaacaaaaaggttggcagccctagccatattttttcttttctgtctaggttattttagctgtggtcctgcttaataccagaggcatgaaccaaatagattttcacattgcttccaaatctatgaatatatatagagaaaagtttattcatgaaagagagaagggaggaaggaaagaaggaaaaaaggaaggaaggaagggaggggaggagggagagagggagggaaagaaaagagagaaaaagaagaaggaaggagaaagaaagtaaagtaagtccagggagcgagagaggggaggaaggaaggaaggaaaagaaagagaaagacggaaagaaaatgagaaagaaagaaagagagagaaaggaaggaaagagaaagaa

SEQ ID NO: 201562 - DNA, 463 bp, Homo sapiens
ctttaaccatttttgcacaggaatagcctctcactttttccaggccttgggcgatgccggcagggcaggggatgactgcctaatcattctgcctgtaatgcttctcccttaagaaggcaaaggactgcctcaaatcccaaggcaaataacgttatgcaatataaaatgaaaagaaaggtggcgggggtagggggcacggagaaagagtgaagccagaaagagctaaccacaagctgcagatacattcctctggttgggtttatggggaggatgggccagctggcttcccaagtgcacagagaagacgctccatgcatcttcactcccttgctaaggaactgctccaatccttggggtccttacaacctgctccttgactgtacttgcccttgacctccagggcattgaaccagggctggcggtcagatgggacggtgaatgcaaaggtagactccctactttc

SEQ ID NO: 201563 - DNA, 282 bp, Homo sapiens
gagaatagacagaatagaagcagaaagaaaagatattttattaaaagaatagatgagtttggtataggacaaaggaaatgaaaaaaagcaaaaaaataaaaagcgactgatattttgagtcttgctgattaagggaatgtgattaactttttaaaattccctttgagccttctgaattgaggggataaatatccatgtagaaatgtgtaaaaataatttaaccaaagatgaggtgagaggccaaggctctagaaatagatttgaaagttatgattgtatata

SEQ ID NO: 201564 - DNA, 115 bp, Homo sapiens
taacaaacatatttacactctaaatgagttaaattatttttataggacatattttaacaaaagtcatttcctgtcacaaacctctacaaaccttagcagttttaaagtttacatt

SEQ ID NO: 201565 - DNA, 421 bp, Homo sapiens
aagatcatacagctaggaaactgttgagtggcattagggtgggggacagaagacaccacaaaggggctgttcgtaactgggcttaacccttgatcctgtcaaattagtcccacctcccgcattcctcacagatgtaacattaaaagagttgagtgaaagttaacagaccatgtcctccctgagaacataccaggaaacagccacttctagaaagataggaagtaggagtgtggagaaaagcaatgcactccaagagctgcctgctgtcagtcagccttcacacttccacagcctagaccaagtaagggtccttagcaacccttcagtaaagcaagaacttgtcccatgggctggtggaagggactcccttccaccagcacattccgtcctgctcacacagaaacagctatatttattctac

SEQ ID NO: 201566 - DNA, 470 bp, Homo sapiens
acaagcataaattatttatgaaataataactcagatacagagattacttcctattggccttacatatgaatataaagaaatacatattatgaacatgagcatacttattttataattatgtaaatgtttgtgtaatgttatatataagtgcaataaagtcatgcttatacatggtttcaattcatgcttctaaaaaccactcaatgtagtcattatcatatgttaataaataatctctgaaaatgtgcttctagtagttgcacaatatcccatcataaagattgtcatgctgtttttaagtcatacttttgagtatataagttatatctgatatttttctgctacatatatactattataaatctaatagtagctgattttttgtcaacacatatgattgtttcctcacaatagtacaagagttggttgtaactttatttccttccaacatttatttaggttcagcgggt

SEQ ID NO: 201567 - DNA, 208 bp, Homo sapiens
tctgggggagaggatatagaggaggagaccccagggttttagggtccaggagttgcgtggtcagttgggcattcaccctggggcccttttttggcccaacacatcctgagatgagggtctttgtggtcagaaagagacgtccagcccaatgctggtccactcttagcaccagactgctttgccagggtgcaggtgagcatgcctgagc

SEQ ID NO: 201568 - DNA, 262 bp, Homo sapiens
tgttcacaaccgttaaaaagtgtgagtcatccatttaaaactgacttaatcaaagcttaatttgttatatttctcagtgtctgccttggacaaatctctgattttaccaaaagctgctatgttcaaaatccaacatcccatacataaagtgttgactaattagttctgtctgtgcagcagctctcacagccaaacctggcccatggttagaatgcattaagggtgagatatattttttaagctgccatgaggttggaaaaaa

SEQ ID NO: 201569 - DNA, 511 bp, Homo sapiens
tttttatatctctgcatttcaacccagtaatagtactactagtagtagtggtaagtggatgggtttactcaagatatttccagtcatatttttttcttacacatatttgaaagtattactatttttatttattttcaacttttattttaagttcaagggtacatgtgcaggatgtgcaggtttgttacataggtgcatgccatggtggtttgctgctctctagtcattttttttaaatgtatttcttgatcatttattttacacttgggagaacatgtttaatcaatattttcatgtaattccgatctgggaagtaaagcatctgttattaaggaaaaataattgactgcatcccaggacaatatgtttcagctgataaacgagctgcaccattgctataaagtaaagcgatattgttatgaaatatttacttaagaaatgtaagtactatacataagagctttttagataagatttacttttctatacatttttaaattataagatggag

SEQ ID NO: 201570 - DNA, 698 bp, Homo sapiens
  misc_feature (33)..(33): n is a, c, g, or t
  misc_feature (46)..(46): n is a, c, g, or t
ggacgaattgaaatgtgttgtgtatggtatcantgttgaggtagtngattagtctttattggcagcgtcagtacagactaatacactgggtgattaaatgtgtgtgtgtgtgtatgtgtatacatgtttgtgaaatatatatgtgtagccaatatatttttaaacacctggttataacattaaatttgcatagtcttttacgttgattttagtcattgtcacagttactgtattaaatattttctatcttacttctagctttcaagtaatggaaacacctccttttttcctgtggtggtctttctatcctagcagtttttttcctctccctataggtgataaaattgactcatataaccctatcttttaaaaaatgtttaattcttcttagccagttttaaatatcaccagaaaatttctgcttaactctaccgaaattatttactttctttctggttttgcatatctttcatcatcttaatttacagctctgacactcatcttatatttcttgcatttctagtttcttcgctaaggacctgctcctagggaaatgcattttcagaaattactccattttctaaactttgaagattatcctactttatataagcaccatcatcctttaaatttaattctggagtgtgttgctaaaatattaagtatgcaaaaattatattctttgtgaaaactatgtc

SEQ ID NO: 201571 - DNA, 732 bp, Homo sapiens
agctgggatttgaagccaggtctactgaattatgcaactccttccccaccaaatacacacacaagcacacacacacacaagcacacacacacacaaacacacacacacacttaaattccatgcccaagcctccccctcccccaagcatagtgagccatttcacaccttcaatttgggaccccttgtcctctcccaccacagcctggtaaacacctgcccacctatgtctcaaggcttagcttacgttattgtcaacagaaatctttctgaacacacaaatcactgccaccacccctcttctctctcctttctttctctcttccccagtgtagaatccgtcatactgtctgggttataagttccataaggagcagaattattttccttagaaagctctgaagtcccggtcaccagcacagttcctgacacagggaagacctgcagcaatcgtctgctgaatgaataaagaatgaattgactcttcctgcctctggctcttttagttctacacaccagttgttctcaatcaggagtggttttgctcctgtggggacgtttaacaatgtctggaaacaatttctgtcattactcatggggtgccactagcatctagtgggtaaaggtcaaggatgctgctaacttccttccatgcaggtatagcccctacagcaaagaattacctggcccaagatgccaacaataccaagagtgagagaccctgcctgctccaca

SEQ ID NO: 201572 - DNA, 330 bp, Homo sapiens
ttccctgagttctgtgagccgctccagcaaattaatcaacccaaagaggggatcatgggaacccaaacttgaatctggtcgatcagaagttttagaggcccagacttgcaactggtgtctgaaagtggaggtggtaggttgggggagcagttttggggactgtgtcagtggtatctgacacttatctcctggtagatagtttcagaattggaggacacgcagctggtgtccactgcagaattgattgtttgtttgtggggggggaagtgcccatttgatcacagaagcctttaatttgtgttgatttttgttgtgagaaaataagaaaag

SEQ ID NO: 201573 - DNA, 422 bp, Homo sapiens
cctcccaggccagactatcatttcaaatgaacttaagacagattatgctaatttgagagggaattaggatgaaaatagaaactctctgggtgtaattaacggcatagggaactaactagagcataagaagctggatacatttcttagagaattgtatttccaaataaactatgagctgccttaaaaatggttacatcagtaaaacaagcagcaggttataaaaaagggtgatatcagtaaatcaaccagcaggtctccatacttacaaagcagaaaatgagcctgcagcagggaaaaccacagagatttccacccacatcaacatagccgtggatgataattaacatgggtattttattaaaagccataaagctaatcctgagaagaatttttaaaaatatataattcatattagaagtatt

SEQ ID NO: 201574 - DNA, 755 bp, Homo sapiens
tgcttcatattgaaagtagcaaaaacactattggcgaaaacattgttataatttctagtcttattgcagtaagaatgctgtaaccacacaaattataaataggtgataagaaccataatgaaaaaaatgagaacaaatttgattcattcctaggccagataacattaaataaaaacagttaaatgtgtaaaatatgaaatatgaattaatatttgtaaacatctgcagacaactctttttataaaccttcttattgctgttaataaatataagaaagttatattaggaacattagctaagcttttgactatgaaaactgcctacattaaacatggatttatatagacccattttcctgcactgaaggcaaggcgcatctctgtgattctgaccagacatattcatattttcttaccctagaggaagtacatgggactgaattcttgaaaagagccatcaaattagggataatactaaattgatactgtgcaggtgttctccagtgatattctactgagaatgctaaggttctggtcaggaactataaatagcagattaccaaacactgctttttctgtgatgataaaagcctcataagtaacaaaaacaatgtttaatttagactcctgtaaacaggatgcaattagtgattttttttaattgggttcagtaacttccagtaacaaatgtagtcaacaccaaattagaatgtgagcttccttacaatttttgtacatagactactatcatctaat

SEQ ID NO: 201575 - DNA, 433 bp, Homo sapiens
aagagaaagtctttcaactatatgtaaaccagtaaaaaaagaaacaaaaatagtgtttttatagatttgagaagatactgcattcataagatgaaaagaaaatgccatgggaaattactgatccatattgtattttgtctaccttttattgtggcacttagtatattatgatttgtattgtaattgtttttagtcgtgtctgtcttagctcatgagactgtaaactcctggaagccaggaagatggtaatgacctgtaactgctgaatgaatttaaagtggatagccagttttctcttagcacgtcccttagaactcctttgagcagaacatttcaggtacggtagctcctgtgttctgactgtagattgtatttatgagctattgaagtttgctaagtttccagggtagagaaagtagcgatagagtcatcc

SEQ ID NO: 201576 - DNA, 314 bp, Homo sapiens
aaatcgtcccattccccagtggattcggatgaaaactggtaataaaatcaggtacaactccaagaggagacattggaaaagaaccaagctaggtctgtaaggaattgaacatgagatggcacacatatttatgctgtctaaaggtcacaatcatgttaccatatcaagctgaaaatgtcaccactatctggacagttggacatgtttttttgggaatatactttttctctctgaatctgttaggaactttctggttggctgggttccgtaataaatacatgagacctttcatttcaaaaaaaagaaaaataggc

SEQ ID NO: 201577 - DNA, 332 bp, Homo sapiens
tcttgttagctccatgttagagatgatacagcagcctcccagggatgttcattcacttgtctggtatcatgcagatagttaatggctgggccatattggagtccagggccttcagactctcaggctcatgctcccttctgccctgctgctgttttaatgaaaatcagccttgttctgaaccacagttttacaatgaagcttaagattaaactgaaaatgctcaagttctctgttagggcttcagattctatgtctatacttgtcttattaatggtaaaaataatgtaacaacattaaagaaaaattttgaagggtgaaacactgtttagact

SEQ ID NO: 201578 - DNA, 282 bp, Homo sapiens
tcttgttagctccatgttagagatgatacagcagcctcccagggatgttcattcacttgtctggtatcatgcagatagttaatggctgggccatattggagtccagggccttcagactctcaggctcatgctcccttctgccctgctgctgttttaatgaaaatcagccttgttctgaaccacagttttacaatgaagcttaagattaaactgaaaatgctcaagttctctgttagggcttcagattctatgtcagttttcgggatcctctagatcacctcg

SEQ ID NO: 201579 - DNA, 790 bp, Homo sapiens
cggcacgaggagctgggggaaaaacaaatccaccaccttgcctcgctttcagtctttcctcgtgactcactccttctgggaaggcaatgcctcggccaccttttgaccctaaatccagctggaactgagttcgccttgctggctgctgggctctgccttgatcatctgtctttcgggaggcagattggctgtgcatcatttcaaccgtctgcagtgacaagttttttagagcctctttgtttcatttagtacccaggccttggttaggaccttaaaggaagttaaaaccccagtggcaccttttatttagggatcgctggctcgcttggcctcagtcttctactcgcctttcccacgtccacctgacatcctgggacagttggcagaccttccctccatggctcaggtgggcaggaggcagagtcagcaggggtgttaagtcacttctacatctctgcgtggccgtcatcgctgctattctgcacatgtgttgccactggggaaaatgggacactatatagagggtgtcttctcccaccacactctgtgggggtgggagaacccacaccaaacgatcatcatgttggatttgcatcatggcacattgagaatgtgttcagtgggactgtggatactatggaacctttcccacagagtcctttgtaatgcctctgctaggatccagttcattgctcaaacacccatacatttttgccctttatatgcgaggattttattctgaaagctgtgttatctgtgctgcttttccaagacagagcaacaactacca

SEQ ID NO: 201580 - DNA, 358 bp, Homo sapiens
ggaatgggtactgctgattggttggggatggaatcacagggatatagaaaaacagtcctggtccttgcgtgctgagtctgcttctgggttggggccacagaggagtggctggtctgagaggggccattgggtagtcagaagtgcaaaagcctgaaaagacatctcaaaaggccagtcctgtgtactacaatagtgatgttatttacaggagtaattgaggatgttgcaaatttttgtgccctctggaataataactgctaatcatttaactgacctgcatcttagcagaattctggtccttcgcatcctcctgacctggtgtcctttcattagttttacaaaggcagtttagttttgg

SEQ ID NO: 201581 - DNA, 461 bp, Homo sapiens
agttgtgctggcaacactatttcttaacctgtgtggtggttacaaaggttttccttttattataacatttcattaatatgtatgtttatgttttatactctgtatagagcatggttttttgaaaaaaaattctttaaaaaagattttgacgcaagggcatttctcagagctccatttacagtaagtagtttagcaggggtttaagagcagggttttagagtcagctgcctttgatgtgaatcccagttcagccacttgttcactatatgtggtgaccttaggtgataaatttagcatctctgagcttcattttttcatttcaaagaaataagataaggctacgtatcacatagggttaacatgggatcaaatgagagaaagtggtatcttacataatgcttggtacacaataagcagtcaatactttttctctatttatttatttattgagatggagtctc

SEQ ID NO: 201582 - DNA, 198 bp, Homo sapiens
acgcgcacgcggtcaacaattctcgtgctagcctcctgagtagctgggactacaggcgcgtgccccaacagccgtggtaattttgtatattaaagagacgggtattgccatgttgcccagactggtctcaaactcctgggctcaagcaatcctcccacctcagcctccccaagtgctgagataacaggtgtgagccac

SEQ ID NO: 201583 - DNA, 147 bp, Homo sapiens
ttggaaaacttacatttgtcttatctgagttcctttcttgggaaaccaaccatcgggcctcctgaatgataccgggaactgagactttccagatcactgccactggacagtgaggtgcacctgctccttgttgaccaacttcttatc

SEQ ID NO: 201584 - DNA, 111 bp, Homo sapiens
atacaaatccaaccagtttaaaattcctccatgatccccccgtcctacacaataaagtacttctttgaatggaaaatgagatcttctaagacctggcccctatccaccact

SEQ ID NO: 201585 - DNA, 755 bp, Homo sapiens
gaatcatactatatgtgaccttttgtgtctagcttctttcaatagtgtgttttcaaggttcctctatgctgtattatgtatcagtacatcattccttgttatggccgaataatttctcattgtatggacagaccacatagaaatgcttctatggcatccaccaagttagtgttcgtatcatcttcctcctttatttcacgtctctggtggattacattatagatattctggtgttggaaaaccctttcattcctgaaatacacttgacttggttgtgatcattatgcatttgataaattgctagattggatttgctagtattgtatgtagaacattggtatctttctataaatgagcttagcctgtattttatttcttgtgctctcctcattagctctggtatagggtggtgttagcacagtaacatgtgtataagggaggaaatatttcttccttaaaagcctgatagaccctagccatagagtcgtaggatctggtcccttttggaaagtaggtctcgcctagcatttcagtttcctctctagttattggtttatccaatctttctacttcttcctgggtcagtctaatgtgcaggcagtaatgtgtacaaaacagcttgatgagatatcacaaaacaacacccaggtcaagaaatacaaaattgccaatattccaggaatctcactggtgattcctcccaatcactgcctatttcctttccaaagtaattattaccttaacttcagtgataa

SEQ ID NO: 201586 - DNA, 363 bp, Homo sapiens
tgggacagagtctcactcttttgcccagactggagtgcagtggtatgatcatggctcactgcagcctccacttgtcagacccaagcagtcctcccacctcagcctcctgagtagctgggactacaggtatagatcaccatgaccagcttatttttgcaattttttatagaggtggggtttcgccatgtctcccaggctggtcttgaactcctaggctgaatccatcctcctgccaaagtgctgggattacaggcgtgagccaccgcacccggcgttggtctcaaattcttatcctcaagtgatcctcctaccttgtcctctcgggcagtgagaaagttctgggcagtgctgggaggtccaagg

SEQ ID NO: 201587 - DNA, 170 bp, Homo sapiens
agggggcaacgtggcggggcccactttcccactgatgaggcgtcccgatccagccctttccttgccacctcgggtgcttgaatgtttttatctgtctccaccttaccacgagcaattgagctaattctacaagcaagagatatacaaacaccaagggcttcgtgacaaag

SEQ ID NO: 201588 - DNA, 701 bp, Homo sapiens
aaaaggtttgcactttcaagtactacagatctggtattagtctaattgaagataatatagaattctatttttgtctagcgttcattctactattaagctctaaaaggctagaactacatttcccattcaatacttcataagttattagaacaaaatacatgttgacgttaatataaaaatgaacattaggtgatttcatgtcctttccttgtttcaacaattaaaaaactacacatgcacaaaatgctcccgtataaaatactacaaacaggtgagataactagaagacaccagaaagttcatggaaaataacttacaacagctgagagaaactgcaggtcaaattattaaatcatatctcatgtctaaaacaatggaacctactggagagtttcccttcacagcagacaacagtctctcccaccacgggaaccctttttaaaagttctaccatagtaatgagtacaaagcaaagaacaggcaaccaagcacaactgcctaaaaatctgagaaaacaaacgcgcaagcatcaaaagaattcactcatgaaaaccagaagattcattacatttgggtgactgttcacatattatatattcttctactaataaaagaacaatatatgcagatgttttgttcatacacacaaacatacatatattcacacactaaaaatgcacatatacatttatctaaaaaac

SEQ ID NO: 201589 - DNA, 515 bp, Homo sapiens
cattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagggagctgctggctgagaaagagcctgaagtcttgcaggactcactggatagatggtattcgactccttcagtttatcttggactgactgacccatgccagccctgcagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatggtattcgactccttcaggttatcttgaactgcctgacttaggccagccctacagaagtgctgtttactcattggag

SEQ ID NO: 201590 - DNA, 479 bp, Homo sapiens
caggcataaaccaccacgcccagcctgatttctaattctggtatagtggggtggcggagagggttcggcttggtggtgactcccaggttgacaccaggaccttgggaggaggttgagggagctccatgtcagatggactcagatcacaaacacagtaggccccaggtctgcctgaggttctgaagtatcccagaacagcggacaataggtttttcatctctactagaagaaaaacaagcaaatctgaactgcctcagcaagggaggtgcttaagaaaaataacattttcaaatcaattgcagccagggccacatgcttgttccctccttcctgggaggacttgcagagctaccagatccttcctgtcttggagagggggccatgctttctggaagcagtgatgcttaaggaagcccaccaggtggcctcaagtgacatctgctgtgcccacagctgctgcttttttctttctttctttc

SEQ ID NO: 201591 - DNA, 145 bp, Homo sapiens
agaggggcccttttggtgcactcctagaggactcgacttttgtggcctcaactagctccagacttgctcccagggattgaggggggaaggaaaaacttccctgtcctatactacacaggcatccgaccttaacctgtgaggcccc

SEQ ID NO: 201592 - DNA, 652 bp, Homo sapiens
ccaaatgtcatgtgtttacatatgaatctattcacttctttatttttaaaattcttctgagaagtactttagaagtaatccctaaatttaaagtatttataacaaaaattttacatattctcaccagtttagagcattacccagaaggaattgtgactccatggtccaggggattagagttagtcattaggggtgggaatttcttctcagaacgaagttagagctctgtaaccatcttatgtgaccaagtagatgtttgagaaagatctggaattaacgtaatgaaggtgagtagcactgagaatgcccatagagtctgtagcttagatgggggtgggtgtcaccatgatcttagtgttgcactttttggaaactaggtttaggtgaggaatgaagtcacaatcccctaagaagggaataatgaataaactagttatatcagcttattactttagagtagaaaacagacctcatgcaggaatcattctgcatatgtggtgaagccttcttggtgagcagacaaacaaaaaagaaaattcactttttctaaaaaaatagcacatcagacctttgtagcctggagaactcattcttctctactttagaggtgtttctttttctaataactgggaagggctgtctctaaccggag

SEQ ID NO: 201593 - DNA, 555 bp, Homo sapiens
gcattgctcttgtgcactgaccctgtcttatttcatatttgaaaggattaagttggggacttgtaatacaattatttaacaaaagggttcttttcagcagatactgttaaagatatacacagaatagcaaaccccacttcctgcaaaggtgaattttacttttaatgtagttcttcatctcagatttgcacaagggctggtaaacttaaatattttcaccccaaaatgcctcctgagtatgaattagagatggagtgcttggagaaaatagttctgttctcacctctaacattcccttctatccccaaaacatgagactgccctggagaggaagtgttagctcattgaataggaagggaaatattttctccagtttgaaggtggggtggccggacctggttgcctaaccctcatcctgggagctctggaatcccgtgttaccaacccctgtgcttacttcctatgagacaccttgccctctgtctgtgaggttcctgatttctcttcttgaaacgatattatttcctgctagtctaaatgttctgcctgatttca

SEQ ID NO: 201594 - DNA, 338 bp, Homo sapiens
agaggcctcccctctacgtgcttcatgtaaatgtgtttatagttgatatccatcatctacaagtgaccaaggcacaatagtttcacctgatatgttagaaaatcccagtagagtttagaaatcatcatttctaaaggcaaattttaaaagatttctctcataagtaaatcaataaacaaatatttgtgcacactagtctttcaacagcaaaggataattttgggataaagaatgatgcaaacctggcaaaattgatatagtcagtttggctggctatgcataaactatcttccttatgtttagcacatctttaataattagaagtgacttcctatagc

SEQ ID NO: 201595 - DNA, 129 bp, Homo sapiens
gccaaaaatatttttcatataccaccacagtaatattaatataataaatactgtcaataaaatgttcttaaaagagaacacaaaacattacagtaagcaacatatgctgtttctactgtatgcccaaaa

SEQ ID NO: 201596 - DNA, 467 bp, Homo sapiens
agtcaagatccaagtctgttcagtgatatattgtctcccagttctataaagtgatgggtcagaaaattaccattgtgtgagtgtttaatctatgcccaacacagtgttaggtaatttgatgaaagtatttcatttaatcaccaagtgaccctttggagggatgtattattaaacacgctgttcagaaaaggacaccaaagctcagagaaggtctttgagaaccaaaatgtgagttcaatttcagtatgtctgactgtaaagatgttctttttagtctactaggtcatctcgccttttgaaaccagggatctaggccatacctggtctcatataggtattgccccagtggtatcagcctctacctcataggagaaggacccaggacaaacaaagcctccatcaccatttggaggaaccaaatcaagttctataatgcctagtccagtcccaacccctaataagattcc

SEQ ID NO: 201597 - DNA, 345 bp, Homo sapiens
ttgtaaacacctctgtacttgggccagccaaaaatgctctgtttagcaactatggtcctatagtcatagtgttaaattatttgtataggggaattaaatatctggaggattcaaattacagttgttactggaaataatttagagcatttcagaattggacataaatcaattattagaaagttattttaaaaagagtattgaattttctttttaacatagtgaatgaaaaaatgacaatagcaaattataattattggaaagtcacacaaatttagaagactcattggggtccttgaatttatgtcaaagtacttctataaactacttagtctaattctccctttt

SEQ ID NO: 201598 - DNA, 366 bp, Homo sapiens
tataatctagtgtatatatgtctgtatatataaatatgtaaatatatgtgtgtatacacacacacaccactagaaaagattaaaaataaagaatacattactcattcaataatagttgtcaaaagaaatgaaaaaagcagaatagaagcataaaatatgtaaataatagaaaaaaatgacaaaagataaaaataaaagttataaaaataaataaactctcaggttaggtaaaaatataaaatccaacttcatgctgtttataagaaacaactaaaatacagtgacatgtaaaaagcttaaagaaaaacaccagggaaagaaagaaagcggacatacaagaaagaaagcggagattatgctattaat

SEQ ID NO: 201599 - DNA, 243 bp, Homo sapiens
cattacactattctcaccagactcctaggcgacccagacaattataccctagccaaccccttaaacacccctccccacatcaagcccgaatgatatttccgatagtgatccggatctgaagtgatagaaaaggaggtcagagaggcagccaggggccaggtcatttaccgtagcttgtaagctatgttaagactttgggtctcatcccaaataatatgggaaaacatcagaaggtatagccaa

SEQ ID NO: 201600 - DNA, 217 bp, Homo sapiens
ctggctgtggagatgacttacaggacagatggagaccaagttaggttagaagtgcttaatattgggttgtactgtctgcattcaatatgaacttgtgtaaggtagttgtgaggttgtgttcaaggtttttcactatagcataaggaaaggaaaaaaacctaatataacaaacctcagatcttacctataaaattatgttatttgcaaggtaagaata

SEQ ID NO: 201601 - DNA, 196 bp, Homo sapiens
cacacagcttccttgcctctctaaactcaccgtttggtcatccccattggcaggcatctctactcttgtgacgcctagcttcaagtattcttctaaattggttaaaaatcacatcaaaaagctactaaaaggactggtgtaatttaaaaaaaaactaaggcagaaggctttgggaagagttagaagaatttggaag

SEQ ID NO: 201602 - DNA, 212 bp, Homo sapiens
cctgagccacagagtgaaactctcagaaaaaaaaaaaaaaaacagaaagaaaagaaaaaagaattgagtatcagttatccactttagatgactaactttccctcgttctcacctggccgattgttcaggtttctaattctcagtccctaacctttcggccttcctacctaccctactcttatttcctcatgtctccatccctctggctccct

SEQ ID NO: 201603 - DNA, 462 bp, Homo sapiens
  misc_feature (404)..(404): n is a, c, g, or t
  misc_feature (411)..(411): n is a, c, g, or t
  misc_feature (447)..(447): n is a, c, g, or t
  misc_feature (449)..(449): n is a, c, g, or t
cagtaaaattggtaccaactctacttagcatgtctgatagaattcagctgtgaatctatcttgtcctggactttattttgttggcaatttttaaaattactgtttcagtcttgctacttgttattgatatgttcagagtttctatttcttcctggtttaatttaagagaattgtatatttccagaaatttagccatctcttctagatgttttagtttgtgtgcatatagatgttcatagtagcctggaataatcttttgtatgtctgtaatatcaattgcaacagctctcatttcatttctaattgagttctctcttcttttcttggttaatttcactaatggtctatcaattttgttgatcttttcaagaaccagctttttgtttcatttatcttttgtggtntttgttncaatttcatttaattctactctaatctttgttatgntntgtcttctgctat

SEQ ID NO: 201604 - DNA, 338 bp, Homo sapiens
ggtagttgcaggtttagttttttaagaaactgacaaactgtttatgaaagtggctatagtacgctacagccccagtggcagtgtctgaacaacccagtttccccacagccttgtcggcatttggtggtgtcactattttctagtttagccatgctgaaaactgtatcatgatatttcgctgtggttttaatctgcatttccctaatggctaatgatgttgaacatcttttcatgtttatttgtcacctgtcttagtctgtttgggctgctataacaaaatatcatagaccgggtggcttaccaacaacagacttatattccttacagttctggaagct

SEQ ID NO: 201605 - DNA, 367 bp, Homo sapiens
tctcagagttttaatggggcacaccgtgtgctgggcattgacatagatgggaaaagcatgacctaaaataagggctggaagccaagactgggaggaagggcaaagggagcaggcagcctggcaccaggtaccagtgaggtgtctgctctttgtccccatcacctgtcagctaaggaattctgcatgtcatcagtgcaataaaatgtgatcgccagagtgaaaaccttgtaatagaccagctgtggcttctctcaacaccagtatgtccaaggaggatgcatttttattgcttttgtggtcttaacaaaaaagattcatgagcattgtataaaaggcatattaaaacaattcggtaaaaggatgaaag

SEQ ID NO: 201606 - DNA, 647 bp, Homo sapiens
gcaaatgctaataagcaaagcccagattactaaaccatttgaccacacgtgtagtagtgtttcagcccactcttttaagaagttttcagaaagccaatgagctaatagcttgaatatattacagtttgaccttcatttcagcaggacagacaaatcattgacaaaacggctgcaagaatatcagcccttttaataagttgtccagtaatatgatatttttatgattattcaatgaattgatttttatggaattggctttcagtgaatttatttatcagccagttttctgaagggcagcccaacactatatgccataaattttctttgctataattaacttcagacactctgtctcctatctttcctaatttcatctctctctctgccctgtttatatttattggatgctctggtatgtaattattagaattttccctttactttaaaaactgttctttcatctttgtgtgtatcattgattgatgaccccatcatgaccttaattgcaatttacaaacttacttgctacaaagttaggttaatgagattattcactatacaggtagattcaacataagtttccattatcatttttaaagccagtatcatccactaaacatcaatatgtcatgcgatgttttaggagc

SEQ ID NO: 201607 - DNA, 230 bp, Homo sapiens
agggtgacttggttaaaaagttcaagcacaaaggatgtagaagcaggtggatgtcatcagagaacagatgcggatctagtgagatgggtcctaccacccctggaatatgttcctgggagaggggtggtctgctagagtggactgggaatagtaatattgcatacttttgtaaattcacaaaaccctctgatctgtgatagaggaataaagggcagaggataaaccccaga

SEQ ID NO: 201608 - DNA, 266 bp, Homo sapiens
tccctcactggtgctcgagccgcacgccggtcaaatcctaatgtgagtggtaaacctgtgtttcactgtggtaacgttatagaagacccaatcacagtgactataggtaacctgcagtgtaagagaaatgctttattgggcggaagcttctgttctcagttgtgtcgctcagaagtgtgggtccctagacaccttattttcctgctttgtttccttcgagcgaaatggaagagggaagggactaacactcactttgcccgcggtgt

SEQ ID NO: 201609 - DNA, 466 bp, Homo sapiens
attagggtaagttgaggagtctttatttacaaggcactacatactcaggattgggcagggtgtagggaaatctcacaagatagcacaagactctaggactagcagcagcagagctgtcacctctcctagacctgaagccgttgttggggagagaggtttctcagagcccagaaaaaaagaaaaaaaaaaaaaacatcatgcagattttaatgccttgggaggagcagtggctttctcttaaggacagaatttgcctcgaaatgatactcagggaaaaagagatgaagggaatcaatactctgacccaagactctcccttctctgcagtggtttgctagtcctctccttggtcaaacccaaacagaaaaccatagggcataggagtctaatgatgtaatccaagtcagccccctggaaggtggaaaaagaagggaaaatggatctggatctggagggataccaaaaa

SEQ ID NO: 201610 - DNA, 426 bp, Homo sapiens
tgaatacacacacacacacacacacacacacacacacaatcttttatgaagagttatattttagtgtactatgtaagtgacagagaattagctttatacttatattggcccatactggaatgtgtattagaatatccatacacttacttaaaatttctgtaattcttaaacctctatcatagtgcttattatgttgattacttatttgaaaactggattaattgaatacagatgaaaggtaaaatgttcaggatggacactaactattaacttttaaggatacctaagaatgtttatgaaaaacatgttccatgctacaaatactagctcataataaaagagagggtggaaatcttgactttgttttctgggaaaaagtaattattagttctcattagtttaataagtcacatttttttaaaatag

SEQ ID NO: 201611 - DNA, 246 bp, Homo sapiens
tccaccttgatgtctctaatctggctcatctgatgtttgtctagtatctttccttaggtgtggcccatgagtgatgggctccctgagttcctgcgtacccgtatatctttcttttgtcctgacaggtaaatgatgtcttgcttgggaatagaacccttggagcgtgtagatgggataccacggtcttccagctcctattgcaggtgagaagtccactgtcaatttgattagtttttcttaaaactt

SEQ ID NO: 201612 - DNA, 613 bp, Homo sapiens
aaatgaaaagaaaaagggtctgtgaattcttcttccctctgcctctaactatatttattaccaaagccacctgtgttaatagttatttgagtattgtacaaaactcttttgtttaggtaaattcacacatgtatttgtataatttgtttttgttttcctttattcaaattatatgtagcctgtgagcatactctgactctgaagtttttttgttgttttttttttaacttatgttttgtaagttactattagtacaagtagagctgtatggtatgtcagtgatctactttgaccagtttaattaataattgtgaaaattagaaataatgttactgtgaataattcttcatttaagccattttaaacatgaatgaaatgtatgtttgttagtttattttgacggagtcttgctctgtcacccaggttggagggcagtggcgcagtcttagctcactgcaacctcctcctcccatattcaagcagttctcctgcctcaccctccagaacagctgggattgcaggcacatgggattacaggcatgtgccaccatccccggctaagttttgtatttttgtagatacagggttttgccatgttggtcagacgttggtt

SEQ ID NO: 201613 - DNA, 587 bp, Homo sapiens
ttaatagatatttacttagctcctattatgagtcagttgctatgttacgggctgaagatacaggagtaaaacaaagtttttaaaaactctgtctttatggagcttacattctaggagagtggttctcaacgaggtacaattttgcctcccaggggacaaatgacaatacatggagacattttttattgtcacaactgggtggtaaggagctattggcatctagcgtgtacaggccagggacgctgctaaacctacaatgcataggagagccactcaaaataaaggattatgtagcctgaagtgtcaacagtgccagtctgttctagagtgaagatgaaagagacagaatatgctatctatacaaataccttacacctagaactgcacatttctcaagagcagaaaatatgttttattcttcatatcccaaataccaactcaaataccaaccttagtaacttgccaacagcagatgattaataaattatgaataaaatagaaacaagacatttttctatattactattaatcatggcatagtacacaaagtcttcttataagatggacagggttcaaactaaactttt

SEQ ID NO: 201614 - DNA, 646 bp, Homo sapiens
ggaacggcatgggaaaagacagaagtttctgataatgtggcatgtatgggaaattgtaacctaactgtatacattaggtttctgataaggtttgtggttgaggaacttaagaccatatgagaaaattagattgggagttataaatgatttgcatgtatttttcccttctttaaagtaaaaatgtagcacattaaataaaggtaacatgccagtgactgacaataaattctataaggaattaattttctcttattcactctatttctagcctagtatttagcatatagtagatactcaaatgttagctgaatgaatgtgtcatgtatttcaaaatatttttagattttctcttcatcccttgtttgctagacatttttcagggtataacttttttcttttggatatagcttgtaaagatatacattactgaattctcaccccctcctcccttgttttttcactcatttaatttttgtttttttaatgactcaggtgtttccttctgggtcctccccatctttggtctttcatttcttcctttctttctttctctttatttagagagagggtcttgctctattgcccagactgcagtgcagtggtgcagtcatagctcactgcaacacagaactcctggactcaagtg

SEQ ID NO: 201615 - DNA, 191 bp, Homo sapiens
gtcggatatattaacttttgttcacaaactaattcctattaggctcatcttgattgttttcatggttctgggcaggcttctatcttgctgagtattatgctaagcttacttttactgccagacttagcatggtaagttgacagcatgctttgaaataaaaccaaaaacaaaaaaatgaaagaaacaaaagc

SEQ ID NO: 201616 - DNA, 352 bp, Homo sapiens
ttttttttttttagagacggagtctcgctctgtcgcccaggctagagtgcagtggcgcgatctcggctcactgcaagctccgcctcccgggttcacgccattctcctgcctcagcctcccgagtagctgggactacaggctcccgccaccacgcccagctaactttttgtatttttagtagagccgggatttcaccgtgttagccaggatggtctcgatctcctgacctcgtgatccgcccgccttggcctcccaaagtgctgggattacaggtgtgagccaccgcaccctgccggaaagacatttaaaaaacaagtaaagattcggccctagactgggacatggggcccac

SEQ ID NO: 201617 - DNA, 314 bp, Homo sapiens
gagaaattacttctgctgactttttttaaatatgaaaatttgaaacatatacagaagtagacaaaaacgtgtaatgagcccatcacccagctttaactgttaccagtttacagccagtcttgtttcatcgataaccccacccacttatcccctcttgttttatcttattttgaaaaaaagtcctagacatcatattatttaatccgtatttcagtatgtactctttaacaataaagtctctcatatgagtgcattaactttttttgttttgagacgatgtcttgccctgttgcccaggttggagtgcagtggca

SEQ ID NO: 201618 - DNA, 445 bp, Homo sapiens
ctgcccatcaggaaggtcaggctggaatttttggaaagaggcgcacctgccatccaccaggaaattttgttgtcttttgttctgctagaactaaatcagacacaccaaggttaactagcactatcttcctagcttgagaaacttgatggcaggcttgaataacacctgtatgaagccatcagagcaacaactagattaatgtctgctagaattaaatcaggcacaccaaggttaactagcactatcttcctagctcgagaaacttgatagcaggcttgaataacacttgtatgaaaccatcagagcaacacctagaatagtgtctgatttaataattgagactatggtctagccaaggagacacataaaacatgatttccatggttggttcatattttatatttattaatagaatctggctggtattataaacagctttgccaaa

SEQ ID NO: 201619 - DNA, 183 bp, Homo sapiens
tatatgtttatttcaaacattagagtcagtcacacactgcttcttggtttctcatcagtagatgatgtcattgcatctctgacagaaatgcttctgctctgaaagtgcagggagaggctgtgctattaaggccaactctgttttgttccacacactagagtgaggagaactcatttcagaatt

SEQ ID NO: 201620 - DNA, 406 bp, Homo sapiens
agcttcagagtttattctggcgctctgcatcactgctgctggtgagggcttgtcagcgcttctgtgcctcatctgcccccttgagaggctggagcccagctatcggttggctgcagaatggattctgatctgtgaagagcatatcttgggggtggggagcacacacctcacatggttttggagggttactctaaatgcagtcggaggcagcagaaggtggaatccagcagctgctgccttttcaaaataatgctttttaaacactttttcctttaaagtaattcattaaacgtgtttagagctcctttcttgtgaaccttttagagtgtttctatggaaaaataaaaccaaaggtacatttaaagatattttcttaaggtattgctaaaaaatccatttttgtgga

SEQ ID NO: 201621 - DNA, 441 bp, Homo sapiens
tctatttttttctatttgagaaaaaagataacagtatgaccgacataggtaatgagagattctgtaactcgtaacattatataactgagaaagatcattaactatgtaagtatatgcaggaatggatgagggggaatcacaccaaaaaatttaaataggcacctactatagggacagaataaatgagggaagacaggaaggaaggaggcaacaatgatgacaactttaccagtaaaaattcctagaatgaaaaaacccgtaatttttcaatttaatatttcagaggcagtgaaaaagtcactgaaaataacaaattagtagtctagaataaatatcatgtaagtaactccaaagaaaccaaaaatcattaataaaactgtaagaagacaaatctaaaaactctaatattaaaattacagaagtcacaggaagaataaaagg

SEQ ID NO: 201622 - DNA, 448 bp, Homo sapiens
gattaccatttctgttcatctactctgatgtggttccaagtgtttctgcaagtctaggagggtcttattacaatggccgagtgatgtggttaagaaatttggaaaaaatatattcacttcaatccaatgaattcttatgaagtgccaactctttagaacatatgtgtctgggctcagtagctcatgtgtgtaatcccaatattttgggaggccaaggagggtgcatcacttgaattcaggtgtttgagaccagcctgggcaaaatgacgaaaccccatctctacaaaaaaatacaaaaattagttgggcatggtagcacacctgtagtctcagctacgagggaggctgaggtgggaaaacagattgagcctgcgaggtcgaggctgcagtgagccacgatcgcaccactgcactccagcctaggcgacagagcgagactccgtctcaa

SEQ ID NO: 201623 - DNA, 434 bp, Homo sapiens
ttaagaaggagatgctgggggaagactggcaagaggaactctgcacatgaggctgaatgcacacatgactcttaggaaagtggtccagggctgagagctggcaccagctgcgtgagcctgaggaggctctgccagcagacaatgttcctatgggaatgcataagtcagggctctccagagagacagaaccaagaggagatacagacataaagagatttattttaagaaactggctcatgagattgtgggggctggcaagtccaaaatctacagggcaggcaggcaggctggaaactcaggcaggagttgaggctgcagctttgaggcagaatttcttctcctccaggaaacctcagttttttgttcaactgattggatgaggtccacccaaattatagagggtaatctccttgacttaaagtcaactaattgta

SEQ ID NO: 201624 - DNA, 735 bp, Homo sapiens
tcctccccagtcgtgacaagcaaaaatgacttcagacattcagacattgccaacttgcccacggcggagggagcaaaattagaatcacggaggtaaattttatagagagttggctggttctaagtggaaaactactctcttattgcatgaaggttaaatgcactcacatgtgacacacactcacattcataaacacacacacgatacaatgacaaaatccctaagacagagtggtcctcgtttctgatttttccacactttcatttgcctgatttgttgtaaatgcctctaaagtttgagcagaacatcaagggttccgttttcaaagtgacctcaactgcctccagcgtttcaggtgttgagctctagaagccaggatggaagttttcaggcagatacaactcccaggctttcattcagcttctataaaacaacagtgcacacaggcacatgcctcatcaccagtgtctgctgtgtgcacccaaaaaagaaagcagacgcagaaagatgattgaaaatgtattccatagggctctagggttgtcttgaaatgctctgttctgaaacactctataaaaattcctcacagattttcagtgactagaggcatggggctgtgggagggggtgctcagctgcactcttttattattgagctgattcaaaggaacagattttatgttgataaatgtacctgatactgactttaatgttcatggactgggtcttttctatc

SEQ ID NO: 201625 - DNA, 410 bp, Homo sapiens
tcaaaatatgacaaagaagtatattttggggtgaaatatttttctttccttcaccctgaaagcctaggaatctgcaatttagcaagctggtttgctaggagagtctgaagcacgttaaagtttgagaaccatttgttgaaactattcttctgctaaggtgttgtaacactcaggaggtttttcctgtctgactcactcccatgaggacaggatagggaaagagcaaggtcacaggggcttgaaatggtgtggcatagaaaactatgatacttcagcaggcccacagggtggaaggtaagaagtgtaaattgtaaagtaaggtctatagaggctgataagggatgtcccatggaaggccctttattgcaaatgtggactatggtctttatggctaacacagtgaaaaataa

SEQ ID NO: 201626 - DNA, 327 bp, Homo sapiens
  misc_feature (279)..(279): n is a, c, g, or t
atttaaaatttttcccctcaaaataaacagactcaaaattatacctgtggtaaatgagttttttaaacctgaaacctaactgcctgtgaaagactgttcacatgaggaattaaaatgcagcctcacaaaaggatagtcaaaaaagggaaaaaaatttagcatactcagcatcagaggtaaacttacagccattaacacataagtgtagcaaaacttaaaatttgttcagaagacccaaatttcacatgtcaaggaatatctttaattcctttcattcanaaattgactacatagttttctttgaggggaaaagaccctggggtaccg

SEQ ID NO: 201627 - DNA, 491 bp, Homo sapiens
gaaaattaaacgagacaaggtaatgaaatgttctggaattagatagtggtgatggttgcagaaccttgtgaatatactaaaaagcactgaattctacacattcaaggggtgagctttatggtatgatatttatatctcatttaaaaaattaaatgagacatatatagaatacctagcacaatgcctgacatagagtaaatacagatagcaacagctattactatctcattattatgtgttatccttatcatttttacaataatgatgattaaaaagatgacaactgttatctttaatagatctgacagcaatctctgtatcttagtaggacaaatacatctccatgtgcacattagtcaagaggaggagatgatcgggcagtttctgtatacatttagatcacagatgggattactagacaaggagctcatttggcatctacaggaggctcaggggatgctggcagctgggtcacctttccagaatgaatt

SEQ ID NO: 201628 - DNA, 366 bp, Homo sapiens
acatccaaatacatcgtctgtacaaggcggacgaactacaggtgacaagtgtagaataagccacaataactgataagcttaaagataaccagcacaatttcacaagagaaccagctcagcccaactaaaaattacttaatagcaattgacactgaagttgtattaagtgtataaattaggggatgaaactgaacaatcccaaggatgagaaattggtaaacataagagagctgactccatagggacatttaaggtagtggttctcaaccttgccgcacattcccaagtcccaaggctcaggcctcaccccagaaaagttaaatcaaaatctgttagggctggggactaggcataaggtttttttgt

SEQ ID NO: 201629 - DNA, 449 bp, Homo sapiens
attattgagcattttcttactttctgacaaaacaaaatatttcaaggtcatcttgaatttttctgacagcagtcctggtacaaccaccatgtcaaggaactctagcttcttttattggaagactgtgagatggtgtttggattgcttgacatcttattattgaactgttgaagtctggaagtgccttttctcaatgagtgtcctgtttatgtcagaaatgggtaaaagatgtggggagcaagcagctgtgacccaactcacccagaacaatgccaactgaccttggactctgagaagttacttagaatgaaccaggggtataatttatacctgatcttgacctcacatcttaaggatgagaagaggatatttgttataaacaataagctttcccattcagaaattactccttagtatctctactataaacaggtggaagacactttgca

SEQ ID NO: 201630 - DNA, 509 bp, Homo sapiens
ctcagcctcccaagtagctgagactatgggtgcgccactgcacccctgtgctcattttagagacggagtctctctttgttgcccaggccggtctcaaagtcctggcttcaagcaatctccccagctcagcctctccaagtgctgagattataagcatgagccgccacacctggcccctgtgctcatttttaagggacaatgttatacttaaatgtcatagctacgtgcagaatcagggtgtgacgaggtagaagtggaggcggcaaagtgcagaagtagcatatgattctttttgtcttgttccagaatttactttatagaaattactctcctaagcaattatgaattatacctcccttacgttctagaatagtaaaaaactgaggttgacaagaaaatctcccatattgtgtaagtcttttaaatcaccaataatctctttaagcattctgagtgtcagacttgagaaaaacagaaaatgatgacaggtctctgtgtacctagattta

SEQ ID NO: 201631 - DNA, 623 bp, Homo sapiens
gcacgagccacagggccctccctgactttgggataatgtaaattatttttcaaaagctacaactattctatgctaacaattttggggtttttcttttttcttcttctttttttgttttattgacacagagacctgctctgtttcccaggctggagtgcagtggcacaatcaatcatggctgactgcaaccttgaagtgatcctcctgcctcaggcctcctgagtcgctgaaactatagggatgtgccaccacgaccaactaattttttttttttttagacaggctctctgtccccgaggctggagtgcaatggcacagtctcagctcacttcaagctccacccaccatgctcaagcgattctcctgccttagcctcccaagtagctgggattacaggcacacacccccactgcccggctatttttgtatttttagtagagatgggttttcaccatgttggctaggctggtctcgaattcctgacctcaaatgttccacccaccttggcctcccaaagtgctgggattacaggcgtgatccaccgaccccggcctgattttttattttttgtagagatggggtgtcactaagttgcccaggttggtctcaaactcttgggctca

SEQ ID NO: 201632 - DNA, 416 bp, Homo sapiens
acaggcatgcgccatcacgcccggctaattttgtatttttagtagagacgggggggtttctccatgttggtcatgctggtctcaaacttctgacctctgacctcaggcgatctgcctgctcagcctcccaaagtgcagagagtataggcgagagccactgcacccggacttttttttgggacagagtccccattaaagtcattctcttaaatccatagtactcccctaaggtgtccccttagagagagtaaatgcttcagaaaaacagataaagtcaagaatactggcatcattcacgtgtctatttgaaagctgagaattttttaaaaatctcgccagtccaaagtaaacctatttgaaagtgaccactgagagttggcctcctgtctaaaggtttagctgtaagtaaacaatct

SEQ ID NO: 201633 - DNA, 452 bp, Homo sapiens
gccatcatcatttgaattccaaccagtggggagaagaaaggggaaaggaacagaccttcctttaaggatacttccaagaagttgttcatactacttcctttcatatcttgtggactggaagtcaatcacattacttgaaatatttcatgtttttattggaaaccatgagcccaatcaaaactcaaagttccattattctgtagataaaggaaagtggatattgagggacaacttgctgttaccgatgtcagctgaccactaaacactcatagcaaatgacactaaaagggtttctttggtggtatttttcttgagatttgaactcgcgttcaactaagtcaactaaacctcagatttggactgctctaggagtacttgggggtgaggggaattgaaaagcaaacagaaaagtataaaatcatccctcagtctctgataagagctttcaggca

SEQ ID NO: 201634 - DNA, 530 bp, Homo sapiens
aactctgagtaatcctatcatcctacaaatattttttgtgacataataaaccacgagacaagttgtgtgactagaatttcagcatggaattacctcattaataggcttacaatttgggaatattttagtacataagttaaaaacaaatcttaagcagaaaagattttttagttttttactcttctttctaccaatgttcaaaaaatttccaattaaggatgctttatcaaaatacacattccaaacattggttcctcattacctgcttccctgatgtttatcacttattttccatcataataatgggtaagagcttatcttagagtatcataaattttgttttaaagttgatggtagtacagaagagagatgcctgtttttctctcccctttgcactccaccttttacaggcatcttctactttggctccaattttttgacattcagaagatctcataagacaatgacattaaatactattagtagtttctgaccatggggattagttatctgcagttgccagcaccaca

SEQ ID NO: 201635 - DNA, 593 bp, Homo sapiens
  misc_feature (593)..(593): n is a, c, g, or t
agaactgagaaagcagccactcgaatcattttctgtgttctgggatttagaggaggaacactggttgagaaagggaatatttttaaggctcttgacacatattgcagatggcttttaaaaataattccttgagtaagtacttcagtaccaagcatttgattctttgtaattcttggtagtatggttattattgtgaaaaatataggttatttctatcatctgaagtgtttcttcttggagggtgggatgtggctagaatacagtatgattgtgaagtaataagactaattttgacatgtggtttgtggaactggtttcattacttatagtcacatttgaggctttacaatatttctcacagtatctactacactgccttgaatgtagttcaatgcatgttctctgaaggaatttgaacatccaacctgtagagtaaaaaggaataagagaacacttcgtaggaccctaaaatgaatttttatattcaatttgtacagaagaatggtgaaagaatggagaaaaaatgaaactgagagaccctaactgtcccatttccatctctcacacttataataaaattcctctttgagtcn

SEQ ID NO: 201636 - DNA, 433 bp, Homo sapiens
agactgagtcttgctctgtggcccaggctggagtgcagtggcttgatttcagctcactgcaacctccgcctcccaggttcaagcaattctgatgcctcagcctccttagtaactgggattacaggcacatgtcaccactcccagctaatttttgtatttttagtagagacgggggtttcaccatgttggccaggttggtctggaactcctgacctcaagtgatccacccgcctcgggctcccaaagtgctgggattataggcatgagcttccaggtgaagctgatggatgcagattcaagaacactctttgagaaccactagctagagcttggatttgaatgagccacacgtgtgaggcatggaggggcccatgctagggtcataaatatagtgggagatttgcctatgtcagttttagcattggtcgtgaga

SEQ ID NO: 201637 - DNA, 318 bp, Homo sapiens
aggcggggttggggcgtgtggtggttgcagttgaagaccagcttctgagcccctgcgtgtttggtgggaggggaacctctgagcgtagagtttcctgccacagtgcactggtgtggaaactgagatgctgtgaagtttctagagaagtggggggtgtgtggcaaattgtttctgaatcatgggaaatggtttatgatgcactgtcaatcattcttcacttaagtgtagtaaattttattgttattctggccacttcatattttggttttgtgaataaaaaaatatttcctggccgggcacagtggctcatgtttgtaa

SEQ ID NO: 201638 - DNA, 389 bp, Homo sapiens
ttctaccaatagtgcacagtttttccacatagtgcacagtttttccacatcctcatcaatgcttgttattttctatttcattgatagtagccatcctaataggtatgaggttatattagtccgttttcatgctgctgataaagatatacccaagactgggcaatttacaaaagaaagacgtttattggactcacagttccacatggctggggaggtctcacaatcatggtggaaggtgaaaatcacatctcatatggcggcagacaagagcttgtgcaaaaaaactcccatttttgaaactgtcagatattgtgacacttactcattatcatgagaacagcaagggaaggacttgtccccatgattcagttacctaccattgggtccct

SEQ ID NO: 201639 - DNA, 531 bp, Homo sapiens
gaatatgcaacatttttctttctgttcctggcttaagtttcatttaacgtaatgttctctatttccaaccacattattgcaaatgacaggacttcattcatttttatggtggaataataaaggacgtatttttgagaaatcaaactgagagagttttcagttcatttcagacaatcgacaaaagattgcatgttttacttgaagctctgaacagatccaaatccctcttgcagagtcacatagaaatatattctcttacagccttcaaagatatcagccctgctcctttattagttagcaatattttgagccagttcaacattaatattagtaaaaagtttagttatacttttcaagaagtagagaagttccattctctaaccttttctgctttagcctctgaagacttaaatacatagaaaacaaaacagaaatgaaattaagaaatgtttgaaatagggcaacccgctcgggtccccttccacactgtggaagcttttttcttccgctctttgcaataaatcttgctgc

SEQ ID NO: 201640 - DNA, 346 bp, Homo sapiens
catctgggtaaggcctcacaaactaggtaagctgaaggcacttgccagctctactacttcaatggcctgggaagggctgtgaagacactatcgcactgtccataagctcattcagccatctcacttctaggaatcttattaatgcttcctgtaaaagccccaatcattttccagtgcttcctgtagtctcccagcccttaaaagaggatgctatacagttagagagggtccaggcgtctccagaaacatccctttcttccatttctgcagaactcttctcctgatggtccaaacaacaccctgggacctctaacttgatgcacttcagaaatctatactctaggcc

SEQ ID NO: 201641 - DNA, 563 bp, Homo sapiens
gacatgaatgaggaagtactccaaagttttttacgtcttcctgaatggatataacattattaggttttctctctcttaagaggggatccacctcccaagtactccccaaatgcaccccttaactaggagcagggtgttattaatagttttctgattaaatgatatcatatcctctcaatgagattgagagaagtgccgtcatcatagtgcttcatctttgctgtctcagaatcaaaactgtgtccctcactctaaaaaagactgattatttgatcatctaatttttctcttttaaaaaattgccttccctggccgggcatggtggctcacgcctgtaatcccagcactttgggaggccgaggcgggatcacctgaggtcaggagtttgagaccagcctggccaacatggtgaaaccccgtctctactaaaaatacaaaaattagccagatgtggtggtgcacacctgtattcccagctactggggaggccgaggcaggagaatctcttgaacccaggaagcggaggttgcagtgagccacgatggcgccactgcactctagcc

SEQ ID NO: 201642 - DNA, 338 bp, Homo sapiens
ttttggtgtatctggacaatggcatattatgtaatatttaaaagcaatgtagaataatacatacatataaaactatatttgacttattaagtcaatcccaataaataaaatcccaaacaactggttgtccgcaatgagagatttaaatctctcattgcgcaaggaaaatattgccaccatttgtagaccacgtaaccttcaagtatgtgctactttttggtccctgtatctaactcaaatcaggaactgtattttttttaatgatttgcttttgaaacttgaagtcttgaaaacagtgtgatgcaattactgctgttctagcccccaatgagagattt

SEQ ID NO: 201643 - DNA, 503 bp, Homo sapiens
agagaataggagaatatatgaaaggtaaaataagctcactgattacttaatagatactggttgggaattaaagaatggtacttcaaattaaatgctggtggagaggaaaggtagaaatgtaagaaaaggttatcaggtaatttccatactgttcatagtaggggaccaacagaatatagcccaaaaaaagtatgaaggaagggagagtaatggtattatataaaggccttactctatagatacaatacaagccttcctaaataccaaaagataacctgaaaatagtatgcaaataagatagacaatatagtaaaagaatacacatgtacacatattaaacagatggattcaagggaccaaggacaaacaattatatccataattgcaaatgttcttaccttaactattaaaagaacaatattttcaaattgtttaacaaagcatagccaaacattatgctgtattcgagaaatatccaaataaaatttaacaagatttaagat

SEQ ID NO: 201644 - DNA, 492 bp, Homo sapiens
tggaagtatcggtaggttcaaaggactgcctgctcaaaacgacttgtctgcttttgcaacctaatcatgcaagtgtggtgcatgccaggaactctatgttaagtaaataacagtacagatgataagaggtggcgtgaaaaatcatgaaagtagaaagtgatggtgtcatagtgcgagataagctgggtttagataatgcctctgcaatttactactggtggggcttaggtgagttattttcatgatagtggataagtctcacaagatctgatggttttaaaaacgggagtttccctgcacaagctctctttctcttgcctgctgccatccgtgtaagatgtgattggttcctccttgccttctgccatgatcgtgaggcctccccagccatttggaatcgtaagtccattatacctcttttcttcccagtctcgggtatatctttatcagcagcctgaaaacgacctaatacacctacctatttcacaatcg

SEQ ID NO: 201645 - DNA, 198 bp, Homo sapiens
tcatctctattctgttttcggccttccaacatgtgaatgttaatcactataggaggaaggtgactattttctgatccaaaaatcatgatgtatggtctgattaaggatttttatgtatatatcatgcctttcaaaggtataaagggagaacttcagttacacatttaatgaattttctttattaaaagagaaaaattg

SEQ ID NO: 201646 - DNA, 518 bp, Homo sapiens
cattatactttgcaggaagaaaataataggcatttattctatagtaattgaatagacagatatagcaccttaaaaactaatgatagccattcatctctatgtatcatgtatctgtcaaagtaggaacaacttggcacagcccaaaaattagccaggtgtggtggcaggcacctgtaatcccagctgaggcctggaggctgagataggagaatcagttgaagcgagaggcagaggttgcagcgagtggagattgcgccactacactccagctgggatgatagaatgaaactccagctaaaaaaaaaaaattgtattctgagtctgactttgcctggacttaagtagatattaagaccaaaaaatttgctggctatgtgagtggcgtcaaacaaggtaagacctcagcagggagggtttcctttattctattaggttggtgcaaaagtaattgcataaacccaagttatgtcctattttagtgtggcaaagagggaccatgtcacctgatttggggctgg

SEQ ID NO: 201647 - DNA, 560 bp, Homo sapiens
taactgtttcttacttttagtgagaacttattattttgtaagaacagtccttttctgggtaggcgcggtggcttacgcctgtaatcccaacagtttgggaggctgaggcgggcagatcacttgaggtcaggaatttgaaaccagcctgcccaacatagtgaaaccccatctccactaaaaatacaaaaattagccaggtgtggtggcaggcacctgtaatcccagctgaggcctggaggctgagataggagaatcagttgaagcgagaggcagaggttgcagcgagtggagattgcgccactacactccagctgggatgatagaatgaaactccagctaaaaaaaaaaaattgtattctgagtctgactttgcctggacttaagtagatattaagaccaaaaaatttgctggctatgtgagtggcgtcaaacaaggtaagacctcagcagggagggtttcctttattctattaggttggtgcaaaagtaattgcataaacccaagttatgtcctattttagtgtggcaaagagggaccatgtcacctgatttggggctgg

SEQ ID NO: 201648 - DNA, 440 bp, Homo sapiens
tctgtaaatgggaattattatggagatgtagctttagagtaaattcctagaagaatgattgctggtcaaagagtaaatgcatatgtagttttattagatgttgtcaaatttccttccatatgagcagcacacaatcacttttaaaaggcacttttttggccgggggtggtggctcacgcctgtaatcccagcactttgggaggccagggcaggaggatcatgaggtcaggagatggagactattctggctaacagggtgaaaccctgtctctactaaaaaatacaaaaaattagccgggcgtgttggcgcatgcctgtagtcccagctactcaggaggctgaggcaggagaattgcttgaacctgggaggcagaggttgcagtgagctgagatcgcaccactacgcgccaggctgggcaatagagcgagacttcgtctca

SEQ ID NO: 201649 - DNA, 506 bp, Homo sapiens
gggcccagagaagggcatgtttggagcctggctgtgtcaccttggaaacttggggcacgtgtggagtgtgagtgagtgagctgctggaatgaactgaccagacaggacatcatctatgtatgggattagaatggaattacaggagaaaaccaaatccctcaaattagcattcaggatcggaaaaaaaaggcccatgctcttagaccaccaccaagaccttgtcttgtcctgcaccgagcaacctccgtgtcaccctgctccacctgctccatgaagccgcaccctccagagaggacccttcccctttccacccttcgcggaccactcaatgagctaccctgcacctgaccccttctgtccaagtcatcacagtattcccagagctggaacagtcaatgcctggcacatcgtgggcactcaacatgttgaatcaatggttacaaatacatgaatgtacttgttgaataaatggttataaataaatgaatgaatgatccccccccttc

SEQ ID NO: 201650 - DNA, 397 bp, Homo sapiens
tcccacctcagccgcttaagtagctgggaatacagtcacccgccaccatgcccagctttcagataggtctttgcagcacggcccatgctcttagaccaccaccaagaccttgtcttgtcctgcaccgagcaacctccgtgtcaccctgctccacctgctccatgaagccgcaccctccagagaggacccttcccctttccacccttcgcggaccactcaatgagctaccctgcacctgaccccttctgtccaagtcatcacagtattcccagagctggaacagtcaatgcctggcacatcgtgggcactcaacatgttgaatcaatggttacaaatacatgaatgtacttgttgaataaatggttataaataaatgaatgaatgatccccccccttc

SEQ ID NO: 201651 - DNA, 363 bp, Homo sapiens
gtccttaggtaacccttcttcctctgcatagtggaattcattgtgttctgggtatttatgtaacaattggtgcatgtagctgttcattagctataaatagttgcatctatatattttctctgagagattgtaagcctttggaaggtcaatacagtggcttatcattggtttactttataaatgctgaatttctacaaaatgccaggctctgcctcaatttacagttaccatcttggcagcacctaccacagtggttggcagatagtaattaaaatgagtctttaggtctgactttgagagtatcaaacctgttggcatcagataagaccatgcataaaatttcaaatgttgcaaatccagttg

SEQ ID NO: 201652 - DNA, 1899 bp, Homo sapiens
taaggtggggaataaggttaggggtaaggttaattctacaagttcaaagccagtagcccctgatgcgctgttggacgtgaactataaatttggctctgaggttcccaggcatggaagaatatctagatctgtacagagaggttgtgtgtgtgtttaacatttccataatgtacaatttcctctaagagtaaaggccatgaggaaatgcccgtggaagataaaggagaccatgtggtctgtggcaaccatggatacatttctttcccaacgcattctctgaggcactttggtaactctgcctctttgctctcagcattgtgttagaaaataaagccagcagacaaggattaaaccctcatgttgctgggttccttctagaaacaattggagggctaaccaagtcacctttggtggaaggcagtaaggtgagtcattgctgtggctggactgaataggatagccttagctgtaaaattgggctgatctttcaaatggactcatgcttgccgaatgactcacgctcctgtttacaaatcagctctgtgaagaaatgcagagtgggaggctctgcttgccagacggagaccttagacctccaggggtggagaacggagtacttcctctggtgctcggcttcccttcctgggggcagatctctcagcttctggttggtggctctcaaaatccagacacaaggtcagctgcagccagcgtgggccctggagtagctccagttatggggcagcaatggccccctctcattttgagagctcactttgcctgtggatggttttaatccatctggataaacttgaggcccatgggaataccatatactatggtaaccatgtacactgctctaaagatgtggctgctgttgtataactttttcctttatttttgtcaatttcctattttccagagtcttgcatacccactatgtctactgtgatagtgaacgtaaaaacatacaagatgttggtgttatcctcaatctcttattcttaatcctgaacaaattacatgaaaaaatcgttcatggagtttttcttcatataaaactttttacaatgaacataaagggcatagctatttctttttttttaaaaagaaacgtagaatattatttcttggttgtgaaatcgcccttcttggaccccaagttgttttttacagccctaaattctcttgtttatagagcctgtttatagagccatagacaggccaatgggtctctacagcaggcacctgcatgagttgactgggacctgagctatattccccctctgccatttactagcagtgtgaccttgggcatgctccttacagtctctgagtcagtttcctcctctgtgaaatgggcatgatactacctacctcataaggtaggggtgaggattaatggagtaagaggcacactcctgtccagggccccagacagagtaggccgtcagtaaactgtagcagctattgtgatagggtttgaaattcaaattaacgcatatttcttgagcacccaaggtgtgtgctgctggatctttcaaggggtccagaattggtagtatagttgcttttctcaaaagactgtcgcctggcagaggaaaaggtgttaaggtatgagtgaagacagatcagccagacatggtgccgcttgcctgagatctcaacactttgggaggccgagataggaggattgcctgagcccaggagttcaagaccagcctgagcaacatagcaagattctgcctccacaaaaaaataaaataaaaataaaaagattagctgagtgtggtggcgtgcacctgtagtcctaactgtttgggaggctgagacaggaggattgcttgagcccaggagtttaagtccagtccgggcaacatagcaagaccccatctctta

SEQ ID NO: 201653 - DNA, 418 bp, Homo sapiens
cctggcactggcttcactgctgcttttgataaggatgtttctacccttgagaggaattttaaccaatgggatttaaagggagtcataaaagaactggacttttaagtggaaacagttttttttttcttggtctatatacctcactaacagatagtcataaaaaaattttgcttaaatttttgtttatctagaaaataagttcattttcaaaaacttagaaagtacattgcaattttaaaaataaacatcacccaccattccacaacctagagggatctactttaaaatttcgtttttgagccaggtgcagtggctcacgtctgtaatcccagcaatttggatggccaaggcgggaggattgcttgaggccaggagtttgagaccagcctgggcaacatagtgagaccttgtctctaac

SEQ ID NO: 201654 - DNA, 264 bp, Homo sapiens
cgaactcctgacctcatgtgatccgcccgcatcagcctcccaaagtgctgggattataagcgtgaatcactgcacctggctagaaacatcttctaaagcctaatctttttttttttccttatataatttaggttgactatgtaaacccaaaacacatagggtagaaactcgtgaaaaatatttttgaggatatctttgcaaagtgttggggttacaggtgtgagccactgtgctgccttctttttaaaaaagtttttctggcca

SEQ ID NO: 201655 - DNA, 368 bp, Homo sapiens
ctcaatgctttagtaaagatattaaaaagaaataatactgggacttggagataagagaagtttggaatgataaatggggcttttgcatagttactcttaaacattaaagagaaagaattggacagtgatgactcaatgttagtaatggagttagacacattttcttgaagcaggttgtcaggcaagcattagcacagtggtcctttaggagatgaatttattgctttgggatgtgcctataccaatcatagacaaccaccatgacagtaggcattatgggaagtttgaccttagcgtgttttaagaaaaaacttgttctggaaatgaattaatttcctgtccagtagacacaaattctttttcttaaa

SEQ ID NO: 201656 - DNA, 813 bp, Homo sapiens
tctggaaacaggactcttctaaaaagcatgtaagggaacttgaagcagcatctcaatttgtgcaatatgataaagaaaaaaaactgtgggatccagaaaacaatacacaattacttttatttatggctaccagaacttcaggaaaccgactaatgtttgtgcacataatgtttttattatggatctatctggggcatattgaacatacagtgccctcaaaaatggtcagttttactcatgcccaatcccatatattttttagggtaatttttctggtccagttaagttagaccaggacattttcacttgacaaatctgagtaaacttctctggaaaaaattgtttttgaccattcgcctagaatgaatctctgggtaaggaagatgcatatagtcgtataatttactgtagttattttgacaccttttcttaacgacacaccacagatttattgctggatatttttttccttcctaagccacttgccatatagttctactcttctctagctctagggaggcttcctcatacagactaggtcaacagattccattccactggctcgtggatgggtttggctaccgagaagcagttaagagaagatcagaattatagggagcagggagtaggaaaaggtgaagaatttattttcctgcttccctgctgatcccctcccaggctcctacatgttggtcacatttctctaccaaatggtagttcctgtggggttcttgtaaattcaccttcctctttccatagagacaaaagctccctgctttcattcaccttcgagtactgcaaactttttttttt

SEQ ID NO: 201657 - DNA, 608 bp, Homo sapiens
  misc_feature (489)..(489): n is a, c, g, or t
  misc_feature (496)..(496): n is a, c, g, or t
  misc_feature (498)..(499): n is a, c, g, or t
  misc_feature (505)..(505): n is a, c, g, or t
  misc_feature (509)..(511): n is a, c, g, or t
  misc_feature (521)..(521): n is a, c, g, or t
  misc_feature (530)..(530): n is a, c, g, or t
  misc_feature (568)..(568): n is a, c, g, or t
tcctgcctcagcctcccaggtaactgggactagagacatgagccatcatgcccagctaatttttgtatttttagtagagatagggttttgccatgttggccgggctggtttcgaactcctgacctcagatgatccacctgcctcggcctcccagagtgttgggattacaggtgtgagccaccgtgcccagtgggtatgtatctttttttatctgtttgctttcaactcttttgtgtctttgaatctaaggtgtgtcttttgtaaatagcatatagttggatcttgatgtttcatccagtctgacattctctaccttttgattgaggtataaaaaccattcacttttaatatagttattgatctggttagatttgcctttttattatttcttttctatacattcttgtctattttgtggtctgtatcctctatgtagctagctctctgagcttccttaaaacaattaaatggtcaggtcatttctagatntccattngnnagtagntgcnnnctggaatatngtgtccctntgtgatgtcatggctcctttaacttttcatgttccttnaagtgctgtcctttgaagtcttgttgcttcaaatgctgtc

SEQ ID NO: 201658 - DNA, 589 bp, Homo sapiens
  misc_feature (470)..(470): n is a, c, g, or t
  misc_feature (477)..(477): n is a, c, g, or t
  misc_feature (479)..(480): n is a, c, g, or t
  misc_feature (486)..(486): n is a, c, g, or t
  misc_feature (490)..(492): n is a, c, g, or t
  misc_feature (502)..(502): n is a, c, g, or t
  misc_feature (511)..(511): n is a, c, g, or t
  misc_feature (549)..(549): n is a, c, g, or t
tcctgcctcagcctcccaggtaactgggactagagacatgagccatcatgcccagctaatttttgtatttttagtagagatagggttttgccatgttggccgggctggtttcgaactcctgacctcagatgatccacctgcctcggcctcccagagtgttgggattacaggtgtgagccaccgtgcccagtgggtatgtatctttttttatctgtttgctttcaactcttttgtgtctttgaatctaaggtgtgtcttttgtaaatagcatatagttggatcttgatgtttcatccagtctgacattctctaccttttgattgaggtataaaaaccattcacttttaatatagttattgatctggttagatttgcctttttattatttcttttctatacattcttgtctattttgtttctctgttcctccttgactgcctccttttatattaaatacatatttttagatntccattngnnagtagntgcnnnctggaatatngtgtccctntgtgatgtcatggctcctttaacttttcatgttccttnaagtgctgtcctttgaagtcttgttgcttcaaatgctgtc

SEQ ID NO: 201659 - DNA, 700 bp, Homo sapiens
agtgaagtgctggccggagggagattgacgagttgactaagttgaaattaagaatctctctttatcataaagactgcagttggcgccgggcaggagggcacactacagtgtatgtacgtacctcagccctcaccctgaatctaccaagagctcctgggaatcagtaagaaggctgccatgacgtccagcgtgtccctcacaggaaaggcctccacccagccagcaaatgcggcagggatgcctggctttgccaaagagtgaaagcctccccagtgggatctgccgtagcgcacaggggagcagacggagccgcggcgcagggcagcgggagcctcagccaccgctggagagagcggatgttctgaacgtttcccctggacgctgcctgccacaccagtggaagctgagctcatgctgtaggacctggctgttcacttgagtcagtcgagattcacagaagcacatacatgtgtccaccagaggcacagatgggtgccggtgtcacccccacttgccccagcccagacgtcctaggatgacaggtagggaagagtgaagaggccacatgatgcctggcggacagtccagacaggagggcaccccctttgtgttccttctttgaagcgtgggagcggccaagccggaggccatgaggaagtaggaggcagcctctaccttgggagggacaggtggacctggc

SEQ ID NO: 201660 - DNA, 769 bp, Homo sapiens
ccaggctggtcttgaactcctgacctcaagtgatctgcccgtcccaggcctcctaaagtgttgggattacaggcgtgagccattgtgcccggcaagagaggctttcttaatttcccttctcaacgacctgttaattaatcttcctcttcaaaccctgctattggtgaagccagtcgggtttcttactttgctcttttgccgagtcaggagccagctggaatgggttcagcttgtctttactctcccctgagtcacttcgagtttggttctactgatctacaggaagcttcttcccaccactgaattcaagggacagtcttcccatatgtctttaccagctctcgcaaatgaagacagagcctgtctatgtcattcagactggcctcaaactccagggctcaacaaagcctcctgcctcaacttccccagtagctgggactacaggtatatgctcagcttcaattatttttgtattagtttgccagggctgttataacaaagtgccaccaactgggtggcttagacaacagaaatttattgcttcacagttctggaggctggacgtccaaaatcaaggtgttggtagaattggttccttctgaggactgtgaggaaggaatctgttccaagcctctctccttggcttatggatgaccatcttctccctgttcctcttcagattgtctttcttctatgtatgtctgtgtcaaaatttcccctttttataagaatgccaggtgtattggattaaaagcccaccctactctag

SEQ ID NO: 201661 - DNA, 358 bp, Homo sapiens
ggctctgcatgctgatgctctgtgtctgaaatagaaatgctgacttctctgaagaggtcctagtgtcatccagataggtcaatgaaattaacagactatcacgttgggtaaccgactgctatagacgccatcactgttcgtacatgtgttagagagacatacacacaaacacatacacctcctttcttacatgcacgctgatcactaattcaaattcttacacatttagacaactatttttccccagagtagcctttctggatacttttttggttgtttgttgatgcagctcttaggatagtagcagaattaaagttgagctgagcatatgaaaaggatcagagtaccctgcaaagtg

SEQ ID NO: 201662 - DNA, 1026 bp, Homo sapiens
tattaacatctattaactcatttaatcctctcaacaaccacatgaagtcagtagattaccattcccatttcgtagatgaggaagcaaagaagtaactttctcaaggtcaactaccaggaagggtcacgtggatgtgggcttcggtctctctcaggactttggatccagtttacggtctcggagttcacagggctttttggagcccctggacctttgcccagccgcctggcttcctcctgggcccgaagacacctccatgagaggtgggaggtgcggccgtggctgtcgagggcaacccccaggagcctgagaggacgtggcgtgaaaccctgtgggttagagcgacccgcaccttccgtttcccggagccgcctgcgtgaatgttcttcccggctctgctgccccctggaggctagtggaggtaaatgcgtgaagtcggcgttttccctccttccgtttcccggagccgcctgcgtgaatgttcttcccggctctgctgccccctggaggctagtggaggtaaatgcgtgaagtcggcgttttccctccttccgtttcccggagccgcctgcgtgaatgttcttcccggctctgctgccccctggaggctagtggaggtaaatgcgtgaagtcggcgttttccctccttccgtttcccggagccgcctgcgtgaatgttcttcccggctctgctgccccctggaggctagtggaggtaaatgcgtgaagtcggcgttttccctccttccgtttcccggagccgcctgcgtgaatgttcttcccggctctgctgccccctggaggctagtggaggtaaatgcgtgaagtcggcgttttccctccttccgtgtcccggagccgcctgcgtgaactgtacttcccggctctgctggcccctggaggctagtgtgcggtcaactgcgtgaacgtcggcgttaccctccttccgtgtcccggaggcgcctgtgtgactgtacttcccggttctgctgggccctggtaggctactggaccgtacctgcgtga

SEQ ID NO: 201663 - DNA, 798 bp, Homo sapiens
ctagaggatccccagctctctctacctgaacctctctgtcttcctctgtttctctctccctttttctgtctacctctgtcactctgtttcttcctccctctctcccctcttctatttctgcctttttgtctctctctgtctctctgtccctctctctctccccatcctttctctcctcccatctcctcccatcagcactccctctggggaagccagctaccatatcctgagcagccttgtgtagcagcccatttgattggaaactgaggcctcttctgttggaacagccatgtgactgggcgtggcagcagaatctcaaccccagtccaggtttcccatggctgcatccataactgaaagcttgatgtttacttaatgggggaccctgttgtgggaagtcagggaccctgaatggagggaccaggtggagctgtggcagaggaacatgaattgtgaagatttcattttaatatggacatttatcagttcccaaataatacttttataatttcttatgcctgtctttactttaatctcttaatcctgttatcttcgtaagccgaggatgtatgtcacctcaggaccacgtgtgataattgtgttaactgtacaaattgattgtaaaacatgtatttgaacaatatgaaatcagagcaccttgaaaaagaacagaataacagcaatttttaggggacaagtgaagataaccacaggtctgactgcctgcacgggtcaggcaaaaatagccatactttttcttcttgcagagagcctataacagacgttcagtggagagat

SEQ ID NO: 201664 - DNA, 689 bp, Homo sapiens
ggccagagaaactgttctcaagagtgtgaattaggtggcagctactattttatggtacctcgctatccactttgtaagagtctccgagagcagagggagcacatcccctgacacctcgcacatgacagttgcttcatcagtgctggttgtgctcctgagaactcagcatggagagaggcctagtccccgctcccctgctcccaattgctctgtgactcattctcacggctcgcccttcaggttctcgttcttgaatttctcctgctccctcccactcccagtcctttgccatgtctcccctgtgcctggaacactttttgatgcaggtcacctccaggactctgccactttcaagttgagtgttccaggtaggtcactgaacccctctgagtttcagtgtctttatctgtaaagataaaaactagacataacctttggctgactgggagagttgggattggataaggcaagtactgagtccaaggcctggctctgagtccctgccccagggacagcagctcctgtgattttggttcatcatggtaggtccctccttctctctctcttcttgggaactgccaccatcctttctgttctttaacctgcttctccgccaataaaggcagagtggaacactctcttcctggctcctatttcctcgctgcctccaaagacaagcctgtcacctc

SEQ ID NO: 201665 - DNA, 378 bp, Homo sapiens
ctctcttttgcattaggcgcgttggagactctgactacagtgatggagaagaggacttttactacactgagatcaagctcaacacagactcagtggcagacgggctgagcagcctggccccggtctcaccttcccagtccctggcttcacctcctactttccccatcccagattcaagccgaacagaaactccttgtgccaaaacggagactaagttgatgacgccgttgagccgctcagctcccaccaccctctacctcgtgcacactgaccatgcttaccaggtgacttgcaggggactgtgagagcaatcactttgaccttgaccaaaaccaggggccatctggcctatgagtaaaagacaactcagtggaaaaa

SEQ ID NO: 201666 - DNA, 391 bp, Homo sapiens
agccatctccctaagatatgtggtttgtggcttgaaaagttttctaatgccttccctccctagaactaatgactcagaactgagaaagactgacacagagcttcatcttctgctggggctgcaaatgctctggagattgcccacgccctcttgcagccactgctagatgaagatgaaagcccactgcccagacggcatcagtatttcacctgctcagtattgcacagaaaagtcttggtttgacttacagcctgctcattgctggaaggtcacagcactgttttttgatggagttttgagtagtcattttttctagtgctttaaacagattaaaatgtggttttatgggtagtcatttcctagatgcttgtgaaaacaattctaatcctaa

SEQ ID NO: 201667 - DNA, 488 bp, Homo sapiens
cttactttttttattttgtgtagagactgggttttaccatgttgcctaggctggtcttgaaattctggactcaagcaatccacctgcttcagcctcccaaaacgctgggattacaagtgtaagcaaacatgcccggcccaaaattggtttttccacagagacgacaatctgaaattactactaattaaaatattttcccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctca

SEQ ID NO: 201668 - DNA, 374 bp, Homo sapiens
ttctggttcttttatttacagcctatttgtgtctttgaatataagtatgtatgtagtatatagacaacatatactttgatgatgttttattttaaattcaccctgccttttaactggagaatttaatccatttacatttaatgtaattactgataaagtaaggtttacatttgccattttgctatttgttttctatatgtcttatgcctgcctttgttcctctgtatcaggtggggtccttcagggaatccaccacacaagtgaaataatgacaattgtttgtgatgaggatttgcaaaacactccaactactttatttcagtgaacacaagactgcactgggaatatggggtattagttttcaaggctcctaa

SEQ ID NO: 201669 - DNA, 536 bp, Homo sapiens
cgtggggagccccagaaatgcaccggctctgggctgggctctggcagattcatatgaatgggagagtctctgtctggccagcccttctgttttgttttgttttgttttgttttgttttgttttgtgactgagtctcgctctgtcacccaggctggaatgtgttggtgtgatctcagctcactgaaacctctgcctcccgggttcaagcgatcctggtggctcagcctcctgaatagctgggattataggcgtgcgccaccacgcccggctaatttttgtattttcagtagagacagggttttgccatgttggccaggctggtctcaaactcctaacctcaagtgatcctcccgccttggcttcccaaagtgctgggattacaggcaagagcccccgcgcccagccccttctgtttttaagaaagataaacccctaacctctgaagagcttttgcagtgacatgggcatggacaccaccaggtctcgctgtgatgaggtgggtggaggcttctcccttcctcctccgccctttcttc

SEQ ID NO: 201670 - DNA, 574 bp, Homo sapiens
gaaaggtctgaaaactggatatgatttcatcaaaaaacataatgcaacatgacatttctttcattctgtacagagtggagaagaaaatacctgttaaaaaatattgcaatacaggaatatgaaatacagaacttctcttccttagaaaatttacaccagactaagactcttaagttattataacaaagttagactgatttattgaggatgaggttagtgcctggaaagtaatacagtgttacaaattagtttttttagatgctgtcaggttaggctggtggtgtgcgcccatagacccagctccttgggaggctgaggtgggaggatcctttgagtgcaggagtttcggtacagcctgggcaacacagtgagacccccatctgaaagccattttttaaaaatgttgtcttgaggagcggccaagatggccaaataggaacagctttggtcggcggcttccagcgaggacaatgcagaaggaggatgacttctgcatttccaactgaggtacccagttcatctcaatgggactggttaggcagcggatccaacccacagaaggcgagcagaagca

SEQ ID NO: 201671 - DNA, 272 bp, Homo sapiens
cagtatagtatagttgctagcatagctccaggttaggataagctgttggaacatgagattgacattccacctgttccttcaacacaggggcaaagtacagcatggttaagagtcggatttctaggccagacagacctggctaggaatcctaattctgccacttattagctatgtaacctcgagcaagttatttaacttctgtatgtgtgtttcttcatatgctaaatgaggataataatagataccttacagattttgtatgaagattaaat

SEQ ID NO: 201672 - DNA, 281 bp, Homo sapiens
aggattgcctcatttcacagatgagcactacaggcctagaaaggttaggagacttgtctaaagtcataaaactagttagtgcacagctgataccagaacaaaaatgtcccagttcctggtccaatgcagaggtaatagatatctaaatataataaaatatttctctggcccctggtcaaatgcagcaacaaaaggcctttggaatccctttttctccaatcaatgtcctgaaggtcctccctttcattttctctgcacaaaagttggggtggggtcttcaa

SEQ ID NO: 201673 - DNA, 293 bp, Homo sapiens
ccccacccccccaccccattgtcacttgctcacttggcatctttggtgacattaaccatgtaatgcgttgcagcaaattgctattgcctactcttttccccagcaaactgaaactcagctccatacatgtgtacagcttccttataacactgggttaatgcatagctgggttcccaattcactgttgatggagggttgggggtatgggaaaaacacaatgcaaatattttctgtgtttcattaaattaaaagtctagtgggacttggccataaggaagatttatggcaaactg

SEQ ID NO: 201674 - DNA, 492 bp, Homo sapiens
ctctaccaattccttgttttaaatgggaatacactgtgctgggtgccataaggatactaaagagttattaagatgtagtccctgctattagggggcttctaatctacctaagggcattataatttaaagggtaacatatatttattagtttaacgagagagatgcctataataaagaagggctaatcaaccagttcagggtaggagaaatatatctgaggcaattgtgatcaaataagaatttagaatgtaaataattgtaatggcacataataaagtaatgcagttgagtaaagtcctcacttaatgttgtggtggataggttcttggaaactgcaagtttaagcaaaacaacatgctatataacaaaactaattttaccatagactaattgatataaagaagagttaaattcttatagcatacagtatgtcatttcacttaaagttccagttttcacaaacctgttgatataaagtgaggtcttactgtc

SEQ ID NO: 201675 - DNA, 460 bp, Homo sapiens
cacacacacacacacacacacacacactaaacaggcatgttttgcaaagactcaaacagaaattgaacaactgaaacttaaataaatttaatatacagtgtatggtttaattattaaaccaagttaataacaacaggattagtgaactagaatactgagatgagtaaataaaagaactacagaaaaatgaaatgatcacaatacaaaaatgagtatacatgtacaaagaataaaatgaaatgaaatcaaatacattggtttcactagcttacatataaataacaaatcacattaataacaaatatttataaatttctgaaactgaatatcagatgggaacccttgaatgcagaagtgtattgtgattaatagtggcctaccaataaaaaatactcaacagaaataaaagtcaaactgcataacagcaaagaaaagaaaaaattttaaagccataagagag

SEQ ID NO: 201676 - DNA, 491 bp, Homo sapiens
  misc_feature (335)..(335): n is a, c, g, or t
tgagcttttggggagtcaggatgctggcccatgggtattaagtcaggtaaatcattaaagctcccactaacccattcttcctagtaggggcttgttgggaagtgagtaggcatggcacatgggtgagagtgccaggccagggagggtcagctcatgtgagtgccctgcgctgctttgggcttctttgctttgcttttttgccttaggcttcctgcctacctttctgaatttgggtcacccttgggatagtttgaaagggacattcatgtccattaactccaagggtcctcacaactgccctgtgatacaagttacagtgacctcatggtccaatnaaaaaatgactttgccaagatcacacactgagcctcccaccccaagacatgctgccagcctttccaggatgacattagagggtggaaggaacccagagcaggaggggccttccagccatggcccagccctccatttgacaaatggggaaattgagt

SEQ ID NO: 201677 - DNA, 604 bp, Homo sapiens
ggcgcggcaagatgctggatgggtccccgctggcgcgctggctggccgcggccttcgggctgacgctgctgctcgccgcgctgcgcccttcggccgcctacttcgggtaggtgccttcggcggccggcgcgcactggtgggcgggggcggcggggccggggcggggtcgtccggagtccccgaggcacccggggtggctggggccggggcgcggcggggccgccgggttgcctggcgctgtttgtttgcggcgcgcgcgtcgctccgtccgctgcgcggcacggctagagaggcgggtggacccgtccggcttgcgccgggccgcggtcctccgtgaccgcagagtcgtcgtcgtcgtagtcgccgccgtgagcaggactgcctcgcgcttagggactgggatcaggtcccgacttccttgggccgccgtgtccttgccaaaaggctggagcctgagtcctcagcccctggccatcgcccacctagcagcttccccccctttctcttctcgagaagttaatttaacaataacaaaaatacgtacaaaatccagatgttcctcgcgctgagccccaaacggagagagagagagaaagagagaaat

SEQ ID NO: 201678 - DNA, 1631 bp, Homo sapiens
ggcgcggcaagatgctggatgggtccccgctggcgcgctggctggccgcggccttcgggctgacgctgctgctcgccgcgctgcgcccttcggccgcctacttcgggctgacgggcagcgagcccctgaccatcctcccgctgaccctggagccagaggcggccgcccaggcgcactacaaggcctgcgaccggctgaagctggagcggaagcagcggcgcatgtgccgccgggacccgggcgtggcagagacgctggtggaggccgtgagcatgagtgcgctcgagtgccagttccagttccgctttgagcgctggaactgcacgctggagggccgctaccgggccagcctgctcaagcgaggcttcaaggagactgccttcctctatgccatctcctcggctggcctgacgcacgcactggccaaggcgtgcagcgcgggccgcatggagcgctgtacctgcgatgaggcacccgacctggagaaccgtgaggcctggcagtgggggggctgcggagacaaccttaagtacagcagcaagttcgtcaaggaattcctgggcagacggtcaagcaaggatctgcgagcccgtgtggacttccacaacaacctcgtgggtgtgaaggtgatcaaggctggggtggagaccacctgcaagtgccacggcgtgtcaggctcatgcacggtgcggacctgctggcggcagttggcgcctttccatgaggtgggcaagcatctgaagcacaagtatgagacggcactcaaggtgggcagcaccaccaatgaagctgccggcgaggcaggtgccatctccccaccacggggccgtgcctcgggggcaggtggcagcgacccgctgccccgcactccagagctggtgcacctggatgactcgcctagcttctgcctggctggccgcttctccccgggcaccgctggccgtaggtgccaccgtgagaagaactgcgagagcatctgctgtggccgcggccataacacacagagccgggtggtgacaaggccctgccagtgccaggtgcgttggtgctgctatgtggagtgcaggcagtgcacgcagcgtgaggaggtctacacctgcaagggctgagttcccaggccctgccagccctgctgcacagggtgcaggcattgcacacggtgtgaagggtctacacctgcacaggctgagttcctgggctcgaccagcccagctgcgtggggtacaggcattgcacacagtgtgaatgggtctacacctgcatgggctgagtccctgggctcagacctagcagcgtggggtagtccctgggctcagtcctagctgcatggggtgcaggcattgcacagagcatgaatgggcctacacctgccaaggctgaatccctgggcccagccagccctgctgcacatggcacaggcattgcacacggtgtgaggagtgtacacctgcaagggctgaggccctgggcccagtcagccctgctgctcagagtgcaggcattgcacatggtgtgagaaggtctacacctgcaagggacgagtccccgggcctggccaaccctgctgtgcagggtgagggccatgcatgctagtatgaggggtctacacctgcaaggactgagaggctttt

SEQ ID NO: 201679 - DNA, 310 bp, Homo sapiens
ttttgttcttctgaatcccattagcctcctagttctctgctctgaaccacagactcccctccctgttatctgggttagattgactgttggttgactgatgactgatggcattgatgtaaaaactgactgtgtggctgatccctgggagactgtatcgtttctttgtctcatactctctttgccttagtgacaaactgcttttaaggtttaatttgtgaacatttcgatgccttcatatgtattttttgctttaaaattggtatcattggatgattctgaattctaaactgagcccccagacactgaaagg

SEQ ID NO: 201680 - DNA, 674 bp, Homo sapiens
gtgtttgcatgacaacgaaaagcctaatggcgcatttctcagaacatattgccattattaagcaatgcatgactgtatattcaatgatgtttatttactgaatggattaatgatatcgcttgaggtatgaagtaacatatttgagaactccaaaaacaaaaacattctacaaaaatgtaaggcattgccattttttgtttagaatgcttcctcttaatctcttagcagcatttaacatagttgaccactttctccttaaaacacgatcttctcctggtttttgagacaccagtttctcctggttttcttcctacctcaagggcctctcctccttagcctccttcctggctgtttctctgctgactctgaccctggtccccttctcttaagtgccttcatggatagcactgaacaccatctatgtgccagatacttccaaatctgtatttttagcgctgacctcgccctaaaactccagactcatacatacagttacctgtctgacatctccacagggatgtctatagacttatttgttgtttgtattcttgtgtgtagtcttttttcttgtccaatattagaatctcctttcagagtttaggaagtgtcacactatgtaagaggctgcttctcatttgagaaatctaaaaggccagatatttgtttccccagca

SEQ ID NO: 201681 - DNA, 395 bp, Homo sapiens
aaacaggcagctaagggtaggaggcagggtatcagtcagcttgaaactgagtacctctggtatggcaaaaggaacctgatatatgtcatcctctgtaaatggctattcccaagaaagggaagccatccctgattctgtgggagaagcagccatatttaaccacaactacgttgccccatatgctcaaagtagcaagcatacttctcagatatagcttcaactatattgaagcttcacaaaaacaaaatctatagtatgttttggatttaatatgctttaactttttttttgttttttttgaaatggagtctcgctttgtcgcccaggctggagtgcagtggcgcggatctcagctcaccacaagctccgcctcccaggttcacaccattctcctg

SEQ ID NO: 201682 - DNA, 245 bp, Homo sapiens
acccaatgtgaaaatcatttcaagaacaaggtgaatacagacattttcaaaacaacaaaaactacgagcggcctcccaaagtgctgggattacgggcatgtgctactgcgcccagctgatttatttttattttttcttgctttggatttattttgttttgaatccaggggttgatagttatcattagttctggaaggttctcacccccatatatcttcttatattacctctgcttcatctacttt

SEQ ID NO: 201683 - DNA, 279 bp, Homo sapiens
aattatgcaagcttggggaacttcgtgaggaatatgaaagcttgagaaagctgagagaagaaaagttacaagaggaaaaaccctctgaagatcaaatccacaagctgttaccagaggatacagaaacagggaaaaggaaaatggatgaacagaaaaaaagagatgaaccattagtactgaaaacaaatctggaacgttgtcctgcacgtctctcagattcagagaatgaagaaccttctcgaggccagatgacacagacacatcgctcggcatttgttt

SEQ ID NO: 201684 - DNA, 360 bp, Homo sapiens
taattttataattattatgattcacccagttccacgggacaaaaataaggaagaactgggtaagtgtatatatccatcctgatgttctaaaagcattctaattcaggtttttttccatttccatattaaaattttcatctacaggattctataagaacatcacagtcaggagtgctcttttgtcttcctctccctttaattttgtaatacatgaaaaagtctctggggccaggcacggtggctcacgcctgtaattccagcactttgggaggccgaaactaaaaatcttaccaacaactagtaattctatatgatgcttttgctctaacctgaaattctaaataatgcctttgtttacac

SEQ ID NO: 201685 - DNA, 264 bp, Homo sapiens
atgaccttattttaaaccctcagggctaaggttccccttctgtcaaagaagagcagtaacagtacctttcttatcattgttttgaggattaaatcggataatgtatgtaaagtacttagcacagcactaaataaggcattaaataaaagacaaaacaaactgcctagcatcttgattacaactctatatagatatatgtacctataccaaccaacgatagaaagatcatgaagagatacagtcaaacagagtaagacttattat

SEQ ID NO: 201686 - DNA, 540 bp, Homo sapiens
aggttgacagtagcttatcgtgtaccctctttcctagcagcacatttgcactctattatgtgccaagcaataggactcagataccaagaagagtgagacagtcactagactaatatgcctcagtctagccaagatcaggaagtaaatgcaaaacctcactgtaacctttgaaagaaggacacacacacacacaaggggcaggagtggagcacagagaatgagaagctctgcctgggatgtttccacaaggcttcacagagagagcagcgcctgagcagggtcgcagagggcaaccaggcatttgcagggcaggtgaagagaacacacagcatgcacacagagactcaccaagtgaagcatgcagaagctgccaatcactcaaaatgctggggtgtaaaagacaaagcaggaggccaggcacggtggctcgagcctgtaatcccagcactttgggaggccaagaaaggcggatcacctgaggtcgggagtttgagaccagcctgaccaacatggagaaacccggtctgtactaataataca

SEQ ID NO: 201687 - DNA, 178 bp, Homo sapiens
agtcattttatccagagcctgccatgggcctccccatatgggtatcaggacatgaaaaagttgcagtcccttcccagaggctcttcctatctggacagttttgtaaatgacagttgatattataaaatagtgctttttatgggcacggaggccggtctcctagaagagagcacgtttg

SEQ ID NO: 201688 - DNA, 612 bp, Homo sapiens
ggtgtttgccactatgcctggttacagtctgtaatttctttctttttttgtgaatatctgttattttactcaggcagatgcttgtttgcaaattaagttgggatatattccctctttttctgttttctggaagagtttgtgtagaagtgttaatgctttttctttacatatttgatagcatttatcagtgatgtcatgtaggcctggagttctctttgtgggaaggttttaaactatgaactttatttaatagatctgagagtgtccaggttatctatgtcttcttgagcaagctttgattgtttgtattttcaaagaatgtgcccattttatctatattgttgaatttgttggcatgaagttattcatgatatatccttattattcttttaatacctgtaggatctgtactcttttatacttgatattggtaatttgtgtctttttctatttgtcttgatcaatctggctggtggattatccactttatttatctttatacttatttttaaaaagtcagcttggtttgattttctctattgttcatatagttcatggacttctgttcttttttttttttttttttgacagggtctttctttgtcacccagg

SEQ ID NO: 201689 - DNA, 385 bp, Homo sapiens
aatttgatcattaaatatgtctgtgtatttaagaaatgtcaaaaaccactattttagtctttaggactgaatatgtctcatgtgttacaggacaggattatgaatttgttgtttgcctgcctctgaactaactggcaagaatagtcaatgtcttttctacagtttatcaccctataggtcatcacaggtggaaatgtgcgtgcgtgtgtaaagcttagaactttaaaagtagaactttagaagtcctatgtctatctatatttatcttcaaaaagagacatagaaatggacgtaggaatcagtttggagagaggaaatgctgcttttaaaatgttgctgaatgttcagaaaaggcatgccaataaacttattttactggaaattc

SEQ ID NO: 201690 - DNA, 785 bp, Homo sapiens
tttgatgttccattccatccctgcccaccgccatcatcacaccccctcaccatcacccttaatgttaaacagaagtatatccaactcagatgtgaaatcacatccatcttctaattaaaaataaagcagctgtgaaataatgatattctttcaaaataagaaaatggtgattagagcagagctgattgggttgagggaaagcaggttacttaattatggttattgtgtgtctgaatttttatggaaagaaaggaagtattgtttaggacgatgaaccctccaaaacatagaggggtggcattgtgtagaagtactctgggttgtgtctttgtcttttcagctgcttgtcttgggtcaccagtcttgcctattagcatgtgacgttgatgagaacttagcatgattcaaaaagctaagccaccaagacgatgggtagtgtttgatttggagtgggttttatgactactgatcatttcaacttcaaaacaaccagagctcatattctttagagagcaatacattttttttgacaagtaatgtcaatagtggtgagggaaacataataggttgtttagtgtccatgatttcattcatttattttttcctgcttatctctgcaattcctgctcctcctcgtccctggaacagtcttttcctttgtgtccactcacaagctcctactgtttatcccccatagccatcttgagcatagaaatcagctcccctcactccagttctctgttaaattgtttaccttttccttgatgctgcatgatacctgtctg

SEQ ID NO: 201691 - DNA, 246 bp, Homo sapiens
gtgttcaagtctagattagattaacaaaaacatcaaacagagtttcaaggaggagggagcagtcagtagtattacatgttaaatgagacaagtaagaagaatgaaaatgttcattggatgtagtaacaaggaagaggttaagttttgtggggaggaagctagattgtggtgcattgaggagtgaatggaagatgaagtggaaatcgcattttacgatttttttttgtgaagtttagcttgaaggga

SEQ ID NO: 201692 - DNA, 524 bp, Homo sapiens
tattttgtttaatttttggtctccacattagaatgtaagttccatgaggacaaggatttgggtctgttttgttcttggctgtatcctcattgcctagggaagtgcctagcacttagtaagtcctcagtaaatatatgaatgacttaatgaacaaatgaatctttccctgcagggcagctctacattctgtattttggtataaaaattggcttagttagaaatggctactcacacacaactcaccccttggctcaagccccacgtctgtactctgcaaaaggcctgcagccactgaatggttgggcacgaaggcaggtttccaaacttaatagagtggtgccctttttgaaggaaacaagacatcaaaagcctctgtagtacactcggagtcctcatgttgagaaactttagctaatgttgtatatttaccctaagaccatcttccatttgacaccaaaaaaagaggtaactggtaagcatttttaaagattatcactaaaataaaagtaaatttaaaaatcttt

SEQ ID NO: 201693 - DNA, 405 bp, Homo sapiens
atcaagcaaaatgaggactaaaagtatccactagaattgactaaatcccttggatcgattgactgtagcaggaagaaccgcagacaaaacccctcagacaccaggttaaagaaggaaggggtttattcggccaggagcatcggcaagactcctgtctcaagagccgagcaacccgagcgagcaattcctgtcccttttaagggctcacaactctaagggggtctgcatgagaggatcgtgattgattgagcaagcaaggggtacgtgactgggggctgcgtacaccactaattagaaaggaaccgaactggacaggggtcttcacggtgtctttttttttttttttttttttgagacagagtctcgctttgttgcccaggccagagtgcagtggcgagatctctg

SEQ ID NO: 201694 - DNA, 344 bp, Homo sapiens
gccatctagcatctatttctagccttctccattccatcaaactcccagaccccccacacttccttcagcaggtgacgtaatctcttacttcaggaagagaggcagcccactgttatgctataatcccacaccaactttcttttccctttccccatttgaccctggaagaggtttccttccttcaccctgacactgggccagtcaccctcccaccccctgaggcatcacagggactctctgctggctcatccccccatttccccacaacatcattttcaacctactacatgttcttccacattgaaataatcttcccttgaccctcatctcttttctgtgatcac

SEQ ID NO: 201695 - DNA, 359 bp, Homo sapiens
caggaaatgcagcataactagccaaagggaataatgtgatagtttcccattacttttaaaatagttttctcagctgggcatggtgcctcatgcctgcaatcccagccctttgggaggcagacataggaagatcacttgaggccaggagttcaaaatcaggctaatccacacagtgagacttcgtctctacaaaagaaaaattaaaaaattagctgggtgtggtggtgcatacctgtagtaccagctactggggaggctgagtcaggaggatcgcttgagcctgggagtttgaggctgcagtgagtaatgatcacatcactgcactacagcctgggtgacagagtaagactcagtctgaa

SEQ ID NO: 201696 - DNA, 468 bp, Homo sapiens
agaagaaggagccgtattgcacaatgaactaccaatcatcaatccaggctctcctgtcgcttccctacatcctctaccctctccaaacttctcccctctcttgacttagcacctccgaaaaggtacatcttggcttaaggaagggagcttctgacttaagccttgtaaaaatgtgctgagggatttgtttctgtggcctcctttttgagctgagaagactcacaagtgatgtgaatggcaaagcttggcttgaagctgttcccttgtgcctctgtcacttcaaggcctgggacccgattcgatctaagccagttcggtctggcttcccctgaccatatgggtgttgggtaagaaagagctatgaggaaggtcatagaaagagtcatgaagaaagatttgcacagcccatcaggacccagggagctttgcatcttgaagaaaaataaagcacactgaaatactgaatta

SEQ ID NO: 201697 - DNA, 328 bp, Homo sapiens
aggaatataaaatggtctcagtaagtattgtatgtgcagtgtcttgctgagattacatcttaataaaaactgttgaactgttcattaaattttcattaaagttctgtctagatggccaggcactgtggctcatgcctgtaatcccagtgctttgggaggccaaggcgggagggcccaaggccaggagttcaagaccagcctaggcaacatgacaagacctccatctctacaaaaaatgaaactaagaagttctgaataggaatgaaagggtggtaggtgctaggagtttgctgcttcttgaaccatagcactttgctaagtttaaaaa

SEQ ID NO: 201698 - DNA, 413 bp, Homo sapiens
gctgggcagggttaaggcctccccatggcctggactgccaggttctctgatgggaatgtatatcccagaggcagtttattcccctgtcatactctcaggactcctagttttttgactggctcacggtgtaggctgcagcccactgcttctttcaaacgtgtgatttctttcagttttcctgttaagttcctgtgttgcttcttggaaaaaagttcacaatgtgaatctcttcttactattttgtctttccaagtgggagaggtatgctaacaatgacttcaatctgctgtcttgaaaaaaaaaatatgtgtgtgtgtgtgtatatatatatatatatatatatatatatatatatatatataaaccttaacataggtatgcatgtataagaataaacatagcataaatagtgt

SEQ ID NO: 201699 - DNA, 476 bp, Homo sapiens
ctgtaatactgtgcttatttatgtaggaactgtgatctcgtctcctccttttcccatctccccctctctaccttagtttttccttatagtctcaagctgaaaacaatgaccaggtgcctaagagataagaatactctttcttttgaactcatggcattagcagtgacctggatgagattggaggctattattctaagtgaaatagctcaggaatggaaaaccaagcattgtatgttcttacttataagtgggagctaagctatgaggatacaaaggcataagaatgacacaacagactttggagacttggggaaagggtgggaagggggtgagggataaaagactacaaatagggtgcagtgtatactgcttgggtggtgggtgcaccaaaatctcacaaatcaccaccaaagaacttactcatgtaaccaaacaccacctgttccccagtaacctatggatataaaaaaattaaa

SEQ ID NO: 201700 - DNA, 394 bp, Homo sapiens
gttcgcaatgaggattagaggccctcacatgcacctttcacccactaagttgacacagtttgaggaagtgaattttagtaacacaggtggagggcctaggtggggatacaaacattctcatgcatcgctaggggatgtcaatcgatacagcttgttttggaggtaaaaatctgatattggattttagtttgtcgtaccttctgacccagaaattctgcttctaaaaatctattctaacaaaatgaagtatgtatgcaaagatttagccagaaggacattcatcataaccttatgtataatagcaaaataaaacagtaacatccaaatactcaagacagaaagctattttactaaatattggagagggagaccctgtctcaaaaaaaataaaatt

SEQ ID NO: 201701 - DNA, 429 bp, Homo sapiens
gaaagatgcaaatgtaacccaagacgtttatacccagcccacacatttctgaacaggcaaaactcaaggaatgttgctcttgtgagctcctcctaaggaaaatactcaaaggtgaagctcagccatccaggatgggagcccaagctaatagtctggcacagcagagctcccgggatggctgagcaagggctcccacgcctgcgctcagtgtagaactcacgcctttcataccctgggggaccattccaatgcccccttctctatacaagaaatgattttcagttaataaccatgttctcattaataattattttcttcattacttaattttaaaacaaaaaattaacttcaaattttaaaaatattattcaatcaaatgaaatatttcatgtaccaattaaaagttatactgattaaaaaaaactacac

SEQ ID NO: 201702 - DNA, 368 bp, Homo sapiens
taatagagcaggctaatagaggaaaacctggagacagactacctgggttcaaattctagctttgctatttatagctgtatgttattggatactctctgtgtcttagtttcttcatttggaaaatgggaatagtaatagtattaaaatcataaggttgttgttaaagactaaatgaattattacaatgcttggtatatgaagagctaggtcaacaaatgtaaggtattttcacaaagaagataatctagtttggatgggtcaggaatggcttcagtgaatgccagacatttgaccatcagtattcattaggtggatgaggtcagaataaagatgagagagggaaatagtacatttaaaggcataggaac

SEQ ID NO: 201703 - DNA, 312 bp, Homo sapiens
acctctcaaggtgctgggattacaggcatgagccaccacgctcagcctttgaataggtcatagatttcttaatttcatttattgtatttttaacttttagaatgtctgtttgctctttttagagtttctatttctcttaaatttgatattgcatctaatttgtacatcttttcctgtgtatttaaaaattgccattttaaagttcttttctgctataatagttctaacatctgtggttctgctgtgtgggttttcttttgattgttttcctcttatgttatcctacttctttacatgtcttaaattttttat

SEQ ID NO: 201704 - DNA, 675 bp, Homo sapiens
tgggagaactgcttgaggcctggagtttgagaccagcctgggcaacagcaagatcctgtgcctgtgaaaattaaaaaaagaaaccacacacaaaaaaactggcttagtggcacactccctgtagtcctagctacttgggaggctgaggtgggagaattgcttgagcccagcagttcgaggctgaagtgagctgtaatcatgccactgtactacagcctgggtgacaaagtaagataccctatctctaacaacaaaaaaagttccacgattgatttcctctgatgtttctaatgataatggagaaatttaaaaattctttcttggtcattttttagaatgatattacctgatcctcttttaaaaaaatcttttcatggccaggcacggtggctcagactgggtgccatggctcatgcctataatcccagcactttgggaggccgaggtgggcagatcacgaggtcaggagttcgagaccagcctggccaacatggtgaaaccccgtatctactaaagatacaaaaaattagctgggcatagtggcacacacctgtagtcccagctacttgggaggctgaggcaggagaatcgcttgaacctgggaagcggaggttgcagtgagccgagatcctgccacagcactccagtctgggtgacagggcgatattccgtctc

SEQ ID NO: 201705 - DNA, 474 bp, Homo sapiens
agaatatttaaatatcctgatcaattttttttttactatcaatgaagtggaatgtaataaaaatgtgagggcattttaatagtataatctttattcaaaaaacataatatggtgaagtaacctcattaactattagctgtatgctttccaacccattaccgttttcctgctttttaagtaattttcctcatcaggtagaatgattgcctttagggaagctagtccttgtcaagaactgtgaagggcccgcggtgttagcctgcatgcaagctgacaagttagccttctcaactttcatacaagctggcagaagacacatgaagggtccaggcaaagcaggcagcatgaattgtgtgttcacgtgggctccccttgtccacccctgaatcccaaaagtaatgcaaagtaggccaacttaatggtgtgcatgtactggatttgcatgacaactgagagaccttgagtgtaagaaac

SEQ ID NO: 201706 - DNA, 428 bp, Homo sapiens
tttacactaccgagtcagtatttttttattaaaaataatagcagaggttttgtgcattcctgctgcttcacgagccatctgtcacagacaccttgggcaaagaagcttcaaaatgcatgaggagcactgatcagctgcaaaaaagaaagaaagaaagaaagaaagaaagaaagaaagaaagaaagaaaaagaaaaagaaaaaatccaagaaagagcttgtctcttgtttttagacagatgagttttagcatctcatctagcatttcccctagtagggaccatttttacaagtaatttaattgatcttattaggcttggtacaggaatcagttatctttatggttacagtcagccaataggcaaagctagggagtctgaaattggaagcagcacagtaaagctaagcaaaatcctggagaattattgaa

SEQ ID NO: 201707 - DNA, 769 bp, Homo sapiens
ttctcttgaaaacaatgagagagataagccttatcagtatgataaagacgaacatttcaacctttaaatcgagagcatttcccaggggagaattatagatgaaagaatctgtaaaaaactgcagagcatgaatttaagaatcaatctccttaaagaaaataagattacaaagagctagattcatttcttaccacactagtaaaatgattataggaagtaattctgtatctaaactcatccattctttcaacaaatgctttttaagtatccattgtgtgtcatgcactgctctaggaatcaggcatacaataatgtcaagggaacctacataataaaaggaagatggggagaaaaaagtgtcagatagctcagtaagcaccagaaaagcaggatgagtgggttgaaaattacagaatatgttattttagaagggctaaccaggaaaggattgtctgaagaggtgacgttttgaaaagtagaaatgaaataaagggtagatacaagcatgtgaatatctggaaggaaatcaattcagtagagcaatcactcagtgcaaaagctgtaagcataatcgttcatgtgagaaacagtaggggatgagagaactagcggaaagttgcaagaaataaaggtggagaggtagcccaagtgccaaacacgtgggaactctgtggtaacccatagaagcagcttttactcagagtcacctcagaagccactggaagatcctaagtataaaaaggatccagtctgatgtttcaaaaggaac

SEQ ID NO: 201708 - DNA, 377 bp, Homo sapiens
accagggacgttattagctgattcaggaaggcgggaccccggcacttggttagacagaacaagctggcactctgacccgcagtgacccttcagaatctccaaggggcagctctcaggtgcccaagtcagtctgcaccagtacagacaggtgcccctccattcagctccttctcaaggaatggccgagtgccggtgtcagaaggggtttaggagtgagcaggactgaaacagtctctgccttctgagagcttccagtgtaagtcaggagacatatactaaacctggaaacagatatgtaattgcaaatactgtagtgctgtgaaggagggaaaaactggtgcttttagagaatcagagggaggccctgttttcctttg

SEQ ID NO: 201709 - DNA, 380 bp, Homo sapiens
ttaaacagacatcccagcacagaaggctgtgtaaatgacaaaagaaattcctactacatattttggcagtgagggatgaatatctatatctgccagggtattgtgtgaagtggacagggtggagagaatagattgggagaagggattccagaaggtgataatgattggatgctcactttctcagtgctaacttgtaccctgaaaattcttattattacccctgactttgttaacatctcagtatctcatttttttacaaccacttcccttgtctcaggcctgatggtgttaatagttgacctcattttgctaaaatctaattgcagcacacagactgggaattctgccatcctctggttcccccagtcccagccagcttc

SEQ ID NO: 201710 - DNA, 464 bp, Homo sapiens
tacatcactttctcagtgagtccttcctgcccatcctaaccatatttaacacatcataataaaaatctgtggggcagctaaaacagtgcttcgagggaaatttatagtattaaaatgtttaaatgttaccttagaaaaggaggaaggaaggtctcaaggcaatgagttaaagcttccaattttaaaactagaaaaggagcaaattaaacccaaagcaagcagaaggaagaaaacaaagagtagaaaattaatgaaagacaaattaccaaagctcactcaagaattaaaaaaaccctaaatatccctgtctattaaagaaactgcagtcatcattaaaaaccttcccacaaagcaaattccaggcccagctagagtttaacagttaccaggcttcactggtaaattctcccaaacatacaaagaactaataccaaatatacacagatttttccaaaaaaaaaaaa

SEQ ID NO: 201711 - DNA, 380 bp, Homo sapiens
aacatgattaaaatattttataaatggaagatgcaaaaattagggtaagaattaaagaaatgaatttggatgccctatttatttatcaatctagcaattaccaattaccaacacacatgacactgttcattcttctgtattaagagagaaatgccttattcctaatattctgctagagccctgccttctgagggaggaagcacaggcctgctctgcacagactgtcagctggtgtgggaagtccttgtgagcctccttccccagcctttgatcttctcctctgatcgcctctcttctgtgttcaagctcatctaaaggctgcatttgctctcagatttcttgctttcatgttctgcttcctctcaggtttctgggaatag

SEQ ID NO: 201712 - DNA, 189 bp, Homo sapiens
gggcgacagtgtgagactccatctcaaaataataataataataattgctgacataccaggccccaatctcataattccaagtggaaacatgtaaatgtggatgcatgaagcaaaatgagatgtgtacaaggagataaggtgaaattacaaatattgttctgaggagaccttctgaattccaagcacctg

SEQ ID NO: 201713 - DNA, 134 bp, Homo sapiens
cagccaccacccaatgtctcccagaggacagcctcccaccaagagctgagcccccagctctggcctcctttctgtaactagtctctggacacagccactctgtgttccacagcatctcaaactcagcactttct

SEQ ID NO: 201714 - DNA, 640 bp, Homo sapiens
ctctccccataagggtgctgtgtctaagaaggcatggaacccaggccattaacatctaaggatgtcatcttgttggagggtcatggctttgtgtacatgtgtgaaattttcaaacacacagagaagcagatagactggcacaatgaactccaagtgtccatcattcaatttcaacaaccattagctttctgcctttcttgtttcatctggcccacctccccatacacacactccatccctgtggatcctctgtgggtttgttctagattcccggatagagtagcatcactcgctttctcgccactttcttccctagtaggcactctcatctctcatctgttataccagcagagtcctcggggggaaataaacttatttcaataaagatttctgattgcaacttctaagctgaaacttgacgatccagccttctggaattttcagcatctgaaagatcccagatgggcttgtgatcagaagattttagccattttttccctcactctttcttttttactttggagattttgatgactatttatcctgagtgggaggtatataaactaaaaaaataagcttcaatttggaggtttcaccataaatttctttgcaggcaccaggaggatttcatagcacatgt

SEQ ID NO: 201715 - DNA, 476 bp, Homo sapiens
cttcttttagcatcctgattcctgttctgtgggttcagtctcatcttatatctgtttgaaaccacttactaaaattttgtgaaggttttcttttgtgacctgcattacctagtttcctgcagttctccatgtgatctgcttaattggtttccatcttttgtattcaggcctttgttccagcgtgggtgcttttgatgtttgacactaaatctgaaatggaagctctgtatctgggcagaatctgtcattaggtgggctctatcttgggtcagatatagcaatagccccttttgagggagcatttgttttgagggtctttcatctggagaataaatctctcctcttcagcttggctggttgttgctggtggcccacggaggagatatgatcaacttttccttatccaagtgtctgcacagtaatctcaatagtatttgacccatgtgaattcatctattcacttactcatgttggat

SEQ ID NO: 201716 - DNA, 499 bp, Homo sapiens
taatttgatttctatgtttttcattcactctttctggcattctgttaattccagcatttgggctctctggactgttgtcctccagttttcccttatttattttccatttctgtctttttacttcattttttgagacgatttccttagcttaatttccagatctttacggagtttttaatctcatctaatatttttaatttctaagagctatcttttgggctgggcgcggtggctcacccctgtaatcctagcactttgggaggctgggcaggtgggtcacttgacgttaggagttcgagaccagcctggccgacatggtgaaaccccatctctactaaaaatacgaaaattatctggacgtggtggcacacacctgtaatcctagctactcgggaggctgaggcaggagaatcacttgaatccaggagacggaggttgcagtgagccaagattgcaccactgctctctaatctggggaacagagtgagatgctgtctcc

SEQ ID NO: 201717 - DNA, 439 bp, Homo sapiens
ccactctttgtttgatgctctcactgtctgtcttgcattgcttctttcccaagtgagagattagtgtcagtgtctctatcatgtagactttctgaactcagaattagggctgatagcacatccttgggagaataatccaacccttactcttctctagagcctatcagctatgaagaaatagtctagtccaaaaagagtccttgagtgttgtcttccttgacataagagtccttgagtgttgacataaacagaggtacaatcagagggggtcaagaacacttttcctagcaatgatgcggccattttagaaaggagggtgttaacatttggaaaaaataatctgctgattatattgaatggcgtgatgtccttgagtggatcgtcttccaagtactgtttttgtacctaatcttaattcagtacctcgtcaaacctgcat

SEQ ID NO: 201718 - DNA, 456 bp, Homo sapiens
gaaatactaagaacactgcaacaaaccaagctacctacaagctgtagatctctgattgatatgagagagtcagattgtcattagatagaatgagacattaaatattttaacttgcgaaatattatttggctgtctttttttgagaaataatgaagttagtttcaaagttctcacttttcttgatctgtgaaatgactgccctatggtagtctttgtaaggaggacagagctagaagaattaatattaactggtatgtgattgtttttatatacctgacttaaaagcaatgaatcagaggatctgattgaatgaaggaaattaacagatctgtgtaacactaatactttctatacttttccagtaatctatgaaatgtccataataggaaaaatgcattcaggagccagatggaccagattttattatttccttactagcaaactaaatgaatcatt

SEQ ID NO: 201719 - DNA, 134 bp, Homo sapiens
gctagacatgagaactgcaataagcaatctctataattcaaaaagagaaaacagttgtcatagtaagaacacagagtagcagttcaggcacagccaagttacaaaacttgaaccgactgcttggattacaagga

SEQ ID NO: 201720 - DNA, 438 bp, Homo sapiens
ccaccctccccttccctccctcatccgcacctctgtggagatcattcccccaggtcacgactgccttgctgttctccagtaatcgagaatattccagccttaaggcctttgcattgacagttccctctgcctggaaggctttctccctagatgcctgcaaagagaactaaccgcctccccttcagtatcctctcggtataacagggttttactatttatgctcaagaagtgtagtgaagattcaattatatagaagagacatgtgcatagcagttacacgtggctgttcattccttctgtaccttgccttcacctgcctgtcagttccttcagtgactgtgactcccttccccatgaagagataaagcctgtggctaaaaaatgtcttaagaagtcataatgatttgaccttaacctcattaaaaccaaaaattctct

SEQ ID NO: 201721 - DNA, 406 bp, Homo sapiens
gctgttcttaaatttctgtttataaaagccataatgcataataatttactgtagtcgttattcctagttttcccaggtaggcagtggtaacatctgtttcacaagataaggaagcagaaatttaacaacaatggcagaatcaggatgtcaatcttgtccttttttccttttcccactttgccatgctgccctctgggtaataagatggagactaatttttgaaggcttaatttgttgagccagtgtcattagtttttaggtaacattttaatacagaataagtgtgtcttggtcttattaacagtgctatgttatgtaaaggaatttagttgtaggaatattttctttgaaacaataatacctgtttttttatctcttgattgtaaagtgctgtgggaaatacaga

SEQ ID NO: 201722 - DNA, 287 bp, Homo sapiens
aaagaaaataggggcatggagatgaaggccgaactcagaaagcactcatctagtttagactaccctaaaacacttgagctcaatagcattcaaatacacctacactccactgagaggcccaacaataaagatagccaccccaaccgatgggatggaaaaggcacagcacatcaggatggaggatgaaacacaggttctcaagtggaaagcatttctaatgtgtgcacacacagacacaaacactcacaaatatctaaaaggacaccatgtcatatagaattattaaa

SEQ ID NO: 201723 - DNA, 217 bp, Homo sapiens
aaaaatatccaggcatggtggtgcccacttgtagtcccagctactccagaggctgaggcaggaggatcacttgagcccgggaattcaagggagcagtgagctatgatcacaccagtgcctccaacccgcatgacagagcgagatcttgactcaaaaaaagaacgtaaaaagaggctgggtgcggtggctcacacctatagtcccagcacgttgagag

SEQ ID NO: 201724 - DNA, 510 bp, Homo sapiens
gtatattttcaatctataaagcttagataaatttcgtatatgctcacctttttttgtgggagacttgcaagagaaacctaccctaaaagctaacctagccaccttctatttgcagaaataaagcaaaaatcattttagtgttgattttgatgtaccagaacctaaattgcttaaattaaaaactttttagagcagtgtgtagaattctatttgtgtccgtgagtatggctaataactccattttaagaaccagaaaaggaaataaaataagttaaccatctcccttgagctgcaaaagttgctaatcaaaaacttcatgtaaacaatgtaccgatatcagactctggttatgatctgtatacatttagtgtgcaattcaagtataaaggctttcattttttggcagcccagatgcaaacaataaaataatcctgcttatttcctctcagcagcaggttttgtcatccatatgtaactgaccgaacagtgtttagccacaaacagaaaaca

SEQ ID NO: 201725 - DNA, 278 bp, Homo sapiens
ctattacagcataaactattacagcataaactattacagcataaactattacagcataaactattacagcataaactattctctctcttctctgactctcaaaggcacgccctagtgtaatctcttcagtgatctggaattttacacaatacaggaagacctattgacttctaacagcttctgttttctgccctgtaaaactcatgaagcaagaaattactaaagaccttgaggtagggggtaaacagagaacaacgcacaaaatagtataaaacaca

SEQ ID NO: 201726 - DNA, 434 bp, Homo sapiens
cctccccaccccctcaacacaccatcctgctgcctgtgtctccagccttatgtggtctggcaaggttgggctacttccggcagccaccgtttgctccctaggatgcaatcttagcctccatggggctggcctgctggaatctgggaccacgtgagcctatgagcctcagggaggctgggatgccagggaggagccagcactcctggaggctctgtgatctgctctggccacattaaataaaggctttgatccctccaatggggagaagggagagctctcccttttcagcaccttctaatatccttcccccttgctgtgcccggccccactgtcacctcaccgaggaggagacaggatgtgtttccagcggggccttttttcttcccgatttagactgggagtgaatgaagctcattaaactgattgtggttgta

SEQ ID NO: 201727 - DNA, 262 bp, Homo sapiens
agatctctgccaagttacagtaggtgtagcatgttcctactattggttcgtccacccactcatcactcactcagcctgtcattcactcatccattctctgtgaaatgggtctccccacatgccaggcaccgatgttggtaaatgcagcaggcacagccttagctctcatgggcttaaaaattcggtggagagtctgggcatagtggctcatgcctgtaatcccagcactttgggaggccttggcaggtggatcatgaggtca

SEQ ID NO: 201728 - DNA, 408 bp, Homo sapiens
catcctgggccacatgtggcctgtgggccatgggttgggcatgcttatcctagaagtatctagtttgttatatgaaattgctaggaatgaagcatccatttcaaatagcctgctaactttagccttgctcaaggcatttagtccttttgtaatctcttttttgtcttatctgatttaatttgaacaaaccttactttacacttttcatatttttgttgcattttgttcaagaacattatattgcattattattgtatattgtaatttcttaaaggtaaaggcagcctctaactgcaaataaaacatctcaaataagacgtttcaaaaaataagaccaaataaggcagcatgttaggatctggcatcatatgtccctaatagtgtctagatttgttaatattggtaatt

SEQ ID NO: 201729 - DNA, 204 bp, Homo sapiens
actttacttaactttgtatttgtgtgatttatctatgctgctaggtacagcagtaactcactccatgttatttctgtaagagtatatgagagagaatggctgttccattgtaaaggatcatataatactggattttttcttaaagctgaactgttagatgcttctcttgcagccattgcctacatctaaattcccccttctcaa

SEQ ID NO: 201730 - DNA, 422 bp, Homo sapiens
ccaattgcacatacggatacctccacgtggaggggtttctatttgcctctatctcctacttggaatgtgaatcctctccttctgcattcaaatagtattttggttctatctcctcaaggcagccttccttggttacttcctgtcttgattccctgctgcttccatgctctcctgtaaagcagtgcttacctccacaatagtctgtaaatgtctcccacctccatttctgaggcaagagttagtcttcttctttgtacccaagcatttggcacattatatgggctcaacaaatataggcacgtcaataaattcaaggaagaagaaaagaatttttactttattttcctggggaaatttctattctgaataagaaatattatcatcaatgagataacaagaaattattacaaaaacttcataac

SEQ ID NO: 201731 - DNA, 266 bp, Homo sapiens
actgggagggtgcatggggtcaggggtgggcttccagggtgtggataatgtgttattactggagctcagtggcagttaggggtgtttgttttgtgaaaagctatcaggctgtacccttatgatttatgcacttttctctatattatgcatcaacaaaaagtttacctaaaaaaaatctaaaactgacagtacattttttagcattttttagcctgaacttactggaatctcccaatcttctggctttttttttttttttttttttt

SEQ ID NO: 201732 - DNA, 397 bp, Homo sapiens
ttttagttaccttaactataccacatggtggtgtcatgattggtgtcaatgtattgcatatatatatatattacaatataccacatgataggtgtcaatatactccaacaattagacttaattttcttcctctccgataatttttccgcctgctttgaggaaacatctggtcatattgcagttaaaaatcaaacctcttaacaataaatttatttaattaaatgccataaaaattaatcaagaatggccaggcatggtggctcacgcctgtaatcccagcactttgggagactgaggcaggaggatcacttgagcccaggaggttgaggctgcagtgagccacgttcgtgccactgcactcagccggggtgacaaggcgagatcctgcctcaaaaaa

SEQ ID NO: 201733 - DNA, 452 bp, Homo sapiens
tacctcagatagagaatggaaagtcagatttcctgaattgctatgggtctgggtttcatccatccaacaacctgcctcacctgtagccttctccatcatggtgttcatagtcatctgaatcatctttttaaattgtttttctcacacactacatccaatccatagcaactccacctacttctactctcaaaatctaactacttctcaccacttctgctatttgtaacctggtccaagccagcatcatctctcgtcactgcaattgcatcctatccggttttcctatttccactcttgctaacataaagtcaactcacaacacaggagtcagagcgatctggttataacataagacaaaacatgccactcctctgctcaaaactcaatacagtcccatctcattaagagtaaaggtcctacagtgtaaaagtagaagtccctacaatggcctg

SEQ ID NO: 201734 - DNA, 291 bp, Homo sapiens
attcagctggtcttttgtggggcatgagaatttagagtagtctgtggaactactcttctagagaatgatttcatggactgagaccatttattgattccccaaacataaccttccttatgtgtaaaaaattttgcatacaaagaccctgcacagcatcaaaaccaagggcaggccaggcacggtggcttatgcctgtaatcccagcactttgggaggctgaggcgggcagatcacttgagatcaggagctggaaatcagcctggccaatatggtgaaaccccatctctacta

SEQ ID NO: 201735 - DNA, 748 bp, Homo sapiens
agcactgggaccaagactaataaaacaccagcctcacggaagacagctttatcttgttgatcggaagtctgccagctctatttatgatggaacataagatctctaaatctgaatttacgctctgtagcgtaacgagaggtcaataagattaaacgggggctcaggagaggaccagcgtcaggctcactgcgaggtgctgcacagaaaacccacagccagagcccctgggcccagcccaggcaagaccagaaaaggagggggcaggtgggagaccagcctggggctcccgggaagcccacgggatggaggcgggagagccaggaggcctggggcaaccctgggacggttcctggatcgaggagagcaggggggtgatgagggttccctcagggctggggagccttctcctggtctcagacccaccccccttcagctcccaagccctgggtgcccctggctctgaggacagttgggaatcttccctgaggcaggttcaaggacagagctctgaccctggcccagggctgctttgggtgcctatgaactcggcttctggctcagagcagttccctgcaccccttcctgagccctctgtcctctggaacccgtgggcagggtgagggacgggtgttccttctgggtgggggcctgggcgcccagccagcacgacgctggcttgctgagcttagggcagaccccgacttcagaatttatacaaataaatgcaatgaaaagtgctggcaacctg

SEQ ID NO: 201736 - DNA, 390 bp, Homo sapiens
tatttgtagcttcatcaacattaactggttcactttaatgatgcactgaggaattagttcttcctgcagagatttttttaaaaaggacttttgagaagtgtgcaggttccttttgtatatttacaaaagctttatttactcttaatttttttgtcatttataatgtttatcttcttaaaattagtggtaactcaggctgggtgtggtggctcacatctgtaatcccagcactttgggaggccaaggcgggcggatcacctgagatcaggagttcaagaccagcctggcccgtctctaataaaaatacaaaattagctggacatggtggcgcacacctgtaatcccacctacttggggggctgaggcaggagaatcacttgaacccaggag

SEQ ID NO: 201737 - DNA, 1185 bp, Homo sapiens
  misc_feature (1017)..(1017): n is a, c, g, or t
  misc_feature (1121)..(1121): n is a, c, g, or t
  misc_feature (1131)..(1132): n is a, c, g, or t
gcaatacgctatagtatctgataactagtacacaatgatacctatgaaaggattcaaagaacaagggtgagaaagctgagctctgccctaaggcctctaaactggcgtacaggctggaggtgtgatcaggctaagtagctagtaggtgtagggctgcagatatctcagtactggggaatgggcaaggaatgaagtaatggtaatatctaggaggcccaagccccaagtcctcaggcaatggcagccaggaagatgatggcaaaaggagacctagctggtgggggcagataagctgaaaagaagtaggagagggaaggggtagctaggaagggtagacaaactacaaaactttcaaaggtgtcgtgaaagctcaaacacaacagacgggagtcactaaatgcaaaggctctatacatctaacatcatgtagcaatgaatcatgggtttgactatgtagtgtatctttccaattgcaaaacctgtatctagtccattaaattaataaaatattcagttagattttaatctcttcatgtttctgccaggaccaatcatgttttcagattgtggtatctggggttttcaaatgtgatctaaaaacaaaagtatggactatttcgcttgcttaaaacttctgggtcacatgagctaatatccagagcagttaatttttatagaggagatggtgtctcagttttgttacttgctgtgacaccatggtcatcagctctctgttatagtttctcatttataaacaggatgttgataacattattaatgtagctcagtcttgaattgctattcttctggttgctaaggaaaatactaatatgaatccaaagataatactaatattttattaatttaatggactagatacaggttttgcaattggaaagatacactacatagtcaaacccatgattcattgctacatgatgttagatgtatagagcctttgcatttagtgactcccgtctgttgtgtttgagctttcacgacacctttgaaagtttngtagtttgtctacccttcctagctaccccttccctctcctacttcttttcagcttatctgcccccaccagctaggtctccttttgccatcatcttcctggctgncattgcctgnngacttggggcttgggctcctagatattacattattcattcttgccattcccag

SEQ ID NO: 201738 - DNA, 710 bp, Homo sapiens
taagaggatccccgtatgtttgcctggccttattttatatggaccaaatatagacttgtgttgttctttaatgaatcattagaagtgaacttgatatttattgaggaatgaagataaaaggattgtagcttagtgtgtacgtgctttgcctgcactgtctttaatgcagttgtgggtaatgaggtttcaacaaaaggctgcatatgtgatgatggtaccataagataataatatattttcactgtaccttttctatgtttagatacaccaatacttacaatcgtgttacagttgcctacagtattcagaacagtaacatgctatacaggtttgtagcctaggagcagtggctatgccataaagcctcggcatgtagtaggctataccgtctaggtttgtgtaagtatactctatgatgttcacacaatgacaaaattgtctaaaagcacatttctcagaatatatccctgtcattaagcaatgtatgactgtacttaaaacagtgacaaactggataaaccaatgaactctctagtatactgtaattctctcaattctgactaattctgattattccttttgcctaactgggaataagttatctgagatggtatagcctaatttactaatgagtttggttgtccgtggcaactgttcaatatctaggctgcagtattgatgttttatattggtaagcaagtgaaacaaaa

SEQ ID NO: 201739 - DNA, 661 bp, Homo sapiens
acttgaacctgggaggcggaggttgcagtgagccgagatcgtgccactgcactccagcctgggtgacagagcgagactccatttcaaaaaaataaaaaaaggataaagtaaacaataggaaaggatttggtggggtgagggtggggtgttgagggctgggcctcatcttgtattctgaaagctgagaaacggctggtcagctggaaggctggtggatgggcaggagtgagccaagctgaggcgttctgcaagaagcaggtctgagtctgtccaaccaatttgtatcctgtggggagaacaacttcattcttaacataccctacaaaccagaaaacaagtttttaaggaagatgctgggcatgctgatagcttttctggtctcctaaggaagagtttttaaaactaaatccaaggaagaaaaatgtaacaacacgtggaagtgaacactggatgaataagcttgtttcccaaattagaatcctaacgtccatatttagcttcatgtattcccctttggcttccacagttcaactccttttattttgagacagggtctcgctgtgtcgccccagctggagtatagtggcactacctcggctcactgcaacctccactccccgggttcaagcaattctcagagtagctgggattacagatgccc

SEQ ID NO: 201740 - DNA, 1052 bp, Homo sapiens
atctttttccttctcttctcctgtcaggctgtctgctgttgtgttcctggctgtcaagtttgtatacctttcacagcaagtgttttctgccctcccctccccagccaccctcttccgactccacgtgttttgacactgatgagtgtttctttttctccaatgaggggtaaggactagaaagattgttaaaaaaataagcattagccaagctagttcctgtgactagaagcaaatgtgatgcttgaactgacctttgtgttcattgctcatttattcagtaacttactgagtttccctttttcacttaaaaaatattggtgggccgggcacagtggctcacacctgtaatcccagcactttaggaggccaaggcgggtggatcacgaggtcaggagttcgagaccggcctgagcaacaacgtgaaaccctgtctctactaaaaatacaaaaattagccaggcatggtggcaggcgcctgtagtcccagctactcggaagactgagacaggagaattgcttgaacctgggaggcggaggttgcagtgagccgagatcatgccactgcatcccagccggggcgacggagcaaaaaaatatgtatgtgtatgtacgtgtatgtatatgtgtgtgtgtgtgtacaaatatgtgtaacatgggccaggtgtgatggctcactcctgtaatcccagcactttgggaggccgaggaatgtagatcagttgaggtcaggggttcgagaccagcctggccaagatggtgaaaccctgtctctactaaaaaaaaaaaaaaattagccaggcatcatgaggcatgcctgtaatctcagatacttgggagactgaggcatgagactcacttgaacccgggaggcagaggttgcagtgagccaagatcgtgttactacactgtagccttggtgacagagtgagactctgtctcaaaaaaaaaaaaagtcacaaaatttataccatactgttttccacagtgactgcgccattttaggttcccacctgtagtgagcaaggggccagtcgtccttgtttccggttatc

SEQ ID NO: 201741 - DNA, 334 bp, Homo sapiens
gtcctatcttcccctggggttgactttggctttgtgtccagtcagtgctgttgtgcaaggagggaaaaagaagtagcttcatgttcaaggtgagcaagcatcctctgggcccaaggccgtcctctgtggaagtcctggaggggcctcaggccagcatgtctgcccccaagctcctggtcctctctcttccccccttccctctgtggagcacgccctaccatgctccccagtgcggcatcctggagtcccactttgcgtctccagttccttcccgcctgcaccaggcatctgtggaaggtcgtgcacctgcctttgcactgtctcttggtgtcag

SEQ ID NO: 201742 - DNA, 226 bp, Homo sapiens
ggtagtatcagtaccaatagagctggagctgctgatcccacatgacccacgctgttcctggtggactcagcccatcagaaggcttcctcatccacacaagcgttcataaaagatgcacacaagtgtctaacacgaaattagccctcactaagatgaatgctgctcattcatcaaagagtagatccctgctccttgcagagagaagactgcaaggagcttctgggtt

SEQ ID NO: 201743 - DNA, 465 bp, Homo sapiens
tccagatacctcttaaagtgcggcaccgcctggggtgatctggcttatgccccttgctccccattcaaagacacacagagagggacattgacagtgcacaggagatatcaacagtgtttcctgacatccatgatgcacgggagagaaccaagtaggtaggattcagacttctcatcttcacctctcccaaatcacacacatgccttcctgagaaagagaccctttgtgagatattaaagaccagccaaattctactcccacatcataagaaactggagttcactctttaattagagaagatgccaatggctttggaactggacaggcttctaagcatcttttagttcagtgtcttcttttacaaaagagccctggagggcaatgaccgcaccaggctcacatgtcattgggtgtgtggcagcatttccctaagctgagaccagggtcactggtgggtgcatttcc

SEQ ID NO: 201744 - DNA, 349 bp, Homo sapiens
tgcagtctacccaagggcagcataggatctgtaggaatacagcattttccgcttccatttactctcacctggatatggtctccaactcattcagcttgtcttacattaaaaaatgagatagtattgtatgtgaaagtgttttgtaaactctaaagctctatgcaagtctatgatagtggcattattattattattatcattatggatagcatgacggtcaagcattgcattggtcctaaactgatgagaattggtgagaattgcaaagataagcacagtgctaggcctggctgactgttattctaggtagatataaaggtagcatttacatcacaatttactatcatta

SEQ ID NO: 201745 - DNA, 375 bp, Homo sapiens
tctctccagccacattaactgtcttactctgccttaaaccctccacatactctcctgccttagagcctttgtactatttcctttgcctacgatgctattcgtcccaactttggcattgctgactcccacaactccttcaaatctttgctaaaatctcaacttctcagtggtgcttaccctgactcattattgagaaaatcactctcccatctcacctctacctttatcctgttcttatctttttctccctgaaaatcttatgtcttgccaatataataaatgatactctctccctcccttatgttgtttattttcttccttgattagaataaaaacttgaagttgtgacaactttttatcactttatttcactga

SEQ ID NO: 201746 - DNA, 259 bp, Homo sapiens
aaagctaagccaattaaaaataacagccaccagctactagcttccttctccccaagtgaaaaacactggatttttttatataaaaaatttggttcatcctacactaagtaccgtgtcttaccaatttgcagcgctatttccttaatgtgattgcctgggatgggacccgcagccgcattaaatatgaaagagggaaaaaactgttaataattgatcctagccaaatggctgccttgccataatgggcttttcaggcaga

SEQ ID NO: 201747 - DNA, 408 bp, Homo sapiens
cttaataaatcattacaaatatcggtaattgaaagattatgtaagagagggaaatgtggatgaggtaggatgtgccaactaatgtttattgaacctttgtttatactgtactgagcttttcttctcttcagtagagtttagtccttaatatgcagtagtcaaaattagcatttaaagttagtattgctgtgaagagggagttgtgaaaaaataaaaaataaataaaatattgtattattaagagtttgtccctgaaatggcctttgaagggctgagaatttgaaatgtctgtaagtagactggtctagagcctgtagtagagaccaaataatgctgccattacagttaacccaattaacctaaagaagagattatgtaagtttgtaaagtgcatgtatgttgcaagca

SEQ ID NO: 201748 - DNA, 688 bp, Homo sapiens
cgtggcattcctttgtctaagactcagcgtcacaacaactgatctatgtggtacaatctaaacaaccttgcacagacacaaggcccttctaagactgggatatctgactttccaaacttacctttaaccactgtccctcttctagcagacatgacagccataataaactatttatccttctgaataacgatgctttttcacagccctctctcctttctttgctggttacaaacctttttctttcttcatctatctggcattttctagggagaaagcctatagccttctaagatttgtaaaatggttggtgaccaccccaacagcaaagaaactgagccacagggaaaagtgacatcgaaataactctgtgctgaactccagcaaaacaatcagtctgcaaagggtggcttggggctgggaagaagctcattaaagattgttgaaagaatgaataaatctgagtatttgaattcactgcttttgtggtcctgtaaagacgatcaggtgatggcaatccacactggggccttatcagtattttctattttttaaaacatgaaattctatactccattatgatttatgttgttgcatgctatctggtcggaatatagctttgtaatgaatacattcgtcttaaaactgacttggctttttctcctaaattaaaaagacaactctgatgatc

SEQ ID NO: 201749 - DNA, 239 bp, Homo sapiens
tgccctcaggtgattccagctcttcatatagctgctgcctcacagaattaggatgagtagtgggaagaactgagtgtgggaatgaagcagatgggacagagtccaagaacccaaaagcaaggaggaagagattggagtgatgcagctacaagccagcaaaggcccaggattgccagcagccaccagaaaccgtggagaggcaaggacggggtcttccctagatcctgtaaattccagca

SEQ ID NO: 201750 - DNA, 814 bp, Homo sapiens
ttattgcaggcatttcaattggatccacttactggtgtcctgagacactgatcccattggtcctcgggtggtttggttgacacctttgtactcaggctctgagcatcccccaaattttacctcagggtggcaattgttattgttttctttactgttattatctcttttgtattatattgtttacttaactctcttcccaactagtaaatatactagatagaggcagagatttttgttccttacgaagctctaaatttctgaaacagtgcctgatgtaggcactcaataaatatttgttgaacaataaatgaatggatgggaatttggggaagctctcacctagcttatatacagaacttgttcttatttccaagattacttcaaacttccagtagaaaaaaaaatggcatcatcacttatactccatgattccatttatctttctctggccctgtactcccacttcacctttttgaaaaggcgcatcgatgtctgtcccttatataggtatatgggtgaaaactagccaagttttctcataagtaattttcagggttacaaaggaagaggcattacagtaaactggtgataaatgtggactctggcagtagactttctaggtacagatgctgaataggttaattactagcactgtgaacctgagcatttacttaaaatttatctactttagctttctcatctgcaaaatagaataaaaatataactacctcattgaattgttgtaataatgaaattaacctgttaaggatttattctacttcctacccccatgagatcaattccttagctccca

SEQ ID NO: 201751 - DNA, 389 bp, Homo sapiens
cagcaatggaagaatgacaaagaaacaccatgggccaggtgtggtggctcacgcctgtaatcccagcactttgggaggccaaggcgggctgatcacttgaggtcagaggtttgagaccagcctggccaacatggtgaaaccccgtctccactaaaaatataaaaattagctgggtgtggtggcaggtgccggtagtcccagctactctggaggctgaggcaggagaattgctggaacctggaaggtgaaggctacagtgagccaagattgcgctgctgcactccagcctgggcaacagagtgagaccctgtctcaaaaacaaacaaaccaaccaacaaccatggaagccatgattcagcaaacacatccctaggacaaagattcccagc

SEQ ID NO: 201752 - DNA, 642 bp, Homo sapiens
tgacactaaggcttgggggctgggtgacttggtatatgtttctacggaaggagaaagatttggaaagaaagatgattagttgttttggacatcctgaatttgaggtgctgttatggatttggagagatgaaatcaatagacttgatggttgcttgaaaccttgaagttgacaagattgggaggatgaaagacagatccttggagaggattcttggagtttagatggtagatgcaagtcgagaaggaagaagcagcatctgggtaggatggagaaagactaggctcatttagtcaaggaaactaggagatgggaagccgagaggcagagattgagaaaaagcctttgaattggatggatctggtcagtggagacccagagctagtagaggagagagggtgagagctagatgtgagggctctaggttgagggcagagaccttgtttacggagtagatactctttttttttttttttgagacagtctcactctgtcgcccaggctggatggagtgcggtgacatgatctcgcttgctgcaacctctgcctcctgggttcaagaaatcctcctacctcagctttccgagtagctgggattacagatatgcaccaccacacctagcaaatttttgtatttttagtag

SEQ ID NO: 201753 - DNA, 355 bp, Homo sapiens
tgcctaattgctcaggctagaagagtggacagtcttgctttgttactgatcttaggtggaaaaattttcaccattgaataggatgttagctgtagacttttcatataatctttattatgttgaagtattttttttctatagctatgtgccacataacaacatttcaatcaacaacagactgcatatataatggcggtcccatacattataatggagttgagaaattcccatcaccagctgggcatggttgcttatatctgcaatcctagcacttcagaaggccaaggaaggaggattgcttgagccaaggaattcaagatcagcctgagcaacaaagtgaaaccctgtctctacc

SEQ ID NO: 201754 - DNA, 377 bp, Homo sapiens
ctatgttgctggcatgcagtccgcactcactatgcactgaattaatgggctgatgaatgaaaagttcacagccttgaagctcctgggggcattcctggcagcagggctgagcagacagatgctaatggattcaggcctgccagcgccaactcttctaggaagcccagagcaatggccctgcctgggacagcctgtgtctccttccccttcctttttttttttttttttgaaacagagtctcgctctgtcacccaggctggagtgcagtggcatgatgtcggctcactgcaacctctgcctcctaggttcaagcagttaacctagccttagcctcctgagtagctgggattatagctgcccgccaccatacctggcta

SEQ ID NO: 201755 - DNA, 760 bp, Homo sapiens
  misc_feature (698)..(698): n is a, c, g, or t
  misc_feature (703)..(703): n is a, c, g, or t
  misc_feature (730)..(730): n is a, c, g, or t
aaatgctttgtaacaaacagttaacaggtaagattgtcttgctctctaggaaatgttacatgaaatagtttttactccttttatttattctttcttaacttctgatagaacacatctggaaattccttttgcagcttctcttccaacatacccttaccatccatcattctctaaagcagggatttcttacctggggtccctgagtttcccagtgatactcaaagaagtctgttttttaaaacagatcaaaaacgctgttcaaaggggcattctctgtcacaccaacacagattttttaaagacctgcattgagatgacaaataggtttgaaaagtagccacatagtattgggttttaccttggcgtctctgacattccatgatgacgtctgtccctgggattgttcagcaatccccctctccatcacactttagtaaatgaagacggtgacatttcccgggactgtatctaatggacaacagttaacattgttcagaacccatataatagaactcacaaattttaatattatgcgtcattatttctgattattaatttcctagtgctgaatttaagaaacaaaaacctttctgtaatgaaagcaaagcatgagtgaaccctaaattttagcagtaaattctatttaattctatttgcacaatttcagagtatttaaacttattttatattcggggganggggngcaaaagaaggtggttatttttatggnggtagtcagcggaaatccggacagcattta

SEQ ID NO: 201756 - DNA, 612 bp, Homo sapiens
tgaattgatgataataataatagtaataaatgttgttatattaataatgcaaatggaatgtggtacaataaaatgtattccaaaatctaaaagcaaatcacaggatagagaaaacctttaatgaacacagctaataagaactcattaacatgcatacatatatacctacaaatatatcatagtaagtaccatttcttcttggacccttcctggcactgtgctaactgctttctacaaatttagcttacataaacccttgatacacccttgaggtgagtaggtattatctgtagtttacataagatgaaatagagcctcccagcagttaagtaacttgtgtgaagatgggacccttgttcctaatggttctagaacctttatccttagtgataataagtaagtacatgaattgcctgaagaagtggtcagagtttatcatagaaaatctagatagtactcagtgtgtggaaaaatgtacacgctcttgcatttatggaaatgataatgttcactatttctgatattctattaactatcttttttttaaactatcttttaaattaactaaaataaaatacaaattaccaaaaaaaaaaaagaaagaaagaaaaa

SEQ ID NO: 201757 - DNA, 988 bp, Homo sapiens
tgaattgatgataataataatagtaataaatgttgttatattaataatgcaaatggaatgtggtacaataaaatgtattccaaaatctaaaagcaaatcacaggatagagaaaacctttaatgaacacagctaataagaactcattaacatgcatacatatatacctacaaatatatcatagtaagtaccatttcttcttggacccttcctggcactgtgctaactgctttctacaaatttagcttacataaacccttgatacacccttgaggtgagtaggtattatctgtagtttacataagatgaaatagagcctcccagcagttaagtaacttgtgtgaagatgggacccttgttcctaatggttctagaacctttatccttagtgataataagtaagtacatgaattgcctgaagaagtggtcagagtttatcatagaaaatctagatagtactcagtgtgtggaaaaatgtacacgctcttgcatttatggaaatgataatgttcactatttctgatattctattaactatcttttttttaaactatcttttaaattaactaaaataaaatacaaattaccaaaaaaaaaaaagaaagaaagaaaaaaaaaaaagtgtgttggggccgccccggggccccggagagaagaggttttttgagacccattgcggtgtggggggcgggggcccagattggtgaagagtgtggaacgtggggcccagcagcgtggttccccgagaggagaaacgcggggcacatagaaaacaagaggggcggggggtatttctccacccaaatataataaaagagcgccgctggggaaaacaccgggggggggttttcgtggaaacaaatatccccgaagaagaggggagagcacgaaaggggcgacgaaaggggggactccaccacacaaagaggggagtgctcccagccaggagaatccgcagtaattaacaattaagccccgcgcgtgggtgga

SEQ ID NO: 201758 - DNA, 268 bp, Homo sapiens
agagagagacagagagagagaggaagggaggaaggtaaaaaggaatagtaatttaaagtttatttcagctataatgcaggttattctgacttcaaggtagcatcacatggcatacttctgagtcaattctcgacatattctgttgtgtttatctctgtctgtttatataaaaaggcacaatgagacatttctaaacatggcaggatctcaagaaatattgtttccatgagctttccttgaataaactactagaagatgaacttcaacc

SEQ ID NO: 201759 - DNA, 282 bp, Homo sapiens
cagttgcaacttgaactagcttggctaaaagaagaagatttaatagctcatataaccagctaggtgaggagtgttgttggaaaggaccagaacagggtcttggtgttgcctgcactttctcttttcccctctcatctcctttaattcagcttttatttttggcttttttctcccaggctgggtgatatcatgaaatgaaccataattagtagcagtttctgagctcacaatttcccagcttcttaactagagaggaaagggctcttccccatggctcttatt

SEQ ID NO: 201760 - DNA, 597 bp, Homo sapiens
catgaatgtgtttggagtataggcacgagccactggccaggactttttccagttcttttcttttcttttttttttttggagatggagtctcgctctgtcacccaggctggagtgcagtggcgtgatctcagctcactgcaacctccacccccgggttcaagcaattctcctgcctcagcctcccaagtagctgggactacaggcgcacactgccacgcccagctaattttttgtattttagtagagacggggtttcaccatgttgcccagggtggcctcgaactcctgagctctggcagtccacccgactcggcttcccaaagcgctgagattacaggcgggaggcaccgtgcctggccaagttttctattcttaattagtgatctgtttctgtattgaaggataattttttttttcttctcagcaaccatggcctgagactgaagaataattatttaccttaccacattgaatctagcatttctaaaaactcaaacaaaaagcagtttaatactaagtcattatttaaaagttgaagtacccaaaatttataaaactctatacaattatattatgacatgggatctattcagattt

SEQ ID NO: 201761 - DNA, 404 bp, Homo sapiens
gctagctaaatatgatgctagtattagtgcaactgagtgaaagatggagcatcttactagtttagaaaagactttacaagaatgagctttggtggagaaattgagtttggttaagtttgagatgcctattaagcatctaagtgacaaaatggagcatgcagtggggtgtattccagtctcctctctttcagagaaagaggagaaggtatgaaaaataatgatctggaagagtgaatggaataaggaaatccaactgaaatattggacagttctgaaataacacatgaggtttgctgtcaaatttagagtgagagcaaataccgttgtatgttttcccctagttataatgagctgtgtgggtacaggtatggagtaggtggagagctgggtttaactgaaactga

SEQ ID NO: 201762 - DNA, 561 bp, Homo sapiens
gatctagaggatcctgtgatccgttagcagaagagaaaatgtttgattctaaagagaaggcttcgaggagagaaacctaagatgggagaattgacaagttagataagggagcgagacagagagaaagccagcagatgaaggggaagggtaaggggaaggatcaccgaaggagatgagggtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggggattccatgacatgaaaccgtagcagaaaacatcgttaccagtatcctgaagcagttcactcagtctccagagacagaagcatctgctgattcttttccagacacaaaagtcacttaagcggatcagcgctgatccgcttaagtagtttgtgagtcaggctaagcaccatgagataaaccacatttctctgccgtgcagatta

SEQ ID NO: 201763 - DNA, 355 bp, Homo sapiens
cagatttctaaagggctttgtttctctacattcttttacttctaattatcagctcataattacagccacgtgccctatgggactggttaatccctaacagtgagttatgatgcacgttgtacagtgtgctcagttaccaagccttgacctggtgaccaaaaagaattctatctgaaagggtggcagtatacgaaaacactgccaagtgaacaagtgttttataaaaattaattaggttccagctacttgggaggctgaggcttgaacctgggaggcagaggttgcagtgagccaagatcgtgccactggactccagcctgggccacagagtgagattctgtctcaaaaaaaaaaa

SEQ ID NO: 201764 - DNA, 338 bp, Homo sapiens
  misc_feature (7)..(7): n is a, c, g, or t
gaccttnattaaaaaatacaaataaactaaaactttaaaacctcagagaaaccgtagaaaatgccattctggatgtaggccgtggcaaagattttattatgaagactccaaaaacaattgcaacaaaaataaaaattgataagcaggacctaattaaactaaagggtttcttcttgaggttttatagttttaggttttatttgtatttttttaatctaatttaatttattttacgttctgggatacatatgcgggacgtgcaggtttgttacatatgtaaatgtttgccatggtggtttgctgcacctatcaacccatcacctaggtattaagcctca

SEQ ID NO: 201765 - DNA, 213 bp, Homo sapiens
actataaaacctttgttaagtcctcaaagatttgaggtggtgcctcatagaacctttcagacacacaaaaggccatccaagtatctttaggtcatgcctcctagttcctctctgttaaacaaaaggtcttctaataatcttaagggctttattccacagcagcctcacagggagcccaaggtagagaaggacttctgcctgagtgagtggatt

SEQ ID NO: 201766 - DNA, 207 bp, Homo sapiens
tgctgggattacaggcgtgagccaccgcacctggtccagggtttttatagccctatctttctactagaagcagcagtttcttctttttggacactaaatttccagatatgacagggatgctttgcacacttagattttcatggagtcaataaaaccttagctttccatggaaatgtttaagagacatttgggaaacatgtttttaaa

SEQ ID NO: 201767 - DNA, 265 bp, Homo sapiens
gcattaattcagttaggatattggcctccagttgcattcatgttgctgcaaaggacatgatattgttttttttttatggccgtttcagtttcttgactgcttaggatagagcttttctaactgtcaaagtgaatctgatcagagaattaaatttgacacttttagtatattcatctgccatctattgagcatgagctgtgttccacgaactgtgctagtggatattgctgagggcagatatggtccgtgtcctcaggaagatcac

SEQ ID NO: 201768 - DNA, 497 bp, Homo sapiens
agcaaagagttttatgactatgtgctttagaggccagatggcattgttttcttcctgtctttggcaggtttcaggcaagttgcattagtcttctggactttgactgcctagtgtgtaaaatggcaatgaaaaagtaaacgaataaaccagactttgtttcttcttctcttctgtacttttcatcttcttcctcctcccttttccttccttctttcgtaaggttgcacaaaataatgtacattaaatgtgtaacgtgcagcatgaactacattttatacatatagataaaaactgttatacatatttttttatttgtgtcattaacttgttcttgttgattcaatgaagattacctgcagttagctgaaaagtcgtaatacaaacaattattttatggctttcttttttcagtatgatttacactgtccagttatgtctttttgaggcataatcttcatcttagttttcctggggggtttttctgtaactcctgtgct

SEQ ID NO: 201769 - DNA, 480 bp, Homo sapiens
cacgtgtcagtgggtgagaggtcagtttccgggtcaaggcctggacatgagggagcgggcacaggttttcagggggcccaagagcggcaggggcagcttggcagctcatcaggtccactagagggtgtcccagacaagagcagcccccgaactgaggtcaagaaacaggttggattctcagagctctgattggttggacaggggttccagatggacaggggttctgggtagaggagcagtctatgcaaaggctcagagaaagagaagtgcagtcatgtctgcggaatgacaggggtgggggccagccaaggcctcccctgccaggccaaggcatttagatttcatcctaagagcaaagtgtggcctgcctcgggctcccccacccccaccagtctccctccaggatgggcccttggtctgcccccccacctcccctttccagcaggagaaagggtgccctgtctgtggccccagtcccag

SEQ ID NO: 201770 - DNA, 216 bp, Homo sapiens
cttgggtagaaaaatggagttaattatgcccacatcacaaattgatgtgtggattacaaatgatgattatattataataaggcctatcactgttcctggcatgtagtgtttatgaagtgatagttcttatttattatgaataagttctcacagtgggaaggaatgagagaaggatggagaagtgcttgggaatgcagttaggggtatgtaggatga

SEQ ID NO: 201771 - DNA, 221 bp, Homo sapiens
aacaaccaactggtcttcatttaccaatggtcttctccttaccattagagcactcagtaattgtacaaactgtgtgagcgtgtgtttgttttgctgaactgtttttatttgtggcttctgtttttattgtttcagtctttttcccacttggtttgatcaactctacctgacttggtcaaatccgagggaacgttccaaattatagggaaacaaggcctctg

SEQ ID NO: 201772 - DNA, 347 bp, Homo sapiens
aggcaggtttgaggtcttagatgggcagtgagagcatcttggatgtctgcttcaattttctgttttattattttattttcacaggcattcaattttgttttattttttatttgagacagggtctcactctattgcccagcctggagtgcggtggtgcaatcacagctcactgcagcctcaacctcctacactcaatccatccttccacctcagccacccaagtagctgggactacagatgcgtgccaccatgcctagctaattttttgttttgtttattggtagagatggggtttcaccatgttgcccaggtttgtcttgaactcctggactcaagagatccacccg

SEQ ID NO: 201773 - DNA, 765 bp, Homo sapiens
tcatcaaggaaattgtttctttcaatgagaacacactctttttaaatttttgtcttagataaaaagagaaagctaaaaaaaatatttagaaagtctgcaaacctatgaaagcctggagttatcatgtagctcttaatttaaacccttttgacctcatataatatattttatctaatagattaacttttttttgccctgaaatagcttcattttgttttgttttgaaattctcattcacttttaaacttttaaacaattttccaatagtattttaaaaactaaacaaatgtgtagatatttcttcagtcatcaaagatgtaattagcattaacagtatgtaattacttcctataaatcacatttgtgaatcaaattgtgtgaattttataatggtatatgtatttcaaaatcttaaatctatgtttagataatatagaaaattacaaaagttatatttcttggttttagccattatttttcattatgggaaaatatccatttaataagtgcatttctagagcaacttcaaataatttaggaaatgtaaaatgacttaaaatgcacaatatttgtaaatattgtgaatagcaattttagtattgctaaaactaattcagagttaacaagagcctaaaatgatggtatttttctggctttttctcatgttgggaatataaatttctgcttgttctgtaaaataacacgctgttgattttttgggaagaaagatgctgctagtcatcatgtgtctttcttcttgtaagt

SEQ ID NO: 201774 - DNA, 302 bp, Homo sapiens
gcggagagagggaggaccgggcgtcatgctgtttctggcctgaggttttgtgtgcctttgttttccttttgctctattcgtgtattcctgcctacggcctgtgcggggaattaggagctcagtactgaaacggcggttttcctaaacagtaccggacgggcgcgggggctgacgcctgtaatcccaacactttgggaggccgaggtgggcggatctcttgaagccgggagttcgagaccaccctggctaacgtggtgaaaccctgttcttactaaaaatacaaaaaaaaaaaaaaaaaaaaa

SEQ ID NO: 201775 - DNA, 458 bp, Homo sapiens
agcgagaccctgtatcaaaaaaaaaaaaaaaatgcctattagaccttcaagtggtgaagacaagtaggtaattggatacacaagtctgggctcagggtagaggctgggctagagaaagaaatttgggagtcatcagtgaatagatgacattttaagccatgggcttggaggagataacctaaggaatgacgagaatacatctgaagatccagcctcagacactctggtgtacagaagcaggtagagaaaaggagaaaccattaaagacctctgttgggccgggcatggtggctcacacctgtaatcccagcactttgggaggccgaggtgggcagatcactcgaggtcaggagttcaagaccagcctggacaatatggagaaaccctgtctctgctaaaaatacaaaaattagctgggtgtggtggtgcacactcacttcactctagccagtagtccc

SEQ ID NO: 201776 - DNA, 472 bp, Homo sapiens
aaacagaggggctcacgttgccggcttctcccattacattttcatttctcactctgaaaaaggacagttctagcagtgtggtgggtggagagaaccatcattggcaagccctggagacctttctagccttgggttagaatgcacagcacccctctgtggcacttccagatatccaaacaagcccttctagacgcccttgtctcttggaacgttaaagacacagctccctgtcttccaaggcagcttgtggttccacagccttggagcgtcctgcagacagtttctgtttttgaaagtttttcagaaattatgcatttattatagagagaccatgtaggttcccttattccctttgtttagagcatcttttatttttacattttagtgattctgaaattgggatgcatcttaaaatagatgcatgtgtttggatatggtgctgtgcctttttcgtgtgaaggggtgttcccca

SEQ ID NO: 201777 - DNA, 427 bp, Homo sapiens
acatataaaagcgataatacaccataaccaagtgggatttatcctaggaatgaaaggttggtttaacacttgaaagccaattaatatatacaacataataatagaataaaagacaagacccatctatgatcttctcaatagatgcagaaaaaacaccgaacaaaatgcagcacccttttatgataaagacactcaacaaactaggaatagaagagaacttcctcaatctgataaaaggcatccacttaaaacccacagctaaaataatacttaatggtgagagactgaatactgtctcctgaagatcaggaacaagacaaggatgtccactgtcatcacttctattcaacattgtactggaagttctagctaaggcaattaggcaagaaaaagaaatggcatctagactggaaaggaaaaagtaaaa

SEQ ID NO: 201778 - DNA, 434 bp, Homo sapiens
ccccgcgccgccgccgccgcgagtccagctcgcaggaggaggaggtcatcgacggcttcgccatcgccagcttcagcaccctggaggccctggagaaggatatggccctgaagccacatgagcggaaggagaagtgggagcgtcgtctcatcaagaagccccgggagtcggaaacctgcccccctgcggagcccagtgagaacaggcggcccctggaggcaggcagccccgggcaggacctcgaacccgcctgcgatggggcgagaaaggtcccactgcagccctccaagcagatgaaggtcaccgtgtccaaagggggcgaccgggacagtgacgacgacagcgtcctcgaagccaccagctcccgggacccgctcagcgatagctctgcgcatgcggtctcggggagaggctactctgtaagtctcccagca

SEQ ID NO: 201779 - DNA, 397 bp, Homo sapiens
tttattactatttaatctagcataaccggtaaggcccattgtgcgaacaaccaatctgttcatttctgcaagtcctaatacattttggtttccttatgaaccaggatgcaggttctaattactgcttgttcagtttgttttggcaaaaggtgacatttagagggtttaaagaaagcatggcctctttttaagtgttttgcgttgattagtttttgaacttttgtggtcaaaagttctaatctcttatcttttatgatctgcattctcaagatctcacattattgggaagaaaatgaaggaaatgagtgaaggtctctcttacaagcagaattagctggactttgagaaacacgatgaacgtaatgcagggtttttcttcttttttttagctgattag

SEQ ID NO: 201780 - DNA, 450 bp, Homo sapiens
cagtcgtggcttcataagtcatataaatatggtctctaaactctgaatttacatctgtctccaccggtaaatatttataatagccaaaggatatcctggacattttctcctaatctgtttgaccctttccttttctgcttgatctagatgcttggatccaacttactttcttaaaccctcttgttcgtttaccttcatgtatatgtaagtccacacttggatcactgctatagtttgtttactactaatacagaggcctgaaggctactatagaaaatcacatagctgtgtagtttgccaacgccaggagtttaaccctcagctcactgaattattccttttcttgaccttaatcagctacttgtttcattcccctcaaagtttctctgaatctttgtcactctcctcaaagctcccttttctaactcacctctcttactcttagcagat

SEQ ID NO: 201781 - DNA, 558 bp, Homo sapiens
  misc_feature (21)..(21): n is a, c, g, or t
atccttaattaaattaattcnccccccccggtattatcatgaagaaaagtgcattgcttgctcttcatctacctcctctatattagatccaagattagaaaagaaaaaaaaaatactagcatttgacttcaaaattgagattggtattattcttcacagcagcaggaagttatttttttaatgtcagtatcacttcctcaaccttattatatatagatatgacagttttataaattataaaatataaatgtaaagtggaatcctccatgtaacttagttttatttcttaattggtgcataaaataaaaagataagaattacataaaattaatgacttagttctgggcaatataagtaactttcaaagaaagtttagtgatgtatttttcaaagatttacaaaattttattgtaaaaccagcattattttacatcattttgtcacatatactccctttaggtggttcatttctatcttactcttcctaagatgtccaatattttattttaatcttcaaaataacatttatagattgatttttagaagttccccttaatt

SEQ ID NO: 201782 - DNA, 534 bp, Homo sapiens
taaggtgggaacctccttcaaaagtggacatttctttggattcttgagacaactgcattaaattaatgctttttcatattccatccttccttcattaaaaaaatatttatcacccactatgtgccaagtatcttgttgggtactagagatataatagcaattaaaaagaagtccaccagctgggcacagtggctcatgcctgtaaatctcagtactttgagagacagagaagtgaggatcacttggatgcaggagttcatggttacagtgagctgtgatcaagccactgcacttcagtctgggtgacagagcaagacctgtctcttaaaaattaaagaggtacaccatcattgccttcagttaaacttagagtcagtttgtggtagaatgcaaagatggccccatactttacccatgcctgtaaacatgtcctttgcctataactttgtagtaccctcccactctgactctggacttgtccatgtgactaactttggccaacagaataagatggaattaatggtatgcccgtgt

SEQ ID NO: 201783 - DNA, 511 bp, Homo sapiens
ttggtgactcctgtgcagatttggcactgaaacaatatgaaattgttacacttctctggacaagtcattatgcttttggctcacaggctccacttccctggacaccccttcaccctaagcttcaagtaattcagcttcacccttcagagcagagctcagctgtcacttcctctaaggacctccccagccgcctctccagcagaagggcccccaccttgctctttgcacctctgtccctcgaggtgctgctgtcctttgtggaggtgaaaagaggtggtgttgccctgaacttcagcaaactgcagggacacgtgttgttctaccccaggtcagagtgtgtcggtcatcactcgatgccactcacagaccaccaacttcagaatatctaggtgtaaagctctgtacaaaagttgtaacataataatgtaaataattttacattattattaataaattattatttatagtacactattacataatgtaaaggctattaaaacatgtttgtctt

SEQ ID NO: 201784 - DNA, 315 bp, Homo sapiens
tacttttttttatattttttagtagagacggggtttcaccttgttagccaggatggtcttgatctcctgacctcatgatacgcccacctcagcctcccaaagtgctgggattacaggcttgagccaccatgcccggcctgtttttgtttttaatctcccatggttaagaaaataacccatgataaaaggataatctttggcctctgttgggtacagagaacaggcaaactacactggatgtgaacatggcatcgtgagtgtttttttgtttgttttgtttttgttttgagacggagtctcgctctgttgctcagg

SEQ ID NO: 201785 - DNA, 537 bp, Homo sapiens
tgctgggattacagtcgtgagccactgtgcctggctacattttactttttcttaagatggatgcttcaggttaactcaaaagagtaactgaggataggaggagaaaatagccttgaagaacgcatttctatatctttcttatattaggaggtaaatatagcaccctatttacattctaatcccaaagtttaattatatctctatatagtaagaaatagggctttaaaatcatgacacagaggtgtgaaagaacgtggaatgttcaagaaaaagtagttgagtgatgagagaatgggcaaaggaagtagagtttgggagtggcagatgctaagcttgaaagttaggctggattctgaatgtagggatgctttacagcgtgtgaaggagtttgaactattatgtgggcgatgcatttggatagaagtttttaaatagaggactgatatgactaaatttggtttaaaaagatgattgtttggaatgtggcacacagatgagagagacacttaatgctaaataactatacggtgactttca

SEQ ID NO: 201786 - DNA, 304 bp, Homo sapiens
ataacccagtactaggacttctgaggcttaaatcgacttgtatattgcccctaaaaatgtttctactaatttctactcctaaagtatattaatttagatattatctttgttttttcatcagctctgagaattgtatccaaaaacatacgagggaattaactgcatccattcagtgacaactgcaccattacaaagaaaggataggcataaaactcaatgaccaaaaagctatgaagcagttccctccttctctcactgaccggtaacccaaacacccaggaaaaaacaattgcagaatatagga

SEQ ID NO: 201787 - DNA, 269 bp, Homo sapiens
gaaatactaaaaacttaacctcaagaatttcattaggcaaagctcacaatattttttttggagatattctttaaaaaataatttatctttcttcaaaatcttcaaattgtaaaagtaggtgaggagtaggacataatttattctactgtgttggttaataaccttgaaagtttacttaaaaggcagtctctttcctgattatacaaaacatttaatgggaggaaaaaagcgctcttgaagtattgccatacacagacttttaaacttac

SEQ ID NO: 201788 - DNA, 165 bp, Homo sapiens
caaccaccattgggaccctggatcctccagggccgctcgctgcctgttctccagtggccacctgtgaccaggaaggtctccttccttcctgttgtctccatctatttaaaaacaataacaaagtaatgaatgaatttccttacaataaagcctctcatgtctgta

SEQ ID NO: 201789 - DNA, 395 bp, Homo sapiens
ctgctttcaaacttccaggctcaagcaatcctcccgcctcggcctctcaaagtgctaggattacaggtgtgagccaccgcacctggcctatattatttttatcaccacattaaataagatctaataatcacagtgattttgccgtggtgacaagtgtcagatgtgtttctggttgcaatgcaatctgaaagtatctgtggtttttattagggacaaacggacaaagtcccaggtcctgtggttgtcttcattaataattgagggaatggtaattatcagttagagtcagtgaaaataaagatgtgaaatttttttcctccatcagaattcacagacaccctgaacacccctaagaggctcagggaccccaggctgaagttcacctaaaagttctt

SEQ ID NO: 201790 - DNA, 378 bp, Homo sapiens
cgagttaggaggactgcttgaatccagaagtttgagggcagcctggaaaacatagtgacaccctgttctctgtaaaaaaaatcaaaaaattagccgggcgtggtagcacacgcctgtggtcccagctacttgggaggctgaggtaggaggattgcttggatccagaagatcacggctgcagtgggcctggagtgacagagcaagaccctgtctcaaaaaaagaaagaaagaaagaaagaaagaaaaagaaacaggtgtagggctggacacatggctcatgtctcatgatccgcccaactcgggctcccaaagtgcttgggattacagtgcgtgagcccaccggtacccggaccagtacttgtcagataagtaacactt

SEQ ID NO: 201791 - DNA, 377 bp, Homo sapiens
gcatcacctatgaattattctgatccaaaaaatatttaaactggatatagttaagcctgtaaacctaacttccactttacaggaaataaagcaatgagttaaattacagcatgagaaaatggacaaatccagaatgtaggatattctctaaaatgacttgcttgttactttcaaaaaatattcatgtaataggggaaaaaacatacataggtgaaaagagagataacagatatacagtacttgaatacggattgatcctgatttggagaggaaaaaacagctctgaaagctgtcttggagaagttgaaatttcaatataaactgactacattcagtgacattaaggagttatctttcatttttcttaggtgtggtaa

SEQ ID NO: 201792 - DNA, 472 bp, Homo sapiens
gtgcccttcattctttgtggggtctaatttcttcattgagtaaagactcacataagcttcttctctttctaaaacttagttctgatgaagccatccctccacctgttgtcagctgtgggaaccccatgtcacacacgtcctgtcccatgagctctatacatccccaccggggcaattctgccaatacgtaaattcacctaacgagcaatttaccagttgtagtcacttactggaaatgtgttcacagactttgtactgaatgaatccaggtggtctagagaggttgggaggagccaggaccaacattctgggacttcatacttcccctttctactcagtttccccctcttttttcccattatcctccttcctaactctatgctcctctctgccctcacaatcttgtgaagctggagacagctgagagccaggcaggttgcatatcatgaaaaccacctcactcatcatctgt

SEQ ID NO: 201793 - DNA, 590 bp, Homo sapiens
gaattctggtgtttgtccaggttccttggcttaccaggaatgaagatccgaactgtacagacttttttcaaaagtatgtacatatgtatgtatgtatgtatgcatgtatgtatgtatgtatgtatgtatttcctctttttaaatttaaaaattacaggatacatgtgcagaatgagcaggtttgttatataggtatcctttgctatggtggttcgttgcacctattgacttatcctgtaagtttccttccctcacccccagcccccaacgggccgtgttgtgtgttgttcctctcactgtgtccttgtttcctgaatgttcaactttcacttattagtgagaacatgccgtatttgttttttttttgtttttgttcctgtgttagtttgctcagtatgatggcttctagctttatccatgtgcctgcaaaagacataatctcattcctttttatgactgcatagtatattttggtgtatatggaccacattttctttatccagtctagcaatgaagggcatttgggttggtttcatgtctttcctattgtatatagtgctgcaataaacatacatgtgcatgtgtcttta

SEQ ID NO: 201794 - DNA, 401 bp, Homo sapiens
cctttgtctacaacttcgggtagcttcatagcccatcccccaccaaacccaaccaataatcatcttttttaacaagtaaacaaacaaaaaaacccatcaaatctcaaatctcttgactcaaaacctctgggagggaaagcccctcaaagtctccacttttaagctctccatgtgtccaccatccccccaaccagctctggcccaggtttggaaacctgctctcgcccaggttgtccttgcagtgggatccagggaccaccagttccagcacaggatgggcttattttaaaatgcagattcctggactcaccccagacttaaacatcagaatctctaggggtgcagtctgcacttgtagttagttttgcaggaggttttgaagcacattaaagacagagaac

SEQ ID NO: 201795 - DNA, 555 bp, Homo sapiens
agccgccgcctcctcttcctctgcctcctggaatagggacctaccctctgcaccctctactttttgccttgtcgccaggtcgctcccaccctcccaccgccccctccccagacaataccatcagactctccgaacgtcccaaccctcgccttgcccctcgaatgctccccaagccggaggggagccgttccacctttctggcaggaagactctggcaaggggagggaggcgggcgccggggagtcctggagaggcgggagggcgtggcggcggctctcacgttgcagccctgcctgcagctagtgggatgccggcggggccagcccgctcctgcttgcacacggtctgggaagagctgccgagaaaacaccgtctggcccggagaagcgcaaaccctgctccttctctctctcctgaaaggaacggaaacgttcccagcgctgcttaggcgctctccaagcgcggactctactgcggctcccaccgcgctccctgcatctcgcccttccctcctggggtcctggacttctctctgacaaagagccctccttcccc

SEQ ID NO: 201796 - DNA, 569 bp, Homo sapiens
agggttgttttacagatcaaactaatgagcaggtgctggaaaactttcagcacagtgtctgtctgagctcctactctgttctgggggctgggggcagagtactgagggtatgaaaaggaaccacagggcagtggttcatgcacaagtatatgtatctgtcaatttctctttcatcccttgcctgccttattcaaatactaaacaaaacagagtgatatgaggcagcttacagtatacctataatacaacagaatcaaaaataaaataagctgggacgtaggataaatgaaggtaggaaaatacactgcagctgggaaaatgttagtaaacaaaatgtacatcagaaaatcccatatatttgctaggcatagacacaaaatttgttctgaacttccagatagtcacgcacaaaactatgcagtaaagattaataatgttctcaagttaggcaaaagccagtttccaaggggaagaccagctttcctgttgcaatgtcatgaaggggataaaaagggagaaaacgacattggctataacaggaaattcaggagagtttttaaagagctatt

SEQ ID NO: 201797 - DNA, 1481 bp, Homo sapiens
  misc_feature (2)..(2): n is a, c, g, or t
gnctacgtcccctttctcatcgtcggctccatcttcattgcgttcatcatcctgggctctgtagtggctatttattgttgcacctgtttgagacccaaggagccctcgcagcagccaatccgcttctcactccgcagctatcagacagagaccctgcccatgatcctgacctccaccagccccagggcaccctcccggcagtccagcacagccacgagctccagctccacaggcggctccatccgcaggttctcctttgccagggctgagccgggctgcctggtgccctcaccgcccccgccatacaccaccagccactcaatccacctggctcagccatctggtttcctggtgtcaccccagtatttcgcttaccccctccagcaggagcccccactgcctgggaagagctgtccagacttcagttccagttgacacgcccaggccatgaatccacaactcagtcagatggcagacaggtggagccctgctcccattgccacatgcaattctgagaaaatttcccttgtaactgatcagtgtcatggaggagcatgctaggaaaacacagcaccttctaatttgaaagttcctgtctccaatcacagaaaggctaaaccagagaactgttttctggttttgcaaacatgtgatcattacatttcaatctatgctacttttattcaaaatatgcagcagtttgactttaaagttgcaaactggctaaaaacgttttactggacattcagctatattgcttagaaaagggctacatgtttctttttcatataagttgttcattgagttatgataggaatatattcataaataagcaaagaaaaatacctaattgtaattatcaaaggttcacttaaaaaattaactattaggtaaacttaagggggcagtgaaaaatctatttatgatttcgggagtaacctaaccatgaataatattagcataatgagaacatttactttttaaataaataactaaattttgtttacaatatgagtttttccagaatacaaggtttcaataatcacatgaggagtttaaagttttaaatatatactcagacattcattgtaacacagagtgtatgtaaaatcatttcccccactcactggagggagtatttattgcagactttttgttcagcaacatttagtgtttcagtgaaagttggacagttggggcttaaaacatttatttgtaaaatgagctatgttcaaatgtaaatatttgtaatttaatgtatttaccacattgactgtactaattatttagtagtcatactgtaatttttatgttaataataactggagttcaaagtctagctattggtataatcatctaatattatatatatctccagtgcccctgaattttatgtttgatgactatatatttgggcatatatcttgttggattagaataaataaaacactttatattttcatgaactctaaaaaaaaaaa

SEQ ID NO: 201798 - DNA, 318 bp, Homo sapiens
gatccagcaaccaagagtttaactccaagcacagcagaggggccccaggcccctgctccaactgtgctgcctcctgccactctgattgggggtggcacccttcaggttggtgagtgtccctacaggttgtcccacagctgcagacaccctggccacacacctctcagactccagctccacggattggggaaggtcctgctggagtctgcttgcatttcttctcgaagctcaaacgcctgctcctcccttcctggcctcctccctcccttccttacccctgacccaattaaagaactcacctaccgggaagcactatat

SEQ ID NO: 201799 - DNA, 458 bp, Homo sapiens
ggttacagatcatgttggagggcattcatttattgttatttgaaaatgacttcacaaagagtgttttctctggaataatttggtttgtacccatttggttatttttcagtaaatacatgttgagtgcctgtaatgtgccataggctgttccacacaccctagctacagcaatgaacaaaacagcaaaatctcttccctccaagagcttagcatctagtggagagaatgcagacaataaattaagatgaagagtctaatataggatatctggatgtgtattgttgttgagctggtgtccctgttgggggaaggagggtctaggacttcctcttctgctatcttgctgacatcattttccgtttggaattacatctttaatatgttaaaagaaaatagctactaatgtaggattccatggcttttaatagaaagactttaaaaagaaaaactaaggagat

SEQ ID NO: 201800 - DNA, 492 bp, Homo sapiens
gagaaatccagtgttggagaaacatttggctaggtgatgatacaattaaccaagagattatgagaagaatatatctagatacaaaaataggaaggagaaaacactaacttctgaattttaaacaagttgagactgaggtgtttgaagcatcaataaagagttgtgtaagtgtagtactcaaaaggtcaagattagaaaaatagaataagtcacagtttgctcaagttcgaaacattactattactattactattactattaccaactatataccccccaaagaaatccacagaatgagcaagtgagcagagagaggacaatgacaaactcctgtaaattactgcagtactccgattcataatatctactctggttgccaagtagtttttttttgtttgtttacttcttagatctgaccacattaacctccagttaagtgaagttattatatgtaccatataaataagatttaccaagcatggttctattcat

SEQ ID NO: 201801 - DNA, 318 bp, Homo sapiens
gaatttcagaattgtggataaaggtttatggctgtgtgtgtgctcctttaaccatgtactccatcccttttatcccttttgtgtggtagttgggacacaggcaagaaatagatctctcaggactgtttggagtttggctacataggcaaagataaaagtgctctcatgttgtgaatatcgtgctaacattcttccttgccttctacctgctcttgaaatatgatgtgctgagactcaagactggtgatattggctagcagagaccacctatggtatatttgctttgtgtaagaataaaatgtctacgtgtttttgttt

SEQ ID NO: 201802 - DNA, 673 bp, Homo sapiens
ggcaaccctgactcggaccgctcgggagagccccaggagaggccagcgccgcgcagcagccgccccgctgcgcccacctccccggctgctcccggagggctcacaaaggcggtggccgcccgagtggccttctccatccaggcgttcgcgtcctcctccccaccttctctcccgaaggcgaaaatggcagggccaggcgagaacctgggacagcggtggccctagccctgcgatcctcacccctcctgctaggagaggctgcgggctgcccgcggacgatgtggccgcggctgctcccgagcgcatcttcggcccgggtccccgccgccacccctcttctctgctccttccatcccgcccagaggagttgatgccgctgtcgccgccgccgccgctgctgaagccgcggctgatggatgccagggagtgccgcattgcttagcgaccccgcctctgggtttgctggtaggagcggctgctctttcttctttcttgctttggggttttatagaaaagataaggacatttttattttattcttcacaacgtcctccccttctcttcgtttttgaaatgtgcattcccagagatatccccggtcccctccctccccctccccccttttctccaaccccgcggcaagtccgtggaaatgaagggctagaggaaggca

SEQ ID NO: 201803 - DNA, 519 bp, Homo sapiens
acaccaaaattcatggatgctcctcaagttcggcagtctgccctgaagataggaaaacgtcctatacacacatacaaaaggtcagccgtctgtatctgtgggttccacatcctacaaatgctattatcttccatcccagttggttgaatctgcaggtgcaaaacccgtggatacagaagcccgactgtatttcctttttttctgagacagagtcttgctctgttgcccaggtgggagtgcagtggtgcgacctcagctcaccaccacctccacctcccagattcaagcggttctcctgcctcagtctcccaagtagctgggactacaggtgcacaccaccaatgcctggctaactgtctcactttgttgccgaggctggtctcaaacccttggctcaagtgatcctcctgccttggcttcccaaagtgctgggattacaggtgtgatgcatcacacctgctgtcttttattatataattttcctacctccctgaggtttatctaatattaatacactgt

SEQ ID NO: 201804 - DNA, 661 bp, Homo sapiens
gtaactttgcatatttccctttgtctaaacaaattaggaatagaagggaacttcctcgatctgaaaaagggcatttataaaaaccaacagctaaaattgtacttaatggtgaaatattgaatactttccccattgagggggagagtaaaacagggtttcctattttcatgatttatatgacatattaagtgctgtatttgaattcctaacctgtgagataaggataagagaagatatatataaaaatcagaaaggaatagtaagaatctattttcagattaccaaacaactactaaacctgataagtgaatatagcagaatatatagtcattacccaaaaatatactagaagtaaacaattggagaagtaagtagcaacaaaaaacacaaaatacttaggaataaatttaagccaaaaaaccctacagatcattgctaagagaaattaaagaaccactccccccaaaatcacgaaatatattgtgaattctatcaattcagtgttcttctagtcacagtggcaggaggcttttttgtatttcattcatatggagtgcagaggactggaatatccaaagcaatcttgaaaaaagttgaagccctgtgtggtggtgcactcctgcagtcccagctacctaggaggctgaggcaggaggattgc

SEQ ID NO: 201805 - DNA, 454 bp, Homo sapiens
  misc_feature (422)..(422): n is a, c, g, or t
cctagaggatccccacgccgcaccgccggttcaaagtgctggcattacaggcatcagccaccacgcctggctttcttctgtgtttttttactgaagtatttaggccattaacattgtttgtaattattgatatatttgggtttgtaacaatcatcttgctctttattctgtttctcttatctatccttaattctttttctaattttctgcctatttttgtattttttaaattatattctattttacttctactactggctaaatattacggcactttttagaattttgagtgctttttttttcctagaggctttcaacattcatttttagctttcaatgtctagttttacatattataccctatcgtatattttgctgggatctcacacaaataatacttccattccaccttctcacctttngaaccggcggtgcggcgtgaggtaccgagctc

SEQ ID NO: 201806 - DNA, 449 bp, Homo sapiens
  misc_feature (417)..(417): n is a, c, g, or t
gcgactagaggacccagcgcacgaggtcaaatgctggcattacaggcatcagccaccacgcctggctttcttctgtgtttttttactgaagtatttaggccattaacattgtttgtaattattgatatatttgggtttgtaacaatcatcttgctctttattctgtttctcttatctatccttaattctttttctaattttctgcctatttttgtattttttaaattatattctattttacttctactactggctaaatattacggcactttttagaattttgagtgctttttttttcctagaggctttcaacattcatttttagctttcaatgtctagttttacatattataccctatcgtatattttgctgggatctcacacaaataatacttccattccaccttctcacctttngaaccggcggtgcggcgtgaggtaccgagctc

SEQ ID NO: 201807 - DNA, 374 bp, Homo sapiens
accgaagttcttgcctggtagcctccattttctcgatgaaatataaggtaaagatagctgagagacttgtacagagaggggaatttaagggtcaattaagggtatggaatagtcatcttggagataaggaaattgactgaagttcttgcctggtagcctccattttctcgatgaaatataaggtaaagatagctgagaggcttgtacagagaggggaatttaagggtcagttaaaggtatggaatagtcatcttggagataaggaaaatgtcattacaaagccttgacaatgagtccagttatatgaagtttgtaagaaattagctactaattaagttttctttgaatgaaggaaagaatgcttattctatcac

SEQ ID NO: 201808 - DNA, 233 bp, Homo sapiens
aaatattcttaaatattccttgcagtgttaagtaaatattctttttttgtgtgtgtgtttttttaaagatttatagttaacccttcaataatgcaggagtaaagagcactgatcaaccaaacagttaaaaatttccatatgctatggtttggctttgtgtccccacccaaatatcatgttaaattgtcattcccaatgttggggagggaattggtgtgaggtgattggatcat

SEQ ID NO: 201809 - DNA, 463 bp, Homo sapiens
tgctatgctggtggtacaggctcagtgatgggaaattcaagtaaggaaaatagaagactatgaaagtcggtgaattcacttttgtcttctctggatatttagtcccttagcactgagtggaagggcttcacagaatccttggtttttcaagaaaagaggagaaaactcttctatagattgaaaaattatatggcacgtggattttgaagaaagtattttcaagggttagatatctcagatttctgttctgttgtctcttatcctcctctttccacaacctaatggaaaagctattcttactctccagcttctctacctttagaactggggaaacaccaccagcatgactcactggggtgtggtgacggttattttttcttaattagtcaaaatgtgcaatgtgctaattacttgaatcataagaaaaaaatcattaaataaaaatcacatttgactggcttta

SEQ ID NO: 201810 - DNA, 775 bp, Homo sapiens
tcccccacccaaacgaacaggaaggaaaatgtcagctgggctttgtgctctgttcctcaggctgccgcagctcccatctgttggagccaacgcagcttctaactgggcgactggcagggttggagggggtgggctgggcacagcgctcagttgccagagatggactgacaggccctctgcttgagaactccaggacctagggtggtgaggagaacagcctccctaggtcagggcagtagaggtgactccctgccagtttggtcactgtcataggggaagatgtaggtctccccatgcacccaggccgatggcaggctccgtgcccccctttcccgccagtctaggatgggctctggcccagcgttttgtccctgaataagaaggccaggagctcctcccattgcccactgcttcttaaagatcccttcaaaaaagagcactgggcatggagggtagaggtgggctctgcactgggcactggagcccccttgcctttgggccctgtggctaccagaaaaagccacatgtgggtggcctgacccactttcctggccaggtgctgttgtggcgaaacgatggaaacagaagggcagagctagggatctgagcctcctaggccttcttccttcccctgtgctgactcaggcttctccttcttgcggagggctctctctggtcctgggatgggtcctcattatttgcaaagcatggaactaaaggcctcagtgcctgggagattgaggtctgcccagggtctggcacctaggaacacccc

SEQ ID NO: 201811 - DNA, 645 bp, Homo sapiens
ttgcttgttttttgtcggtaatcatgaaattataccaccagctcacaagagctaggaggacttgggacaagattttagagatgttaaagcacgccatccacatgatctcattaaatcctgacaatcatgtatggtgccgggatttaccaagaacacctggcttattagggactctgggcccagggacctcggcacaacagaatcactggtgagatgctttgtgtggtgagaggctctgcggagacggggatggggagctgggcgtcttcccggctaaggaggagagagtttctatgacttagttagtttcacttctgaaccttcagaagcagccagggccaggaggacaccgcctgtcccagagcctccagaccatcaaaggccaccttcccttgcttctggggacacaccttgtctgtatcaggaggaggggctgcagtccaggaagccaggcggacttagccctggtgctccccacatgactcagctgcttcctcccaggggccccagatgccctgtcaaggacacgtcccagtactctcgtcaagctgtggcaaggacagagccaagatttcaaagtagggctgtctctctccgaagctcaacgtccttccaggacagggcactgtccatcccaagcaccta

SEQ ID NO: 201812 - DNA, 144 bp, Homo sapiens
attacaggagtgagccaccatgcccggccattgaatctccataaccatcaagaggtacagtaaacatccccattttaccactgagaaaacagaggcacctaaaagtcagttatctccaagataatatccacagacccagtaaac

SEQ ID NO: 201813 - DNA, 338 bp, Homo sapiens
gtgcgagggaaggaaggtcctgaggcctgtgttgaattaaaaagggcgtgactcaaagtattgcagccagctgcaggggagaactggaacagttcttgatgagtgccaaggtcagagctgggaagtcaatttcatgtgtgccatccaaaaggtgaggccaggacagaaaactagtatggaatattagttgtgcctgggggcaatggtcaacatccataacaggtatagtaatatagagatatggatatagaaatataatatatgtagatagagataaagacatatttggacatattggtacatattatataatacaataaaatgaaaatccataaaca

SEQ ID NO: 201814 - DNA, 376 bp, Homo sapiens
gtgggctccacaaggtcactgatgacaccaatgtcactcggctacagctggagacagagatggaggctctcaaggaggagctgctcttcatgaagaagaaccaagagaaggaagtaaaaggtctacaagccctgattgccagctctgagttgaccatggaggtaaatgcccccaaatctcaggacctcagcaacatcatggcagacctcccggcccagtatgatgagctggcccagaagaactgagaagagctggacaagtactggtcccagaagactgaggaacacaccacagtggtcaccacgcagtccaccaaaataggagctgctgagacaacattcatggagctgagatgtatagttcagtcctaagagat

SEQ ID NO: 201815 - DNA, 185 bp, Homo sapiens
acttatccaggtctcagcttaagtgtttttcttcataaaggccttttatgagcatattttatgtatttgtgagtttgcttaatgtctgtctgacataagctacacaagagtgaagtctgtccgtttgattcaccacaatataagcagtgtctggcacagggcctggcacatagtggtcccgctcc

SEQ ID NO: 201816 - DNA, 594 bp, Homo sapiens
gcaggtgatctagaggaccccatgtctctcactgaacctcctaaaattgaattaatacctctcctctgtgttcctatcaatttgaacacatatcagattgaaaataagctgggtgtagtagctcatgcctataatgctagcacttcagaaggctgaggcaggaggatcacttgagcccatgagttcaagcgatatacccacctcagcctcccagtgtgctaggattacaggcgtgcaccacctcgcctgcccatattttcctatcaattattctactattaatatttttatttaggccaggcgtggtggctcacaaggtccagcctaaataaaaatattaatagtagaatatacatacacatatatatatatatatttagacagagtctcactcttgttgcccaggctggtctcgaacccgtggcctcaagcaatctgctcacctctgcctcccaaagtgctgggattaaaggcataagccaccatgccagcccaagggaagccttttcgaagagctaattctgaatcttcatcctgtggattaataaattagtctggtgaaacagtgtgagaagagaatactatactgggcaa

SEQ ID NO: 201817 - DNA, 328 bp, Homo sapiens
ccatgaaggcttgatgagggcttaggagctttatttctacagaaataatccattctctgccatctcatctgaagttcggagaaacaagaattgcttctctattttcaaaccttatgttttcttttacaaataaaaatacatcaaatttatttattgagtacctactaaaattacgggatctatgtccttaaggaaatcatgctgctgtagaaattctgatgtgttatacaatgatttagaaatgtactgtggaatcttataaactgcatttgatatgtgtggctaacctcctaagataaaactttgtctttcataataaataactatt

SEQ ID NO: 201818 - DNA, 1200 bp, Homo sapiens
gaatctgccaaattttcttaggctcattatccactaccaccatattctgacttgtggtggaattaataatatttctagaagaaatatttgcaatatttaagcaaattttagaatttttatactagaaataagatcttggacataatgtaactgtatgtctaggtggtgctaagtaacgagactttctgcactgagttttagaatgaagaatgggaaggaaagctcttcctaaataaagcaggaaacatggataccagcttaccatttgtaaccagaggtgtttcttaatctttttcagatcagttgtacaaaagttaagacagcaataatggtttttatagaatgttctcatgacggttaaatattaagatgtatgtgaagtacatagcccagtactagaaagatctggcgtctcttctgattatttattgcctgtgctgtaccagttaatgtttggaatatcagtactgtattcaacagatatctatttgatatctagtatgtgattgggccagtaataggccctaaggggacagtactatttttatcttcatggtgctcactttctagttgaaggaggtagaaaaaataattattgcgggtagtgataagtgaaacaaaaataataagacaggattggggtagagtgacatgaattggggagaaggaaggattccatgagatcagttgtgaaaggaggcttctaagaaagcaacactggagttgagaagggaataagaaagagccaactacctggagattggtagaaggatgaaaagacatgcacaagatttgaagaagagtttatgaagatgaaggcttccaatgaactgagatttctacatcatggggagggtaataaaaatgctctttaaaatatgttaaacaaggtatctgtatctatgtctgcatgaaagtagagaggagacagaatagctgatgcaacagatgacagtgaataatcgagtatctacagcttctacaatgatcatcaaccaggttctttctgcccaactgcagcaagtcaatcactgagataatggattttgcaaaagagaagactattcatgaggcagccagtgaggaggtgaagaacaggtctcaactccacctcccagaagataaggcttagggatatttataggttatagaagtggggtcagctaagatgtgggaaaaggtgattgtcagtgggggaaa

SEQ ID NO: 201819 - DNA, 406 bp, Homo sapiens
gtgagacattcttgccaaaagcaaacccgggtgaatcatagctggagaccttatttctcatttatgggaaattaaggggacagaggaataagtttatgaccccacaaggaaacagatccaggaaagggaacgttctgtaacacattggcctgcccattgccaaagaaaatgtctttgaaaagaaaaaaaaaaaggccaggcacagtggctcacgcctataatcccagcattttggaaaaccaaggcaggtggatcacctggggtcaggagttcaaaaccagtctggacaacatggtgagaccttgtttttaataaaaatacaaaaattagctgtgcatggtggtgtgtgcctgtagtcccagctactggggaggctgaggcaggagaatcgcttgaacctgggagg

SEQ ID NO: 201820 - DNA, 516 bp, Homo sapiens
ttccacaccttcccctagggctccatgctgcttgtggagcctcacagccaggacctataataatagcctgtttgcagaggagtcagatacctttcctaggccagccctgacaccaagatccccacagaaaaaagcatcgtctccccgcaacctccttgccacttcccctaattacgcctggttctattccttattttctcctcttatttttttttctatcatccatccatggtggcctggaacactgcaagagagtaaattcaaaaacagaataaaactacgcttttgttcaagcacagaaaacaaaacttaaagtcagcaaacctgggttcaggccccagcagtgccacccatgagctgtgctccttgaacttaaagtcagcaaacctgagttcaggcctagcagagccaccgatgagctgtgctccttgtgcagctgctcatcccttttcagttctaagttccttgtctgcaaaatgatcaaactgtctcatgatgtcactgtgatgagtgagt

SEQ ID NO: 201821 - DNA, 615 bp, Homo sapiens
tttcctactgcatatgtgttccacatagccaccccagcaccatttgtgccctctgagaacacccagactcttctggtggattgtgtattctctaaaaattctccttggcctcacaccatccatttcagtatcctccctctttttctcatactcagctactccttcagggctactctttttctcttgcctggtgattaaagaagcatgagagattcatccactcatttgtgaatattgatcaagtgtgtactttgtgccaggtactgggacatagccccaatgggggaaaggaagtgttttcaaagagtttttagtctatttgggaattaaagctgtggaaaacataattgtttgatttatacttttgcaagagaacatctgctagcaacagctgacttaatcttagagaggccacataggggcctccctgagatggtaaagaacattaaagctgagccctgaaggagtgtgaatggtgtgtgtcatggggagagtagtctcagcagaggggatagggttgttgttgagagatgcagagagaggagctgaaaatccaggattcctagagcaagggaatcgttgagtggcatctgattgaggtaggaagaaggtaag

SEQ ID NO: 201822 - DNA, 432 bp, Homo sapiens
acaggtgttatgtggggcatactattgtttgcttttgttgagaatcaggtggttaatttttgactgttcttgatttctaatgctgaaatgacatgattctgttattcagcaaacttggaaatcttgatgttttgacaactgcctcctaggaaaactggccatatgttaattaacctagtagatggaaaattaaggattatgtgaggttaattttaccctgataatgacaaaaccttgatagcatttaatattaatacttcttctcaaaattgaatgtttatatcaagtactgatttttattttaaaaaagaaaaaactataatccttctgccttccaaaagccatgctgtgatagctgcccaggctgctctgttacatctcccatttattgtttacttttataaatttgcttctaagatggtatgtgtttca

SEQ ID NO: 201823 - DNA, 444 bp, Homo sapiens
tgcaaatatgactgctagaacttggcactgtcgtgtactttgatgactcatttggtagagtggaagaccgtcggtctctagaacttggcactgttgatcatctggtagataattctttgttgtaggcggggggtgccctgtgcattagcctcttcccactagatgccttccccctagttgtgacaaccaaaaatgtctgcagacattgcccactgttccctaggggtccaaattggcctggttgagaccaccaccctaggtagtacatgcttcaagcacttgaaggcctactatgtgccagccactgtgctaggtgctgcctaaagaaaaaaacagtagcctcctatctttggactcagtagaacacaggaagatagggttagcttgcgagtttatgagagcatgtggattggtatatccaaggttagtgatctgtccaccctg

SEQ ID NO: 201824 - DNA, 737 bp, Homo sapiens
cacgtgtatatatattatatatatatatacgtgtgccatgttggtttgctgcacccattaactcgtcatttacattaggtatttctcctaatgctatccctcccccagccctcaccccatgacaggccctggtgtgtgatgttccccgtcctgtgtccaagtgttctcattgttcagttcccacccatgagtgagaacatgcttgcaccgccgcttctaaatgttttaaaaacagacaccaatgcccttcattggggaaatgaaagacttttaagtaaaacgattttgagtgaaataatatttgttgttttaaaaagttaatattaaccactctccatcatatgttgaaattatcttaagatgtgaaagttaaaattagaaaccttgtaaaggaaaaataggaaatagtttcatgaacttgacacaggaaaatatttcttagactagatactgtagcactcaccacaataagaaatcaagcgaattgcacttcatttttaaaaagcttctccttattatgttgttgtttaacaacttaaacgctatctctagaccaggaataattatttgctatataatacagcaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaa

SEQ ID NO: 201825 - DNA, 230 bp, Homo sapiens
tctgaggatcccgtctcacttcatcgcgttcagccaggcaacaagagagaattcccgtctcaaaaaaaataaataaacaaatgaatctgtgcatctgcctagaacagctctgtaatatacaaagaggcacatttgctgcagcactgtttgtaattgtggaaaactagaaataatctgagtgttcccaatagggaaatgggtaaggctcattcatacaaaagaatacaaaa

SEQ ID NO: 201826 - DNA, 664 bp, Homo sapiens
ccttgctaatatcattgagccactgagttaatcaaccctggatattacctcttgttatgtaagactgcttgatgtgtaaaataatagatgtgcttgtcatctaagccacttttatgttattcgtattaacagaaaatgtgtattaatgatacaaatttccatgatggacccaaatgactatagagccacccaagcaaatatgaaatatttcaggaaaggaaatcagttagagcatagactgcatttctgaactctagttgattgtgctaccagcccgttacttattattataccatttagtctattatttccggctcctttttgtggcctacatggtgcttcatgtcagttcccagccttttcttccaggctctatcttctgtgtgagatgctccttgcaggaagtctaactgtttattactctggaggttttagtttgaagtttttttagttgacaaacaatgaatgggattgataattatcttctggggtccttgtgaccttccaattttcccagttgaagttctctatctgtagggtatgctctccttccttcagttttggggcttaccttgactctaatcaaggcaagatttaagtctaactcattagtgagattagcaagagttaaatcaacctaagcgaagcctgaccagataatgta

SEQ ID NO: 201827 - DNA, 284 bp, Homo sapiens
ctagtatttgatagaacaacagggtggctacagtcagtaataattataaatttagaacagacctcagggagtacaactggattacttgaaacacaaaggataaatgcttcaagtgatggataccacatttactctgatgtgattattatacattgtgtacctatatcttatacattgtattcctaaatatatatatataatcaccacctactatgtacccaccaaaacaaaatttatgaatgaaatgagaatcttctttaaaagacaaatactcccccattaaa

SEQ ID NO: 201828 - DNA, 276 bp, Homo sapiens
tcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaacaacatcccagagccagttgtcatcggaatagtctgg

SEQ ID NO: 201829 - DNA, 487 bp, Homo sapiens
tgtcagattaccggcgtgatccagtcattcctggctggtgcatcttatatattattttcttgggataaagttaaagaagtgggatgggtaccaaagggtcagaaaagtttgggatggttgaaacgttattgccacattgcttttgcatgagaagcacctccaaaagggttggcctttagggctgtgcccaaatgagctttcttatactgtttatcatgccacttctggtctcgtcggtgactacggagcttcctagcagtacgaagtccacgacacttgcccatcctgtcggcgccacgggcctgagcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaacaacatcccagagccagttgtcatcggaatagtctgg

SEQ ID NO: 201830 - DNA, 940 bp, Homo sapiens
cttaaacatctcatcgcccttcctccttccaacatctcattgcgccttccaacatctcatggctccttccaacatctcatcgctccttccaacatctcatagccaccatcaccctccttaacctctacattctacctacgccatgagatgttggccttccaacatctcatagcgggttgtgcattcttctctggagacaccaaatttcattggagtatctctccttacaaatgtatttccccactagattggcccctcaagaacaaggattgtattttagttacctctgttatctctgtacctggggaggagtgagaaaagagagcaggaaaggcaatggtatagtaccaacatttgttgagcttctattatgaggaattgtctatgctacacattgtacataaagtatgtatgattcacagtataaacattataatctggaatcaacctaaatgttcattagcagatgaatggataaagaaaatgtggtatatagacgcaacacaatactatacagccataaaaaaaaaaaagaatgaaatcttgtcattcatggcagcatggatgagcctggaggacattacgttaagtgaaaaaagtcaggaacagaaacacaaatgccacatgtcctctttcatatatgggaaaatttaaaaagttactctcatagaagtagagagtaaaatagaggctactagaggctgggaagggtagaggggcaagggtcatagggaaaagagagttaacggatacaaattacagctagaaagatgggaagagtgaattccagtgttctaaagcagggtaggtgactacagttaatgattatttattgtctacttattgtatattattgtatattttcaaatattgtatattttcaaagaggattctgaatgttcccaacacaacaaaataataaatatttgaggtgatggat

SEQ ID NO: 201831 - DNA, 1538 bp, Homo sapiens
gagggagagggagagcttctttaggttcctggtaaggatctctgaagacaattccttaggcttggataattcccagacatttgctaaaaagcagcatcctccaaagctttaatttggatcacaggaaaatgatgctcccgcctcagattcaaacacagttttatctcacactgcaagctccctggcatgggcaaagtcctcgatgcctttcctggtggtttccaacatcaaggacatacttgttcctcctcctagctctctccctcagccaagtccttccttacaatgaattgtcctgcagaactccctcttaagcttggcttctgggacagaaaacctactttctgaaagggtatggggactgtcagagcatgaactggactcaagctcccaattacagagcagacacaaggctctgcctgcaccaggccatccctggatttctgcagctccaggactctcttccagcatctagatgcagctactctcattccagctttgtgtcctgtttgatgcaaaatctttattccttcctgtttcaatccctgttgcatattctgtgtgacaaagcaagaagctggaaatcgagttctgagctttatacccagctctgccacaaatgtgccatgaccttgaataagtcacatgacttatctggacctggattctctcatctgtaaaagaggaagctgagctatactactttttaaaatgtctccagctttaattttattagaatatcagctgcttcctcctctggtttctcatggcaggttgtgcattcttctctggagacaccaaatttcattggagtatctctccttacaaatgtatttccccactagattggcccctcaagaacaaggattgtattttagttacctctgttatctctgtacctggggaggagtgagaaaagagagcaggaaaggcaatggtatagtaccaacatttgttgagcttctattatgaggaattgtctatgctacacattgtacataaagtatgtatgattcacagtataaacattataatctggaatcaacctaaatgttcattagcagatgaatggataaagaaaatgtggtatatagacgcaacacaatactatacagccataaaaaaaaaaaagaatgaaatcttgtcattcatggcagcatggatgagcctggaggacattacgttaagtgaaaaaagtcaggaacagaaacacaaatgccacatgtcctctttcatatatgggaaaatttaaaaagttactctcatagaagtagagagtaaaatagaggctactagaggctgggaagggtagaggggcaagggtcatagggaaaagagagttaacggatacaaattacagctagaaagatgggaagagtgaattccagtgttctaaagcagggtaggtgactacagttaatgattatttattgtctacttattgtatattattgtatattttcaaatattgtatattttcaaagaggattctgaatgttcccaacacaacaaaataataaatatttgaggtgatggat

SEQ ID NO: 201832 - DNA, 904 bp, Homo sapiens
  misc_feature (1)..(1): n is a, c, g, or t
nctcttctccctgacaagtctgagccctgaacaaagagttaagttaccttttaaggatttcgtggggcggcaggggggaatctgtgcaggaggaagaatattacagaatgcaagaaataacagcatgcccagcgtgggagggcttgcacagacagaagactcgatcatgttatggaagggggccgattggtagagtggttgtcagtgcagtgaggggttgggatcgagtgcaaagtgaagaggtgggcttcagacaggggcatggacacttcataaactgttgtgggataatttaggaatcagaccgaggggttgaggaggatatattatttaggtgcaccggcccagtcggattaacatccaaaaagtctgagccctgaacaagtctgagccctgaacaaagagttaagttaccttttaaggatttcgtggggcggcaggggggaatctgtgcaggaggaagcatattacagaagcaagaaacaaagacaattattcaattaattgagacatgcattatatcatttcttactttccaaggaaaaaatgtgttttatggcttgagtttatctgtctagtgaccttgcagctgcacagctagagaaacagggtcttcacaatgcctgggaaaggaggagagataaggcttactagccacagaaaaacaggcagataatttttaaagggctccagctctttctctttctcagggggaattgggttttcttacatagaactgagtttctgcttacacattctttaatttcttttaactcctattccaaaacaagtaagttcttcttatttttgggggggatagagtctcgctccatcacccaggctgaagtacaggggcgcaatctcggctcactgcaacctccacctcgcagatttaggtgattct

SEQ ID NO: 201833 - DNA, 295 bp, Homo sapiens
atgctcggtcccaaatctcatgactccttccaacatctcattcccccttccaacatctcatgcctagagccagttaacaaaaaccgggattgaaataaaaacactagggccatgagatttccaacatctcatcgctccttccaacatctcatcccgccttcccacatctcatggctgatgaggttggagagatgggcaggcattatgctaaagagcctgtattccaagcttcctgaaagctttgggaaacaatctgcttttgctcctttaaaaaccctaactctgggccaggagt

SEQ ID NO: 201834 - DNA, 357 bp, Homo sapiens
ggaaaaaaggggtaaagaacgggtggaaaaatataaaacaacacagtaatagatgtaaacctcacaatgtcagtaatcacattaaaaataaatgatctaaaggcaattaaaaggcagttagtatcagactgagtgaaaggtgagacccaagtataaactataagaagtgtgttttacatataaagacaccaatagcttaaaagtaaaaggaaggaagatgatatacaatgagaatactagtcaaaagaaaactggagtgactttttaaatatatcaaagtagatttcagagcaaagaacattaccagggataaagaaggtatcatgagggccagtctgccagaagaccataacactc

SEQ ID NO: 201835 - DNA, 868 bp, Homo sapiens
aagtgacatattctcagacatcatttttcaattaagtatgtgtcttcactgcttgccaggatggctgttatctttcaaaatgtaaaagactgagaaaatacatgtttattttcaggtattatatcttgatcaatcctctttaagaggaagtatattttaggtagtaggtggataatggagaatttccttgtgtcacacctaagaagcaatatttttgttctttaatagttagttagtttaatattttgtgccaccttcttttcatgtcttgaaatgtgatgtatttaaacgcttctcgttaccttgagcttaaagtcttgcagcttattctgagtgtctgctatttgcaagtgtaatcttttgctgaaaaataagtttattattacagaaaagaaattgttcccatattttctgattaatgatctcaaattatatgcataaaagtcttaaaggccaggtgtggtggctcacgcctgtaatcccagcactttgggaggctgaggtgggcagatcacttgagctcaggagttcgagaccagcctgggcaacatggcaagaccccatctctacaaaaattataaaaattagcctggcttgttggtgggtgcctgtagtcccagctatttaggaggctgaggtgggagaattgcttgagcccgggtggtggaggttgcagtgagccaagattgtaccactgcactccagcctgggtgaaagagccagaccccttctcaaaaaaaacaaaaaacaaaaaacaaacaaaacgcaaaaccaaaaaagcaggccttaaagcactgcgtagcactgttttgaaaaagttgaatttatttcattttattgactgctttggattttatttctttcctct

SEQ ID NO: 201836 - DNA, 333 bp, Homo sapiens
taaggcctttgaatcctgtttctgaactggcacagataacaccttaatgttaataagaaagtcctatctttttcacacaagacacctccagcactaggtcaacatgcctaaatgaagatcacttatccaccagcaaattccagcctgaacagttcagattaatgccaagtaggctttccagatcaaaaattatcccttgaagctgctagtggagacctggccaacggccctggtagttcattaactgaattctagtcaacctcatttatcacattccctcaaagtgatttattactattttaaggcctttgatttgaacagtgcttcataata

SEQ ID NO: 201837 - DNA, 419 bp, Homo sapiens
attatataatggtaaaaggccttgtacaacaggaaaatatcacaatcctaaatatatatgcacctaaagctggagttcccaaatttataaaacaattactaccagacctaagaaatgggatagacagcaatacaataatagtggaggatggctgggcgtggtggctcacactgtaatcccagcactttagaggctgaggcagtcagatcacctgaggtcaggagttcaggaccagcctggccaataagtctctactgaaaacacaaaattagcctggtgtggtggtacatgcctataattccagctacgtgggaggctgaggcaggagaattgcttgaacctgggagatggaggttgcagtgagctgagatagtgccattgcactccagcctgggcaacaagagtgaaactctatctca

SEQ ID NO: 201838 - DNA, 210 bp, Homo sapiens
taataagtcaagggggaaatgtatgcttttctcaaggaaaatgttacttttatattaacgtttctggtaattacagcaacatctagtggagacaaaccagcattacaatccactggtgtaactaacagtatcaaactctactctcagttatggtctataggacccccattaagagtggtcatcttaatgctaatattctaaccctatatt

SEQ ID NO: 201839 - DNA, 640 bp, Homo sapiens
taatttcctttatcttaggagatacttatttccaacaatgttacatattttcagtatgtaaatcccaatatttcaatattgcttctctaatgtaatctctgtgtcttgtgcttctgtaacaaaagccaggcctatctaccagtttagcatctttgatcaaactattagtggagttttaaacacaggaaaactgacctcatcaactttcttccactacagaaatggaggcagtcatcttgttaataggaatccaggtccataaagagaaaggtttgataaccttagaacttgagtgttacttttgaaaactataagttgtgtaccgttttgttctttggtaccttaccaatttttgcacactacagaacaaatttctttttatagaaataaaaggagttttagagagacaaggtctcgctatattgcaggctggtctcaaacccctgggcccaagtgatcctcccgcctcggcctcccatagtgctgggatcacaggtgtgaggcaccatgcctgggcaattaagatatatttttaaaactatgaatgaaaactgaactttagcaaaagttttcgtgtacttattgagatgattatgatttttttttttaaagacagagtttgctttttttgagacaaggg

SEQ ID NO: 201840 - DNA, 778 bp, Homo sapiens
gacaagttgcagaataatatatagagagagctatatatagcatggtcccgtttatgtaaatagtgcctaattttaagtattcaataaatgtaagccattattattacaatgaacatgtactactttataatcagaaaaatcaacaaatttattaaattaagtgtttatgtacttccttatttaataactaaaaagtatattacttcaagaaaagtaaataacatgtgcttgcctctctggcaatcttaatttaaaaaacacttcataattatacaatgtcacatttaaatacacctaagttacaggaatcaagtagcactgagaagaacactgcaacacttccaattacctaggtttacattcagcatgttagaccacagagagctgtgctgacatgactatatttagagtttaaaatcataaacaggccaaatcagaggtggtatttcaagggctgtgattaacaagattttcttgatcaatgtcttatgctgtctgaaaagtagggattttggtacagacttttttttttttgagatgaagtttcactcttgttgcccaggctggagtgcaatggcacgatctcggctcattacaacctctgcctcccgggttcaagcaattctcctgactcagcctcctgagtagctgggattacaggagcccggcaccacgcctggttaattttttgtatttttagtagagacagggtttcaccacgttgaccaggctggtctcgaactcctgacctcaggtgacccacccgcctcagcctccc

SEQ ID NO: 201841 - DNA, 525 bp, Homo sapiens
aaaaggtgtaaacttagacttatctatctagcagaggaggcactgtacatctccaggcagtcacaaacatagctttatccttctttttgggaaaatgtgtcttgtctaagtttatactgtcatttctctcctaccagctaatgatatcttaagttagaacatcatgccaagagaagtatgttttcaaccaagaaagcaaaatcaacatgatcctaaatgaactgcttctgcatgtcaacagtcttgatatacctgagagagtgagatacagagtatgttgttaaactttttataattacaaatattgcttgtatttcttttgaaatttgccacacgctgatattaaaaataatagatagaaaatcaagagagaaacttgtagctttaatttattttgttgtttggataattaagattgtaggatagacagactaataattctctacttttaaaggaaaagtatttctctttgagtctccttcactttgtaaaccatggttgaaacaagttcagagattgaaaggg

SEQ ID NO: 201842 - DNA, 613 bp, Homo sapiens
cgtcttcattgcgcctgcccagcttattggggcctaagaatgcctgggacatgatgaatggtgctttttaaatgtgtgttatatgaacgaaataatgctttggacagataggctgctgagaatttgacttttatcagaactcaagggacacaagaggtattagttttgtttgtttccgcattcattttctgtttctctttttcctgtggtgctcactgagggaggttagtctagtggttaagagcatattcttcagagagaggcagctataggttcaaatcctacctctaccattaattagccctggggccttggacgagtcacttataatttttgaacctcaattttctcatttacagaatgggaatacaaatatttaccttaccagataatttggtgggatttctacaagttaatgttgagttaaaaaagaaaaaaggcaaaaaaaaagtgtggtatgaagataaatggttaccataaatacctaaaatgcatgtgtgtgtgtgtgtttgtgtgtgtatatataaaacacgcatcatcctatacaaacttgtatacgaagtaatatgtaaatacagtggataatttagaaaaaaagttgtgtttactctgg

SEQ ID NO: 201843 - DNA, 300 bp, Homo sapiens
ggagacaactatggaatcacttgcagtggtaagtccttttaaaagcactggacacttagcaaagtgccggtcacacagaaaccctcccaagaaatgttacctattaagtattacgaaaaaggcaaagggcattcagaaggcacctttgaggaggagtgaataagagtttctctttacccaatgcttaaagtatgtacacatacaataccttaaataatccttccaatgaccccatgaagcaggtgttaatagcctcatttacaaacaggaaaaccactcccagaagtcaagttacttgtc

SEQ ID NO: 201844 - DNA, 408 bp, Homo sapiens
tccaaattatatcactaatcattaacaagaaaggcatgagtctggtagtcagattcactcctcctggagctctgaggaaacactttcctcttgtcatgtttgttctcatgtctgccatttaatcaacaggccatagaagtgtaacatcagtttggcctcttttaatcctcacttggaaactcatttctcattcctcggtctcccttggagtgagtgacttactagaaaacaaaggtagttcatgattattcatttctatttagaatttgtggtcttttgtgagaaaattgccccaaatcctcctactacagaaagtgttgatttttcaagctaatttttcattctcctcactgactaacaaagtaatatccaggctgggcaacatagggagacctcatctctacaaaa

SEQ ID NO: 201845 - DNA, 416 bp, Homo sapiens
  misc_feature (307)..(307): n is a, c, g, or t
  misc_feature (322)..(323): n is a, c, g, or t
  misc_feature (364)..(364): n is a, c, g, or t
  misc_feature (395)..(395): n is a, c, g, or t
  misc_feature (403)..(403): n is a, c, g, or t
ctgagagcgagcaagggctgcgagggctgccagcatgctgtcacctctcaataggagatcagttaatgcatactgaaggaaggcttgttggagaagaatcctctcctgaaccctgtggagactctagaatcctgcggatgtctctctccctaagtaagagatgttacttcctggagggaatgcagtgttgggaatctgaagacccagctttgagctgaatttgctttgtgatacctgaaggagctgcaaatgaacacttcatagcaatgtggaactccaacagaaaccggtgaataaagatcagtgncccatatagagaccnnaggagctggagtcaggaggcatgtaccactgccacaagtgntccaagcccacaaaaaaagggggcgaagggngtaccccntattgccccaagg

SEQ ID NO: 201846 - DNA, 473 bp, Homo sapiens
gaagatcttgcccttggcatcagggcacatgtttttggaaggattaaatatgagcatctataaagggaggcgggcaacatgagtaccctaagaaaagtacaaacaaagtactgtagggggttaaagaagagatggcgctaggtttggcattttacccatggtataccaacatcccagcaaggtgtgccgggtatgcgagagaatggcagctgccttttcctggtgcctggcttattctccacacccttggccccccagcacagctaatgaggcattccttgtgctcctagttttgccaccccagctcctttctggcttccccagaaatctgtggtctaaaaagatgtcaaagtgcctcctagtctaattttccaacatgcaatgcttttagaagagcacttacaattttcactttgtgtgtgtttgaacagttttaaacaatgtcaccctagactagactgcagtggcacaat

SEQ ID NO: 201847 - DNA, 284 bp, Homo sapiens
gtgttaaccaataccatggagtttcctctcatttcctccctttccatatttctacctcctttctctaccagaaaaaccagactcttattattggtaatatgtttgcttactactcacttataatatgtttacatacccctgaatgtaaccaatctcccattgtcaccacctcctgccccaggcagatgtctgtcaccccatgctgggatctgacacccttgctgggcagcgtcccacatgggcaccctcctctgcttgagccgggctgctgtggtccatgctga

SEQ ID NO: 201848 - DNA, 2406 bp, Homo sapiens
agtttactctacatcatagcagagaaaatggacaaaacacagctgttttgcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtgcctctttcaggaaaagtataggaaatgagagaagactgtgacaactcatgacctgcatccttaatatccagtgacttcatctcccctttcttcaccacaattccaggcaatggcctgtcggaccagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcacaaaaa

SEQ ID NO: 201849 - DNA, 3367 bp, Homo sapiens
cagttctcttcaagtcatgtaatcgacttttttgaattagttttcagtttcattttgttttccctaattcaagttgggaacacttcattttccccaattcaagttgggaacacttccttggtatttccttgctacatggactttagcaaatgctactttactctccttccagctactcaggaggctgaggcaggagaatcgcttgaacccgggaggcggaggttacagtgagccttttcctagttttactgttggaagcctaactcacaggagagattatgcaatacagtcctgaagtcaagggaggagagcatgtaggagaatactaaccctgcacagattgtgatggtgatgtggaatatactaaagcctagaacgcacctcctctgcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtggtaaggcattatttcctttatcaaaccatatacagtataaaaatgcttctttaaaagggtaattgaagttctgactgattcacatatcatcaagcaagacttttatacagaaaaaaacagcagcaggggttgcaggataatatagcacgaaaaatataattaggcttttcccaatgtctataattaaacaggctctacttgcttaaatacatggttgttcttcttgtctcctattgttatttgtagagaagatctccaatggcattgtgcatatgagggtgagccaatgtacttattcttatgatagaagcatgaaacatgggattgtatacaagtggaaagaaacacaactataattcacttgcaaattatagtttgattgtatacttcctttttactgcattccttttagtatttatgtgttccattaatcagagtataaataagggccaggagtgtggtaaacttgttttttccactgttaaaaaccatgaaacagctagtagggagattaaaattaactgataagactcagacttattttataatggtctcatggatctttaatttcagatgcaagcaatagactaaagctttttgccgcccaccccaaaacactactatcaataaatatttaagatataaatggttattctgacttgaacaacagacatttagagtctatttttcttgcttctagcctctttcaggaaaagtataggaaatgagagaagactgtgacaactcatgacctgcatccttaatatccagtgacttcatctcccctttcttcaccacaattccaggcaatggcctgtcggaccagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcacaaaaa

SEQ ID NO: 201850 - DNA, 2401 bp, Homo sapiens
agcatttgactaagacggtatgaatttctaagtaagcacatatagaactggatgcccttgtggtacatctcaaggctgatttgaaagcttgagagaccatcaagaattggatttggggaagagcatgactaatatgttctgcacaagacatgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtgcctctttcaggaaaagtataggaaatgagagaagactgtgacaactcatgacctgcatccttaatatccagtgacttcatctcccctttcttcaccacaattccaggcaatggcctgtcggaccagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcacaaaaa

SEQ ID NO: 201851 - DNA, 3038 bp, Homo sapiens
catagctgaattcaatgtttattcttatggactacttagcatttgactagacggtatgaatttctaagtaagcatgtaggagaatactaaccctgcacagattgtgatggtgatgtggaatatactaaagcctagaacgcacctcctctggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtggtaaggcattatttcctttatcaaaccatatacagtataaaaatgcttctttaaaagggtaattgaagttctgactgattcacatatcatcaagcaagacttttatacagaaaaaaacagcagcaggggttgcaggataatatagcacgaaaaatataattaggcttttcccaatgtctataattaaacaggctctacttgcttaaatacatggttgttcttcttgtctcctattgttatttgtagagaagatctccaatggcattgtgcatatgagggtgagccaatgtacttattcttatgatagaagcatgaaacatgggattgtatacaagtggaaagaaacacaactataattcacttgcaaattatagtttgattgtatacttcctttttactgcattccttttagtatttatgtgttccattaatcagagtataaataagggccaggagtgtggtaaacttgttttttccactgttaaaaaccatgaaacagctagtagggagattaaaattaactgataagactcagacttattttataatggtctcatggatctttaatttcagatgcaagcaatagactaaagctttttgccgcccaccccaaaacactactatcaataaatatttaagatataaatggttattctgacttgaacaacagacatttagagtctatttttcttgcttctagcctctttcaggaaaagtataggaaatgagagaagactgtgacaactcatgacctgcatccttaatatccagtgacttcatctcccctttcttcaccacaattccaggcaatggcctgtcggaccagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcacaaaaa

SEQ ID NO: 201852 - DNA, 245 bp, Homo sapiens
ggtgtactggtgcccgccagtagtcctagctgctcaggaggctgaggaaggagaatcgcttgaacccgggaggcagaggttgcagtgagccaagattgcaccactgaactccagcctggcgacagagcgagactccgtctcaaaaacaacaaaaaacagcaacaacaacaacaacaacaacaaaaaagggaggccatgtcttattcatcatcacattaccagcaagtgtccagtgcagttcctag

SEQ ID NO: 201853 - DNA, 554 bp, Homo sapiens
agaccctggcatcacaattccactgtattagctgtgctaatctagagaggaaaacaaaacaaaacaaaacctcagccattcacattccttgaatagaatcagaggaggagagaagtaagtataaagtttgaaagaatcccgagaagaaatgttgatataaacagctcttggcatcaggtggatggtgtcagggaagttactattttcgtggggacagaggcgctgacgttcagctccattggacccagagtcctgtgctatgttctctcgtgactgacaaagcccccaactcatttctccctggggacgacattcctgctttcttattcattacggatcctttgagatttttatttcgtatccttttatttactgatcagagctgccctgaaggcttcttctgggacaccagaaactcccagcagtcccctgcctgcggggaggctcttcatcccaaagctcattattgttagaacaggatgggttcacacccgggggctctctctccaagcctcctcactccccatcaattccacctgttcattcagagtcgt

SEQ ID NO: 201854 - DNA, 330 bp, Homo sapiens
cctgtgttatctaactgactacttaatggagtccacattgggtgtgatattctgctcaagattaatttcgggtaatgaagatctgaaacaaggtatttaagagccccactaatgtttcatttatagcaatctatcaaaacgatagatatttagcctctttactggatatgaaacattaacttaaagccagtgctgctttctgtgttaaataccagtacccctgccttcgattttatcaaacattgtgaaaaatctgccaccacctcccggagaacacatatcatggacttagccttaagttatgattctctggcaccttggacaactgac

SEQ ID NO: 201855 - DNA, 285 bp, Homo sapiens
ggaagggaagaaagctccccacatacatgcacgatgtgttttctctattgttctgttacctgctttctccttcagattgtataaggctacactggccttttacaagacaaaattggccattcacactgataacgggtattaatttaatcagcctcaaattgataacaggtatctcttgtggaaacaaagataatttgttattgattgtgatcatgtcttctgatgtaaactcgaggcttattttgtcttgtaaaaggccagtgtagccttatacaatctgaagga

SEQ ID NO: 201856 - DNA, 409 bp, Homo sapiens
cggtgtcacatggctgccttatttgtgtgtctcttctgtgacttcaaatttttcttttattataatgatttgggtgattagatttcagactcaccgtactccaatatgactttaccttaacttaattacgtctgcaatgacccatattttcaaatagggtcacaatcgcagataccaagggccataactttaacatacttttggggggcatacaattcaacctgttacagcttctaagcaaaagtgtccctatatttgagatttttttgagtcaattgtctgtatgtagtttcactcgtgtcagtgtgaagagaccaccaaacaggctttgtgtgaacaataaggctgtttatttcacctgggtgcaggcgggtgagtccgaaagagagtcagtgaagggagatagggg

SEQ ID NO: 201857 - DNA, 413 bp, Homo sapiens
atgtcagagcagaactatacatgtggctagatcaagtaagtggcttgtgaagactaagtaaaagaggcccggccgggtgcagtggctcagtatgaggcaggagattgttaggacagtattaagcaggagattgtattgatttcactggtcccagtgactattaagtttagctgtaattgaaatctacccagcattaaactctgagtctgctgttttgggattctcaggttcctctctgttagaggaagtggttcattgcccatgacactggttccttgtgcctttctttccagttgtcatcctggtcttgtgagttagttataaagtggttctcctgcccaaatcccaagattcacagtggttaaagccaaataaaaactgaaatatcaggatgtgctctgattcccacatag

SEQ ID NO: 201858 - DNA, 442 bp, Homo sapiens
atagaacacacattaaatgcaacactcaagatagtttcagctgctttgtgaagctggttttcttacatcttctttctcaatcataatatggaaaatattattgcctgtcctaaaatgaaaattctttttctcagcaatttatttggagtaaatttttcttctgcagatgaccaaatatttatttgtcatggtgataataaaggtttgattaattgctgattttggaaatagtaaaagacttaaaaatgtcaattttcagcagggtgcggtggctcacccctgtaaccccagcactttggaaggctgaggtgggcggatcacaaggtcaggagtttgagaccagcctggccaatgtggtgaaaccccgtctctactaaaaatacaaaaattagccgggcgtggtggcaacgcacctgtagtcccagctactcaggaggctgag

SEQ ID NO: 201859 - DNA, 495 bp, Homo sapiens
atttaatatccaatgatagatgattaaaaattggtatgtcaggtgaaataacatgcaccaattaagactactggcaaatttgggaaaatgttcgtggtaaatcattaggtaaaaaatattataaaacaataaccatatgattaatattgtacaaacaggaagtatatgaaccattatatcagtgattctgggtggttgacatataaaaattttgtgatgagtaaagttatatgcacatataagtataaatttgtatttatttaagtataaatttgtattcacctatttcataggtgagtgtgtgtgtatagataaacacatggaacaaaaagttaggtatatctgtgtagtgtggagggaaaaagctaggaaagaaatacaccaaattattaagtaaattggcatttgaatgtggggattattgatgtgtaaaaatttttttgattgtagtctccagaaatcaccaataaagtatatcgtttaaagtgtatatta

SEQ ID NO: 201860 - DNA, 462 bp, Homo sapiens
gggctctatcccggcgcagctgcctctctctcaggaccgctgctgtaccgcggtttcctcgtcctgccgagagggtgctgcctgccctgcccagccccagggcgagggtgtatgcgtgcagaagggacttgggaaccagggcgggcatgaggctgttggcatttctgtaacggaggcctcctgcattactgtggattttagtgggggaagaattggcttgttttacaagtcagctttccttgttaatgagctttccttgttgctcacagcttattgtccatgtagtgagtacagttgagaaatctggctgttatttatgacaggggtacccaatccctgggccatggactgataccagtctgtgccctgttaggaactgggttgcacagcaggaggtgagtggcgggagagcgagcaaagctatagctgtatttacatcagctcccatcactcccattaccg

SEQ ID NO: 201861 - DNA, 271 bp, Homo sapiens
ggtgttcagcgacaacgccctgccacactccgctcatattcctgagtacccactgcatgccaggaactcttctaggccttgagaatgcagagtgaacaaaggaaagtaggccgactggagttgggtatgggattagagagggatggagatggggctgtgctatttcagctggagcagccagggaggttgtggcaactgagtggagatctgaacaaagtgagtgaagagccaggtgcggtggctcacacctgtaatcccagcactttgggag

SEQ ID NO: 201862 - DNA, 355 bp, Homo sapiens
aaaaaattattacctggcaaactgagttgccggtcatattgaggacaaaatcttaaatatgtgctattagcattgtttttagactagtaatatgcagaaaacagttttaggcctgcgttacatattgcctcttccagctccaaagttttggaccctgtcagttttgcaactacattatacattattataatattcttttttttttctagaaactgggggcagcctcaaaatcatgttaaagagggagttttgttagaggcatctttaatgaacatgaatgtgagtgctctctaaattcttagcatctcactggatgtaaaatctatcagttaatagttttaaaaatgtctctttt

SEQ ID NO: 201863 - DNA, 469 bp, Homo sapiens
tatttgtttcttagtcagtactgagctaagatatatttgtttgcatttgacagtgagagcattatttttaggtaaaacatgtcttcccaggatggttcaactagtagtacagagggtcttcagacaatgttgtttgattataatattgatgaagaaaaaagaaaccagttcctggccggggtcactctctgtgtggagtttgagcattgtccccacgtctgtttggattacaaggatccttgtaatccaagcagtcgtcatcatcaccatcatcatcattattttggtttgtttgtttttgagacagatcttgctttatggcccatgctggagtgcagtggcataatcacagctcaccgcatcctcagactcctgggcttaggtgaccctgccacctcagcctctcaagtagctgggactacagacacaagctaccatgcctggctaattttttggtttctatttttgg

SEQ ID NO: 201864 - DNA, 561 bp, Homo sapiens
cagttattaaggagctttgggaccaaaaatggcttaaaaccggggaaagaaggttccaacccaccctggggacaaaaggaaaaacgggttccaaaaaaaaaaaaaaaaaaaaagctcgggctttcctcagtcagaaatgcaagtttcccccttgagactggggatcacttgttctgctctgatggtacctgtatgtctgacctgcaaaaggctggaaagaggagctttgtggaaagagttcccttagcctttgatagtcggtttttgaaggaaaaagactatgaggagctcctacttcaagagataaaaatagcaagcaggaatcggtctgggcttcctctcctacactggatgataatgcctgacgggcatcaccattgttgctgattttctttgaatgagtcattttcccagcacatctagtggggaacatgtctctttggttaaccactgtatcccggcgcttctgtaaatattgaatgcatgagtcagaaactgtacacatatgactatcgctccaccaactttttgttatttccctaagcttgttcaggtaggaga

SEQ ID NO: 201865 - DNA, 165 bp, Homo sapiens
actcacatttcactgcccagctgggatctcacctacttcatgaagtcttcaggtcactattgccacagcaactctttgctgctttaaacctctgataaattaagtccatggttagcatttgataatcaatggagtacttagtacttttaatcccctcttatatag

SEQ ID NO: 201866 - DNA, 518 bp, Homo sapiens
aaactaaacatagcattaccatatgatccaccaatttcactcctaggtatatacttaaaagaattgaaaactggtgtgcaaatcaaaacaaacacgaatgttcatagcagcactattcacaatagtccaaaaaggtgaaaacaacccaaatgtccatcaacacatgaacggataaacaaaatgtgatatgtcatttgtggctgccaggagatgggaagtgattacttaaaggatgttcttctggggtgattacaaagtgttgaaactagagagggatgatggctgcacagcattgtaaatgtgctaaatgccactgaatcgtacactttaaaattcttaaaatgctgaatttcatgttatgtgtattttgcaacttaaaaaaaacatgtttacctaagtattgatagaggcaacattggcaaatgtgaatgtgtttagtacacatgcatcacattctacctgacatccttttttggagcaagaaagggtataaataaatacttcttttagagcttaaa

SEQ ID NO: 201867 - DNA, 406 bp, Homo sapiens
ctctcagtggtgtttgacactctcaaccaccaactctttgtgaaacctttttttccctgaaagctgtgaggtcgtgctttctcggttctcttctcatgtctctggtaactcctgctttgtctactttgggttttttgttttgttttgttttttgttttttaagagttgggatcttgctctgctgcctaggctggagtgcagtggcgcaatcatagctcactgcaacctcacactcctgggcttaagtgatctacctgccttggcctcctaagtaactgtgttcatttgacacagtttaggaactaaagatcaggtaaaaccagccagttcctgagctggaattgaatctgttcagaatgtctgggaactaactccatttttacgtgtcaaccatacctggctaatt

SEQ ID NO: 201868 - DNA, 572 bp, Homo sapiens
cactcacgtaagaaatgtaaacctgacaagtgtttcaggcgaatgcaatttttatctgaaatatgctccaaatcctggggtgggggggagtgccttttgcaaagtgaatcatcactatgggaatctggcgacacgctgtttgtcttccagccatggagacagccagacctcactggggaaggaacagggaactgtgtggcttgagaccacactacctaagctggggtcctaaatgattctccatctgtatcaatggaatatttcttttgtgctggtgtttctcagtcttcacgactacttcccggagggaaggaggatagtaagggtgtccccattcactgggaaaaaggggtgttctgagaggtcacaccactctccaggaggcccacagctaggaataaatagcagggccacctccgctttcaaccaggagggaccagagggagccaggaggaaaaacagtgccaccttgacagccttccacagcatctccagcttagaggatgtgctaaccggtggggattgcttccttgaccctgccctgcagctatgccagggcttctgactcccag

SEQ ID NO: 201869 - DNA, 284 bp, Homo sapiens
acccagggacagccacatctttacttctctttcagaccaggttactttcagatcagcagggggcagaggtagggcaagggtgttcttgtgtaacttggccatggcaggggttctcattgctaactaatagacgggtctggatgcgcagagtccttgaggatagtaatagtgtcaggattgcagaaccctaatggagaatgcatgtgtgtacaggtccctgagcctagctagctcagtattgggcaccctgtaggccctcagtaaatatcccacaagtgaatacg

SEQ ID NO: 201870 - DNA, 487 bp, Homo sapiens
cctcagtagcacaaagaaggaaaaacaccaatcaattctgttacttaacctatgcatttgaaaatgcagtcaagtagtcagtcatgccctttgcaaagtacacaggcaaatataatactaacaaataacacttgagactaaattttaggtgatgaaaacattatgattatgaatcttcctgggaaacgtgggtcaatcatgtctatctccttgaaatctggcaccgctaggtttcaggaagccatttatggtgtgtgtaccagttaggcttagatgggacttcatttaacaggaagagcaaaataaaattagttttaagatggtagaagtttatttgtccctaacagaaaaggaattcataagtaggctgtacaggcctcctatgaccacttaactatgttatcatggctcatattttctgctttgtcattcttagcttgggctttccaaattcaagggttgagatgatgactagagttccacctat

SEQ ID NO: 201871 - DNA, 993 bp, Homo sapiens
aaacaattgagtaaaaaatgtgatttagagtttttaggcagtaacttgtcatcacagattttactttacaaacaagctaatccaatccatcttacttgtgtgaagagaaatttaagcattttttccgaaataatttagttaactagtaaatatatgaaaaaagtataactttcaaatatcacttccctagaaattgctctcatctgatgagttctccaaagcatatggaaaattcaggaaggggaagagaaaatccaaagagcaaagatactctcctgctgagattccccatcccaaaaatgccaaaagaaacctctctagtgaatttgctaactgtgaagaacaagctgggccccctgtggatccctgggtccttcaaacacttgggttaaaagaccttgacactatcgatgacacctcatcagctaactacagtgccctcgcatctcatcccagaagagtcgccagcacattttcccagtttccggatgatgcagttgattataaaaatatccccagagaggatatgccaattgactatagaggtgacagaacaacccccttgcacagcactgccactcatggagaagatttccacatcctttctcaactttcaaatcccccagtggggctgaaaactcttccttactatactgctcatgtgtcacccaacaagacagagatggcattttccacatccctgagccctcattgtaatgtgaaaactcattccttccaccagggacaagcctttgtgcgtcgagatgaggagggaggctggaagtttacctgggtccctaagcagtcttagtgacccctcttttatcacaaagcactgccacgaactctgtttacaaagacctctcttgcacttgaatttgactatgtggaacacagaagctgttgcttagactgtctcctgccactttaaatgtcactctcaattacccacttaaatctgcagggaatggcttccaagaatccataatgaaa

SEQ ID NO: 201872 - DNA, 605 bp, Homo sapiens
agttcaaaatgcaaaataaaataaaaaatacctcagcagtacatgaatgaatgaaagtgttgaattttaaaagtccatttatagtattactgatgataaatatggcaagtcttggaagccagatatacagaacaggagagaggggtagagaattcatagaatctaaaaatgcaagaaacaaacatataaaatagaagaaaaagagatgaatgagaatcctaatttctgggtacaaacatcccacagattattcagttcagaaaaccaagttctgaaatcttaactataaaggctaagatttagatgattactgtatctctcattccaactatgggtagcagggccatagaacctgctgtccttgacattatttaaaagaaatgatgcagggctgggcgtggtgactcacgcctgtaatctcagccctttggtaggccgaggcgggagaatcacttgagcccaaggagttcgagaccacctgggcaacaaagtgagaccctgtatctacaaaaaataaaataaataaaaagaattagccaggtggggtggcacatgtctgtagttccagctgctcagaagtctgagacaggaggattgtttgagcc

SEQ ID NO: 201873 - DNA, 454 bp, Homo sapiens
cgatcatggacagctctttttctgtgggccctatgtgtttcaccagggcccggaggatttgggtaggagttgagcaggactagtcagggtcaggttgaaatgaccgtcactaaaagtcccagattcttggtccatgagttgcagccgagtcaggacacaacaatcctgtgcttcaccattggaattttggacataactttagggctttccctcatcctcattaaattaaatcttgttgattgtaatcagccaaaaccatttgaacctcatttctggagagtgttatctatccctttcaactttctgtcatgcatcaaatgtataaagtgacttttttttctttttcatttaaaattttttttagagacaaagtcttactctgttacccaggctagagcacagtcatgcaatcatagctcactgcagccttgaactcccgggctcaagagatcct

SEQ ID NO: 201874 - DNA, 441 bp, Homo sapiens
ctaactttcttcttgagagttctttttacttacttgattccatgtttacttagatttctcccttctcattgaatacctatccatttattttgtggattctttccctgctctttttttggagactttgaattccctgtggttatttctcactctgtgactctatgacaatcagtgattacattcaccatggctttcattgttatctatataatggtaactcccagctttctctcttgagtttgaggtatctatatctatatccaatgaaatactaggcattctcttggttgtcttacaaatataccaacctcctttgtttactgtcttagttgtgacactaatattctctctttttattctttttttttttttgaatgtctgagtttgaaccttaagagtcaatcttgacgctgatcttggattactttaaccaagtctctc

SEQ ID NO: 201875 - DNA, 575 bp, Homo sapiens
ccttcttgtttaacaagttacttatttgcttctcatggcttcactaggtgcctagaatttcctttaaactcaggatttttctttatttccatgcttggggtccacaggccgctaataaaaggtgtccctactgtcttcataccatagcaatcttcttcccgtttcttgtcatataacccctaaaattttttgagtcttaaaagtgataagtgacattttgtatgctaatgagttgactgatggcttgggcctgctggatagcctcaggatgggggggcaggtagcaaaggaaataaccatgtgattataggattggaactttcagctccattcctttggacctccagagtggggagatggactgaaggttaagttgataaacaatgggcaataatgtaatcagtcatgactacataatgatgactccattcaacttgaaaggcctgggtccgggagcttctggggagctgaacgtgtggaggttcctgaaaggtgtcacacctagagtcatacatctcttccatctggctgttcacctgtatcttttgtaatattctttgtaataagtgggtaaa

SEQ ID NO: 201876 - DNA, 421 bp, Homo sapiens
gttgagctctgctgcttcttccctggggaatctttggtgaggcccagcacctctctgaacctcagtttttgcacctagaaaagggggctgatcaccacatctacctcattgtgttgctcagctgatgtcaacttttattctttacaaccaagacaccaaggcttaagtgcttctaagctgggcctgagggagttgggaaaggcttcttggaggggtattttgtgctgggacttaaaggctggaggaagacagaagacagaaagcaggaggtggttatgtcttgttcccacccctatcttggggcctgaagagagctttagtgactcctccaaagattgaggtccctccctgccaaatccccctctgcgagaaacacccaagaatgatcaataaaaaaaaataaataaattgaaaaaaaaaa

SEQ ID NO: 201877 - DNA, 461 bp, Homo sapiens
tcgccagcaagcttggtggccctaccagagacattccatcaaggatgaggcatggggaggactcatcctcggctgacctcccctgggcgcaaatgatgggcagtggttaacagccaatcacaactctacaacgcctatgaaggcgggtcaaaggccagtttgcttattatttcacagaaacattaaaactacaaacaggtagcatgtgtggcagggaattttacagataaatcatgttcttttgttgcagtaaatataatttcttttccaaaatagagggcactcagttcttactgagaacctatttcagaacaatggacaatggtcacaatttatgaatcccattgttttccaggaaaaaaaaaagagtattaattgtttggtcagagtttggggattcaagaatccccaaaaaggaatttaaacagggatctcctcaaacagacaaggacataaagact

SEQ ID NO: 201878 - DNA, 680 bp, Homo sapiens
caaactgtagcatttaacctcagtagaacgatacccagtttgtacttaagctgactgtttatcagacaagatttttttgttggcactgatagaaactcaagttagttctcctggtagaggcaaagtgagagttgctggagctagggcagcttgaggacctcaaagatgagaacagagctgaccattttggttaaataggactctttcatatttgcttagctttattttttttccctgcagtctttcttcatggtttttctagattcccattattccagctttcataaatggagagtcaaaggatgtttcctgtaatcttcagggaggaaaatcctgaaaaagactggtaaagtccaacttgcatctttgtcccttcttctttaatgggggatgaggtactgtggtgggcaccaatgggtagaaggaacagagttctaaaatggaagaaggaatgctggcaatggatatctactatgataattcaactaaagaggacaatagcaaaaaaaaaacataaaaaacaaaaaaaaacactttttgggccgctcttgggcccttaaaaaagtttttaaaaccatttctttgggggcggggggccccattgggtacgtgacatgggcacaaggtgtccctaagggaaactcggggcagcaacaggggctgggttttccccaataaac

SEQ ID NO: 201879 - DNA, 642 bp, Homo sapiens
caaactgtagcatttaacctcagtagaacgatacccagtttgtacttaagctgactgtttatcagacaagatttttttgttggcactgatagaaactcaagttagttctcctggtagaggcaaagtgagagttgctggagctagggcagcttgaggacctcaaagatgagaacagagctgaccattttggttaaataggactctttcatatttgcttagctttattttttttccctgcagtctttcttcatggtttttctagattcccattattccagctttcataaatggagagtcaaaggatgtttcctgtaatcttcagggaggaaaatcctgaaaaagactggtaaagtccaacttgcatctttgtcccttcttctttaatgggggatgaggtactgtggtgggcaccaatgggtagaaggaacagagttctaaaatggaagaaggaatgctggcaatggatatctactatgataattcaactaaagaggacaatagcaaaattaagttatatttaaaaaatacaggaggccaggtgtggtggctcatgcctgtaatcccagcatgctggattataagcttgagtcacagtgcctggccaacacctttattgaggacatacaataaatgtcacatatt

SEQ ID NO: 201880 - DNA, 413 bp, Homo sapiens
tactaatactaaattcgcggccgcgtcgatatacgaagtgggccactgccctccagacctaaggatgatagatctaccagcagcttgtattctgcacctggaaaagccacaggcactcaactgcagcccatgagcgcagccttggattctttaccctgcaaagccataggggcaggactgctcaaggcctggggagcccaccccttgtaccagtgtggcctggatgtggaacatgatgtcgaagattattttggaactttaagatttagtgacttccctactgggttttggagctgtgtggatcctgtagaccctttcttttggccaatttccccctttttgggatggaaacatttacccaatccctatacccccattgtatcttggaagtaaataatttgtttttgatttta

SEQ ID NO: 201881 - DNA, 1447 bp, Homo sapiens
actggtactgagaagtgagtcattgctgtagagatacctgaaaatgtggaagcagctttggaacttggtgacaggcagaagttggaagagtttgtagggctcagaagaagacagaaagatgagggaaagtttggaatttcttagggactggttaaatggttgtgaccaaaatgctgatagctaggacatgaacagaatgcacccaagcactttagcaaaggtcacacaatgttaacgccttagcaaagagcttggctgccttctgttcatgccctaggaatctgtggaagtttgaacttgagagtgatgatttagggtatctggcagaagaaatgtctaagcagcaaagtgatcaagaagtggtgtggctgcttctagccacttatattcagatgtgggagcaaagacaaaaggtagaacttatatttaaaagggaagcagagcaaaaaaagtttggaaaatttgcagcctggccatgtggcagagaaagaaaaaagctttttcagtagaggaattcaagcagactgtggaacaattacttgctagagatgtttgcaggattaaaggggagccaagtgctactatccaagacaatagggaaaaagccttgaaagcatttcaaagaacttcagagtggcttctcccatcacaggcccagaagcttaggaggagagaatagattcatggactgggcccagggccatggtaccttgcacagccttgggacactgctcaccacatcctagctgctcctgttcccactcttgccatggctcaaaggggcctacatacagcttggactgccactttggagaatgcaaacagtaaaccttggtagctttcatgtggtgttaagcctgcaggacacaaagtgcaagaatcgtggattcttggcagcctctgcctagatttcagaggacatatggaaaagtctgtttgtccaggcagaagcctgttacaggggtggagcccttacaaagaacctctactagggcagtatagaggggaaatgtggggttggaggctccaacagggtcaccgctggggcactgcctaatggaactatacgaagtgggccactgccctccagacctaaggatgatagatctaccagcagcttgtattctgcacctggaaaagccacaggcactcaactgcagcccatgagcgcagccttggattctttaccctgcaaagccataggggcaggactgctcaaggcctggggagcccaccccttgtaccagtgtggcctggatgtggaacatgatgtcgaagattattttggaactttaagatttagtgacttccctactgggttttggagctgtgtggatcctgtagaccctttcttttggccaatttccccctttttgggatggaaacatttacccaatccctatacccccattgtatcttggaagtaaataatttgtttttgatttta

SEQ ID NO: 201882 - DNA, 358 bp, Homo sapiens
tcccccgtctcttggcgctggatataagtgcccgccaccatacccggctaatttttgtatttttagtagagacagggtttcaccatgttagccaggatggtctcgatctcctgaccttgtgacccgcccgccttgtcctcccaagtgctgggattacaggcatgagccaccgcgcccggccgtagataatctttattattgtaaaaattatttgtatttcatggcaagtttgttgattctaaatctgggtgatttatatgtttattattccaattttctggcaataaaatattctattctaacaaaatcagtatgttaacataattttctaaaagatgaaagtgaaataaatatcttg

SEQ ID NO: 201883 - DNA, 505 bp, Homo sapiens
ggaggagaactgctcaactgggacttgggaggcagaggttgcagtgagtggagatcacgacactgcactccagcctgggctacagagtgagactctgtcttgaaaaacaaaacaaaacaaaaaaagaagtaaacaattagataatcagcctgggctacagagtgagactgtcttgaaaaacaaaacaaaacaaaaaaagaagtaaacaattagataatcaagatggccaggtgtggtggctcacacctttatcccagcacttcaggaggccaagatgggcagatcacttgaggtcaagagtttgagactggcctggccaacatggcgaaaccctgtctctattaaaaatacaaaaattagccaggcgtggtggcatatgcctgtagtcccagctactcaggaggctgaggcaggagaatcgcttgaacccaggaggaagaggttgcagtgagccgagatcgtaccactgcactccagcctgggcaacagagcaagactctgtctc

SEQ ID NO: 201884 - DNA, 786 bp, Homo sapiens
gtttgaaggcctggaattttcacatagcacttggtcgaaaatatcaagcctaaataggaagtcattttctgtgacacctctacatagctattacagatcctaagtcctagggcatcagctataaaaattggccagtcccaaagacacagtaagttctaacattctggtactatcatatttcaagtattttttctcactttttaaaaatgtttttctgaacaaaagtgaaacaatgccatttatcaaactgagatcattacaatcttcaacaagacaactaaaacagcttgatgttagatgggattctgtgacagtttgtatactgacaggtccttccagtctccctccacagtcccacaagcggaagtattctacctgattccagagttcattccaacatgcagtagaatgaggtgaatgaagaaccaagtgtgggttttgttttcacagtgcacttggtcaatctagtttctctgagtagtgggctgtattctaagaaaagctttcacgtagacgtcaaagtctgcaaaagagatgagttagccactttacaaaaacctgctctgctttacaaaagatgcacaccaggcttcctttacaagtgaactccaaggctgcttgtaaagtaccacccttcctgcagactttgtgggtcgtgtcacttggcctaaacaagtggcctaacatatgcatgctcacagctagtagcatccctcatgcgtccttgtcatactctggaaagaaaaaaactctgctatcttcagagaaaccatctattcatactta

SEQ ID NO: 201885 - DNA, 205 bp, Homo sapiens
agtgcattatcttattttatcctcagatcagctccataaaatagctaccattattacctctacatgtatatagatatatgtatctatctatctatctatctatctatatctacatacattggaagtctcaccagggttctaacttgtgctttcaaccaccatacatattttaaagagcgtaagaggagaaacaaccatttgtgtt

SEQ ID NO: 201886 - DNA, 539 bp, Homo sapiens
aaggaaatgcatattctcatctcatctaaagtgagtttacttaggctgagatgtcaataggtaggatatgacctgtagaagtaggaggagaggttccagtagagaaagtgggcaagaacatggtatataataggtgatgtcctgaggctgatggcactagagcatggtgaaggcagcagcctatgagggagaggtatgctcaagcagggcgtaaaggccatggaaagtcactggagagttttaagtagggaaatgacatgatctgccctgatccaattctgttacatggaaaatgaactggaggaagatctgagtggaaaccagggaaaactgaagatactgttgtggtagcccaggcaaaagatggtggtggcttggaataaggtggtaaaagtgaagatggagaatagaagacagattacaaaaacattctgcaagtggaagtgacaagacttactgaaagactggggaagaggagtagtaaaggagaagaacaaagatgattctcagaggtctatctttggtaaccctgcggatag

SEQ ID NO: 201887 - DNA, 409 bp, Homo sapiens
tgagtttaagctgattatgagatatctggaatatggttggatagacaatttggaagttgtttcatgtttgggtaagatgtaggaattattagtgtgtcggaattgattaaaggcagttgtagatggagttgttcactgaatacaaaatatggaaagagaaaagggtcaagtagagattcatcatgtcactcacattaaggagtaggaagaggaagaggaagagcccatggaagagaggcaaggaagaactactggtgcgaagtggtctttaaggaagccaacctgtgaagaggaagggccggagggctcaaaaggacatatgattaggtagagtcatttttttgttggcttgcttttagaaggaaaatgaaacatttgtatacagtaaaaagaacttgccgagacagaa

SEQ ID NO: 201888 - DNA, 186 bp, Homo sapiens
gtctgggaatataggtaggaggtaggtaaagctgtggtcatgttgagaagaaatgagagtgaattatggaaagggctcaaaatataggtatcaggagaggagcccgttactgtgactgagacagaatcagcagaaagttagaaggaccatgaaaggctgccaggtggaaaccaagggaagtgagac

SEQ ID NO: 201889 - DNA, 438 bp, Homo sapiens
gaaacggtacttggactactcatacagctagtctgttttcactttcagtaaagtattcaataaattatgtgagatattcaacactgtattataaaataggctttgtgttagttgattttgctcacctgaaggctagtgttaatgttctgcgcatattcaaggtaggctaaactaaactagggtgtttggtaagttaggtgtattaaatgcattttcccagcctgggcaacatagacttcatctcttttttaaaacaaacaaacaaacaaaataaaaaaaaaaactagctcgcataatggggcattcctgtagtctcagcagctacttgggaggctggggtgggaagatcgcttgagcctaggaggttgaggctgtagtaagccttgattgtgttactatactccagcttaggcatcagaacgagaccttgtctcaaaa

SEQ ID NO: 201890 - DNA, 1392 bp, Homo sapiens
gcccaagttaaagagccagtgtgtgcacttggaggcacgttctcagctctgacaggctctgactctggggcaggacccagccttaaatgaacttgagatgatttaatgggcagcatgtaatgggagcctacatctgacatcccaccccccactttgtactctgccatgtgtctggctctctggagtgagaaggagagaacgtttggccataggtccacgcaatggtatcgcttcacttgtgtgtaatgtaccacctcttacacaaaagccctgcctgtgtctccagagctcttggggaacaccctttctcaggacagtttgagtcccgaaaatgaacataccaggaatgccttaggtgtgaaggaagttatctgttcctcaaaacacaaaatattagccactaacatttcttgagggcttgctgtgtgccaagtactgtgtgtttaatgtttcctgtgatcctcacaacagactttgagatgggtattattgttgttatttccactttacaggagagaaaattgaggcttaggttaagaaacttacccaaagtcaaacaatttaattggtttgggaagaccaggaagactttaagttcctaagatcgtttgagattctgcatcagggaacacttgacagcaggtttatacaaagacagatttggtatctttggagggaatgagtttccagtcattgcaggtggtccagcagagagggccactctcctaatggggatgaggatgctgtgacagagctgtagcttcggatggcagggttcaactagacaggtttaaagtcccttcagcccgagtctccttgactccacagaattaatgtgagaagacagagggtcatactgtcctatggtgtgtggggggtacaggaagtatagggcacagagagggaggcaggaggtgttgaagacatggtgttgtcctgagcagctggttgaagctagttgcagctagcttcactttgccattgccctaatgcagtcttcatgtcttggtaagtctagaatgggcatccagtctctgcttcaacctctgagggatagagaggacactcacttctccaagataagaacaaggaccttatgagattgcttcagaaggcttcagaatgccatcaggcagctggactgttgaaaagcttccttggggccaggcacggtggctcgcgcctgtaatcccagcactttgggaggctgaggccggtggatcacgaggtgaggagattgagaccatcctggtcaacatggtgaaaccccgtctctactaaaaatacaaaaaattagctgggcatggtggcacacgcctgtagtcccagctactcgggaggctgaggcaggagaatcgcttgaacccggaaggcagaggttgcagtgagtcg

SEQ ID NO: 201891 - DNA, 350 bp, Homo sapiens
gaacaaggataacgacattttgaaaccctgagtcttccattccaaactctcctgtataaagatagtataacaaagcagaaaacatgggcatatcaataccagctgtattgatgtccattattatctctgccccatactcaggtgaggaagaaagcatttaaaaaatggacaccttgctgccaaaatggcacgatgaacaggataacaagtttcttgaaatatgaaatctgtatcagtacgatacttgtactcataaagatcagccatatctttctgcaatgtccgggcttccggtctagccaaactggcttgtagggaaagcttctttaatgctgaccttccctcatatt

SEQ ID NO: 201892 - DNA, 416 bp, Homo sapiens
cattttgtctgtcacacgcaccttgaagcagataccattggtcacaccccccaaacagcaattacctgtcttcttctggctgacaaaccccaatttttcccaggaactaagctccagagagtggtaaggaaagctgtcccactgcatagtccaagggagcaaatgctgagtaattcaacttgtaatggtaattgcattatatctgccagcaactggtttaagtggggacatgtgacacaatcctggccaatgggaaataaagggaacttgttagaagacttctaggaaaggtttttctctatgataaaaacagtgagaacaaaatgaataaaatacttaggaatacagctaaccatggaggtgaaagatctctacaatgagaatttaaaaacactgcttaaaaaaatgagagataa

SEQ ID NO: 201893 - DNA, 258 bp, Homo sapiens
ctttacaccaaaaaaattttatattagtcaggtgtgttggcacatacctgtagtcctagctaccccggaggctgagacgggaggattgcttgagcaagtctaggctgcagtgagctgtgatcacaccactgcactccagcctgggcaacacagcgagaccgtgtctcaaaaacaaacaaaaatttttaattaattttaaaataaaggccatcccatccaagcaaaaattggaaaatgtaatgttcaacaacatatcca

SEQ ID NO: 201894 - DNA, 894 bp, Homo sapiens
taaaattaagtgtttaagctttgtctgcagctgtttttgtgattctctgctgttcaccagcgatcctgatgtcacattggatgagagagctccagctgtatttttttgttgatagtgttaagattatagctttaaaaaattttgttttctaacataattaaggcctttatgctttgcctctaggttgattctaaaagtgtaacactactagaaaggatttatagtattttgattatggaaatattattcactatagaataactagtgcagttgaaaccatatgcacttttatgtttcaaaacccttattgctggaagaacattttggggttaagatccagtccttttcattttttacttttcttctattctcctgtatcagactcatctatttttgtttttcaagaacttttcacgtggaaaatgtggtaaacttttagagtctttgcatgtttaaaaatttctatattttgctctgtcaattcattgatagttgactgggtattcaaattgtttacctgaagaattttgagagcattttctggactgcttttaaataaatttcagatattattttatccttaaatactttagtatgtgtcttcaaaaaattaggacttggcggggcacgatggatgatgcttgtaatcctagcactttgggaggctgaggcaggtggactgcttgaacccatgagttcaaaaccagcctgggcaacatagtgaaaccttgtctctacaaaacattagctaggcatggtggtgcgcccatctagtcccagctacccaggaggctgaggtgggagggtcacctcagtccaggagattgaagctgcagtgagccaagatcatgccactacactccatcctgggtgacagaagtgagaccctgtctc

SEQ ID NO: 201895 - DNA, 530 bp, Homo sapiens
atgttctggaattagatgattatgatggttgcacagctctgtaaatattaaaataccattgaattgtacacttttaaatagtgaattttatggcaggtaaattatatctcaagtttgaaaaatgttataaatcaggagttggcaaacattttctataaagagccagagagtaaatattttaggttttgtgaaccatgcacagtctctattttattttttttctttcataacctttaaaaatgtaaacaccatcctgacttcactggccatacaaaaataggctaatggccagatttggcaaaggacacagtttgctgagttatagatgaatatcaaatctcagaaagttttcatgtaaaattataaaataaataaagcaagtgtaggtctttctttctttttttgagacggagtcttgctctgttgcccaggttggagtgcaatggcgtgatcttagctcactgcaacctctgcctgccgggttcaagtgattcttgtgccttaacctcttgagtagctgggattacagg

SEQ ID NO: 201896 - DNA, 456 bp, Homo sapiens
tatgtcaattatgacataatatatgcataatattgttagtcattactgtatgacttttacctaggaagtgaaaattctttggagagagagagagaggaaaaaatactgataaatgatggttatagttaagtaatcatgtgtggaaatgaacttgtattttagaaactcggggccgggcgcggtggctcacgcctgtaatcccagcactttgggaggccaaggcgggcggatcacgaggtcaggagatctagaccatcctggctaacacagagaaaccctgtctctactgaaggtacagaaaaattagccgggcgtggtagtggttgcctgtagtcccagctattcgggaggctgaggcgggaggatggcgtgaacccggaaggcagagcttgcagtgaccccagatcctgccactgcactccagcatgggtgacagagcgagactccgtctcaaaa

SEQ ID NO: 201897 - DNA, 557 bp, Homo sapiens
attgcactccaatgaaattgtttttaatcaagactgcagtgacctggatcttgccaaagctagtggtcagttcaatgtttgtatcttatttgacctctctcaccagcatttcacagtggccaactttactagttttgacctcttagttgttcattctcattttctatatgcttttgccagtttatctctactttcccactccttgaaaatttggaatgtccctcaggtgatttcatccaatttttggtttcaaataccatttatatgccgatgaggctcaaattcttatttctagtactgacttttttcccccttgcgctctagactcttgtaactccatgcctctccttggatgtctaatggatacctcaaaggcagcatgaacaaaggagggctatgaattactcttcctgttggtgacttcttcctctacctcccccaagtctttaccatctcagtaagtggcatcatcatccaccacttgcgcaggccagaaccccggattcttcctcctccttgatttctttttttcctcctcatctcatgttaagtctggt

SEQ ID NO: 201898 - DNA, 393 bp, Homo sapiens
aagacaagtcatatttttatctactgaattcatgctctaaaaattaaagtaaatatttaacataattatttaatatccataatattttgctgttaaaatttatattaaagatattaatattttccatcagtatttaagagctcagaattactgaaaagaagaaaccacaggaaacaggagactgttgttaattaaaccaagtgaagcatttttccctttttaacttccgagaaagtagataaattatacatatgtagacacacaaatattttaagagtcgttattctatcatagtaagcatcataactaaaatactaaagtagagaaagttcatgtgaaagtcatttgggaaggtaaattattcaatatctacttataaatattatatatcat

SEQ ID NO: 201899 - DNA, 243 bp, Homo sapiens
tttcatttgtcatatcactctggctacgaggtgagagaacatcttaatgggccagagtggatgtgtgaaaggcagtgagggagagatactaagatgaaacagacttcatgcatgtcactgaaatgcccagtcaggggcaaggggataaacaaacaaacaaacattcagttctaataattctacaccactatcatagacaatgcattctactataatattagtacagaatacaaatcacggagt

SEQ ID NO: 201900 - DNA, 638 bp, Homo sapiens
ggatttgagacattttgggtctacttgggactgtgtcctgagtctaacctattggctagataatgaactgtgtttgcaccaaacaccctaccccagtaccacaggtgaaccctatctaaatttttatacctttctaagtgtgagttttctctaaaaagcctcattgactggcctactatacaaaatcaagggacttatccatatataatcacagagataaccctgtgtgaaacatcccttcccattctaaaccacttgcaactgaaagaggtacagtgctcttaaaaatattaaaaactcttaggcatttttatttagcccaccagtatattcccttatcaaaacagacttttaaaaaattcatcctgatatccgttgcactgtacttgacacatatatttaacaattacttgattatgactgagtcaggagccttgagtttttgacccagtgtatccttgggcaagtaatttcacttgtcaaaaatacaacttgaaattcaaaaataaataatacaggagaagtgataattctaaatccagctcataaaccattttaacaatgtataaaaatgatttttttcaaaatacgttcaaaatatgttaaacgactccctgggaacctccctggtccctggc

SEQ ID NO: 201901 - DNA, 537 bp, Homo sapiens
tcgtttatgtaacagcatttgttgagcatctagtatgtgccaagctctacggatccgagacaaatcaaccataatgggcccttacagaacttgttagccaactggggacacagtcacctatcaatgacctcacagtgagaagtctaatcttgggaatgggggaaggagaatgaggggaaacttccccaagaaagggacctctgatgtgagaggttaggtttcccaaaaggaaacactgttattgcttgttctgatagaataaaagtcttataaaacattttagaaaattcagcaaaatatatttggtgaattttgctaattttttttcctgtttacctacactgacaaaaatatactttacagtacttggtttttgtttacaaatataaggattttaatattaatctatctacataaccttttaaatgattgtttaatgttccattgcatggatccctctttctttagccatttccctgttaataggtattttgtttgtttccagtttttgctctaataaatattgctaccacaaac

SEQ ID NO: 201902 - DNA, 469 bp, Homo sapiens
gcaatctcatctatcataggccctccccaactcaagcactaagtagttcctagatgggccaagcatgtcaagccttggtaaactatgtccttgtctcctaattcttaagttctatattattagaccaataataagaattattagaaattggggttccagttctatgacagtaaaacatcaaaattcaccataaagaaatgaaaataaaatgatatcgatttttgaaaatacatatacatatccaagtccttaatataaaatttaagttctgttttaaatgctccttttgggggatgtttttctgcatggaatgaactttctgaggcttcttaaaatatgtgcccagtgaagtttagactaaggatgctttttccttttcctggtaaatcttccagtcataggatagccttcttcatcgttccttggacctctgaactgcagttcagaattagtcatttatttcaagaag

SEQ ID NO: 201903 - DNA, 556 bp, Homo sapiens
cttactgatttgtttgagttcgctgtagattctggatattagtcccatgtcagatgtataaattgagaagatttttctcccactctgtgggttgtctgtttactaactgttccttttgccctgcaaaagctctttagtttaattaagtcccagctatttatctttgtttttattgcatttgcttttgggtctttgctcatgaaatccttgcctaagccaatgtctagaagggtttttccaatgttatcttctagaatttttacagtttcaggtcttagatttaagtccttaatccatcttgagttgttttttgtataaagtgagagatgaggatccagtttcattctcccacatgtggctagccaattatcccagcaccatttgttgaaaagggtgtcctttccccactttacatttttgttggctttgtaaagatcagttggctgttaagtatttgggttttatttctgggttctctattctgtttcaatggtctatatgcctatttttataccagtaccattctgtctcttttttttaattaaacaaaatttta

SEQ ID NO: 201904 - DNA, 445 bp, Homo sapiens
tactatatgaaatgaaattcccataggtattataccctactgcagtgagctgagtaatgcttcccgaaaaggtagccacatcctagtccctgaaacctgtaattgttaccttatatggcaaaaaagaactttgcagatgtgactgagttaagatgttgagatggagagattatcctggtggactctaaattcagtcacatgtatcatggagggaatatcatagaggagatgcaggcaacatgacctctgaggcagagattggaatgacatgaccacaaatcaaggcatgccagcagctaccagagactgcaagaggcaaggaatggattctttctagagctttcagaagagtggccctgtggacaccttgatttagacatcgtgaaactggttttggatttctggactttagaactgagaaagaataaatttctgttgttttaag

SEQ ID NO: 201905 - DNA, 483 bp, Homo sapiens
cctagccagccacatctgttctcctgaaacctccatggttactctgccctggctatggttactgagtgcaaggtagattctgagagctgagtttgtgtaggggttgtgcgatgcagctggccatgctctttttgtctccaggagctggcatttgccctctatatgcactttgtattgtagctccctttccacctaaaacctccctgcattctccccttttctcccttttctgcctttgctaaatacctgttctggtcagaccctgtgctaagagtatggggctacagagatataaataaaccttgtgccctggccctgaggaactcacagactaccagatggtgactgacatggaagttgaaaaataggctgggcgcagtgactctctcctgtaattccactttgggaggctgaggtaggaggatctcttgaggctaggaactcaagactagcctgggcaacatagcaagacctccatctcta

SEQ ID NO: 201906 - DNA, 519 bp, Homo sapiens
ctcatggctttgctcatcttccggcttcaggctctgacttcatctcaggatgggatcggtgtgtgtctgttttcatagatccactacatcagaagtatctttacatctctgtatctttacatcccaaggtcaaggccctggcaacctcagaggttcccatagcttcagtcttccccaaaccatgccacttcctcccatttctttgggtcaggaatctggcttttgttttccatatttctttttcccaagacattgggaggcatctggtgaacaacaccaataaaacagttctctccccacggtcatccaggtcacttctctaactcattcctgcacacacagcacacgtggaatttgcctgtttagtctatgttcttgacttgatcacagacgcctgtacaataaagccccttttcaacaaggtgctgcagaatgataatgctttccccaaaatctgaaactgatttgtatcattgaagtttttttctgtattaaaaataaagcaaaattaaaaataaa

SEQ ID NO: 201907 - DNA, 329 bp, Homo sapiens
catgtcttcatcatttattacctggattactgtaagaatctcctaaatagtgcctttatctctagtattacaccttctaaccaatctattaaatgagagtggtttttgttccaacagaagtctaattatattgtgtcactgcttaaaatccctccatgactccctattgccaaatccaaagaatagcatagaaggctttttaggctctgaaccttgccatctctccagtctcctctattgacgcatcaccatttaaatctgtgctcttctgaaccacttcaagcaaacttcttgaccatgtcctgcatcgtcttctttttttttttttt

SEQ ID NO: 201908 - DNA, 445 bp, Homo sapiens
agtaggatattattagacaaagactagaatattgaagaacctcaacttaaacatgaaagaaatatttcatttgcccttttcaccagcatgtcatctctgtcaatgttggttcctataaaagacttcagtaaatacatatttatactgattctttttttttttttttttttttacttagctgtcatattgtcttctcgaacccagatgtaaggacatgcttctttaagaagccatataggcccttctttggagattctcagattcatttgaagacctgagtctgttctttatctagaatggaaaggttggtgggtggtgaaccacacacgccctttgtactgatcaccttactctgtactgtgtggctgctccagaaatggcgagttcactcaccagttcattggtcagttgtagggttgttcactaaagaacattgaaaaattgg

SEQ ID NO: 201909 - DNA, 487 bp, Homo sapiens
atagtttatactaagcaataattaccggtgagctaattactttatagactttaaaaatgcagttatttttcatgatgcactgtccaaagagtaaaacaagcctcaaaagaaaggaaagaaggaagggagggacaaaaccctgagtattttatttccaatttgtatgctgtgatagaatattgaaacttacccaactatcaatacattcaagagaatcagtacgaaatagcacattttcactataagtaatatttaaatatatagtgggtttaagtatattaattatacccaaaagcataaaattggtatttcctaagaattgatcaaggatatctaaatacaagtcatgattagtatattttaaaccagtgtggttctttatgacgttctgttgtttttcaacctaattgtcagtgagataaatatagcatcatagaaaaagatgcattaaccaatatattcagtgacaagtataaacactcaaact

SEQ ID NO: 201910 - DNA, 524 bp, Homo sapiens
agggctccatagttatgagacaatttaaccttaatttcttccttaaaggccttgtctccaaatacaaccatattgggaattaacctatcaactttgatgggacccaattcagtccataacactttttaaatttaattcaactgtatttaattaatttattttttgagacagggtctttctctgttgcccatactggggtgcagtggcatgatcatagcccactacagccacaacttcccaggatcaagcgatcttcctgtctcagccttctgagtagctgggactaaaagcacacaccatcacagctggctatttttttttttttattgtaatttttgtaaggatgagctctcactatgttgcccaggcaggtctcaaactcctgggctcaagggatcctcctgcctcagcctctgaaagtgatgagattacaagcatgaaccacccatgcccagcctcataacactttttaagaggttgacattaaaggattaggcaaaagaatttccttgggaaatagttga

SEQ ID NO: 201911 - DNA, 467 bp, Homo sapiens
aaaagggataagatactgcagagaggctccagaacaggggccatgggagtcaacccggtgaagacaaagggttcgggtctgagagtcagtgggcctcaggggtaacctccaagagatggaaaggtccatcccacaggtcctggagactagaaggataaggttagcgcagaaaagagatagggccgggagcagtggctcacgcctgtaatcccagcactttgggaggccaagaagggcagatcatcagaggtcaggagttcaagaccagcctggccaacatggtgaaaccccgtctctacaaaaatacaaaaattagcagggcgcggtggcatgtgcctgtagtcccagctacttgggacgctgagggaggagaatcgcttgaacccgggaggcagagattgcagcgagctgagattgtgcccttgtactccagcctgggcaacaggacgagactccatctcaaaaga

SEQ ID NO: 201912 - DNA, 343 bp, Homo sapiens
acacaggtaaccacggctgtggaaaaaaaaaatccaccaacacatttctcccaggcacttttcattttgggctttcaaaagctagggctttaatataaacatcccacctctagaccaagcctgcagatctgcaaaaacaacgtctagacctcagagtaaagttatgagagaaatgctcacattagattacagtctcactgaattacaggtaactgctcaaacctgatctttattataatacagaaagcttcctcattacaaaacactttcaattcaaaggataagtccaacgttccatcattctgcccattttggagctaaaaaaaaaagattctaaatggta

SEQ ID NO: 201913 - DNA, 294 bp, Homo sapiens
catgagactaggaccagcttcactgaaatataatcttccttagccccaccttcagcaaactcattccaaaaggcccagagaagaaacttcaactatgccgagcgaagtctcaggtccaatgaggagaaacaagacagtgcagaagatgcctctctctgaacgaaggtctcctactggaagaacacagttcctccatggagacagtctcaagacctcttttggaacattttatattgcttgttttgatgcccagtttatggaattaaaaataaaacctctcactgaaatatgcaa

SEQ ID NO: 201914 - DNA, 295 bp, Homo sapiens
taaaaatgaaatcttgtcctcttctgggtccgactccttttgctcaacttagtattgtgaaatctatccatgtcgttgagtatgcttgtattcattcattttccttgctctgtagtattacactctataaatatatgacagtttattgatctattctaccactgatgacatttggggtagtttccagtttgagctatagtgaatagtgctactataaatattgttgtacatgtttacatatatcgtaagcttaaatattgagagtgctattgataaaagggaaatggacatctag

SEQ ID NO: 201915 - DNA, 471 bp, Homo sapiens
gtgactcactgcagagcttcatgtgtctgtaatatgcatgtttcactgcgtagaatgtcacgtgtccgtgtcttcatgcatgtctgtggtgtcttgctgtgtagaacttcacatctatgtggcatgcacgtcttgctgtagggcctcatgtgtgacatgtgtgtctcgcctggtagaacctcacgtgtgtgctgtgcgtctcaccgggtagaacctcacgtgtgtgctgtgtgtgtctcggcgggtagaacctcacgtgtgtgctgtgcgtgtctcgccgggtcgcagaggttggcagcaacgggggaagccgcgtggtggatcccaggagccccttgtgctgttctctgcttttgtgtagattcgacaagtttcaaaacggtggagggtgtttcaggtgctcaaagtcctggcttcagatactgctcttgactggggggaacagcccaggatcccccagacacaagaagg

SEQ ID NO: 201916 - DNA, 466 bp, Homo sapiens
tgtgtgtgccactcctgaccctcctcaccatgaccccaccagctgtccctctccactacttggccaaccctcacctctctctactcatcacagaaatggcatttctactctatagtctagtgtctttgcaccatttttcagaggcaacttgctcctgagaagtcactgaatagcatatttcttcttgttttcctacagatcaagtttggctttaaatactggtcagcagccaactgcctcctggaaatgacctgctcattgtctgcttgccagattcttgcctcaggcactcctgtctctgtgaattccacattgaggacactcattttctcagctttttcctgctcatcatgcaccactgtggtgtaaccagcttcctccaaacaatcagccaataaatccctctctttcatttctgtgtctcctcagtagagagacagccaaatcatacaaactaacaccaaga

SEQ ID NO: 201917 - DNA, 423 bp, Homo sapiens
gaagcacatacaagcaacgtgtgagacgtgatttctccctcatggcagcccatgagctacagtatcagacttgagagactgctggccgcggcggcgagtaccccacccaccagttccaggaaatgaccagccacaggaaacccccaccccaatgttgaacaacccttcttttcttgaaatctccccaaattaccgccaaccaaggatggccaaatgtacctgaagaccaattagaaagtctctccagcttccaaaattccacctaagcataatatttgcgaatcagagactgtctctgtatttcctctttttacgctgtgtaagaactctcctttaacacccctgaacacttgtccacaaaagtgacagctgatgggtttccttactatgtatttatgaataaacaggctgtgagttttgtct

SEQ ID NO: 201918 - DNA, 303 bp, Homo sapiens
tctttactctttcttttctgggttcttaatatttaaagtgggtttcttatagacagcgtgtactaatccagtgtgacagtgtctgcctgaatttatacatttggtccatttgcaattaatgtagttatcaatatgattgggtttaagtctaccctcaaactgtttgtcatatctaatttttcattcctttttcttttttctctgccttcttttggactgaggatttttttgttttgttttgttttgttttgttttttggtgttaaccaatgtttcattcctgaaataaattttacttggtcat

SEQ ID NO: 201919 - DNA, 461 bp, Homo sapiens
tgtatggaccccacgccgcaccgacggtcaaactgtgtgagtgtgtgtgtgagagagagagaaggaaagagagactgacagacacagttggggaaatggtagtgttagatttaagagagagatcaactatattccatgtatggactttacttggatactgattcaaactgtgcatgtatatgtgtatgtctgtgtgtgtgtgtgtgtgtgtgcatgcatgcgcgagagagagagaaggaaagagactgacagagttggggaaatggtggtgttatgtatttttttcaaaagtccttaacacttagaggtatataaggaaatatttctgggtgatctgatatctggggtttgtctcagaataattcagtaagggtggaagagacatggatgaagtataattgaaacaggattagctatgagttgatcatttttgaaccggcggtgcggcgtggggtaccgag

SEQ ID NO: 201920 - DNA, 446 bp, Homo sapiens
acgctgcacgagcgagcaacgtggtatgtgtgtgtgagagagagagaaggaaagagagactgacagacacagttggggaaatggtagtgttagatttaagagagagatcaactatattccatgtatggactttacttggatactgattcaaactgtgcatgtatatgtgtatgtctgtgtgtgtgtgtgtgtgtgtgcatgcatgcgcgagagagagagaaggaaagagactgacagagttggggaaatggtggtgttatgtatttttttcaaaagtccttaacacttagaggtatataaggaaatatttctgggtgatctgatatctggggtttgtctcagaataattcagtaagggtggaagagacatggatgaagtataattgaaacaggattagctatgagttgatcatttttgaaccggcggtgcggcgtggggtaccgag

SEQ ID NO: 201921 - DNA, 249 bp, Homo sapiens
gtccaacaacttccagcagatgctggagttttcccaactttgaaatgccaaacagggcttaaataaaaagaaataaatgtagcattttataagatttaatttccacaatactaagtttagcgacctataaggtcaagttaccacgtatctctctgaaggcatctaagtctacaacagaagggaagaaaatcgttatttaaaatgcgaacatgaaaaaccttattcttccaggcttctcctataaaaaca

SEQ ID NO: 201922 - DNA, 110 bp, Homo sapiens
tccaagaagcctccctggacttccgaatctaagtaggctagcccagtcacactctataatatggcccaattttattttgctcacagtgccctgcctaaactgttcattta

SEQ ID NO: 201923 - DNA, 815 bp, Homo sapiens
tctccctactgtatcctagctactcaggagacagaagcaggaggattgcttgaggccaggagttcaagagcagcctgggcaacatagcaagaccttgtctcttaaaaaataaatgaatagaaatgtaaagagtaacagtcaaagctatgtataaattacatctttcaaaagactgtcctctaccagccaaaccatgagtatttcttttattgttttcaacaaggtaacttactagagaaatattaacacaagtctactgactgaaaacaaatccctgtgagtatttccgtagcaagggacacaatgttaccccaatgcttcacatgcttccctacattttctaaatgctcttgttgtcctagacaatgagctaagaacaaaaatgacttggcacttcttgtccaaagtatctaggactaagctgagttcacacgcttgtctcccatgccacggccacctagaagccatgctagtgacgtagatgaaagtggtctggatccttgagtcacctcctgaaagggtagtctagggagcccaccaaacccagaggacttcgagaacctcagatttcagaggtttgttgttcctccaacatccctaacctatcctggcttatccattttctcaggaaaagtaatggctcacaccaataaagctgaaaatagtttttcagttataggaagctagaatgatattaatgtaagaaaacatgaacttcgaaaaaaaagtctggctgaagccacccaatctgtccagatttgcttcaaggtaaattacagcaggataagcaaatgaaaagaaaagggaaagctggc

SEQ ID NO: 201924 - DNA, 954 bp, Homo sapiens
gacgagcacttcatctttcaggtgtccagcaagaccatcacccagagggtgctgaagttctccgtctaccacgtggacaggcagaggaagcaccagctcctgggccaggtgctcttccccttgaagaatgagaccctagtgggggactgccggcgtgtcatctggagagacctggaggccgagagcctggagcccccctcggagtttggcgacctccagttctgcctcagctacaacgactacctgagccgcctgacggtggttgtgctgcgtgccaagggcctccggctccaggaggacagaggcattgtcagtgtgtttgtcaaagtgtctctgatgaaccacaacaagtttgtcaagtgcaagaagacttcagctgtgctgggctccatcaaccctgtgtacaatgagaccttcagcttcaaggccgatgccaccgagctggataccgctagcctcagcctgactgtggtgcagaacatggaaggggacaagcaggctactacagtggaactgtttctgtttcatctgacatccggatagatgccagccacccccacattccaaggtgagatttctgactagcagtgacttttctagggccgcttggaaaagttgataagtatccttttctgcaggacagagtagactggtatctctgactcatccctgaaaaatctaaatggcaagagactagctggctctctgctctgatggggaggaggttgttgtttgggctgttctctacagacatagtcagggcaaaaagcatacgcatgcttcccatggaccagagaaacctggcctgggttgtctcaaatcctgtccacaaggcaactccagaagaaagaagccctttacatttccataaaacactttagaatcagctagtcaatttccacaaaataaagtgctagaatttgattggatttaattgattatgtagaacaattt

SEQ ID NO: 201925 - DNA, 423 bp, Homo sapiens
cggagtagctgggactacagacacctgccaccacgccctgctaattttttgtattttcaagtagagacggggtttcactgtgttagccaggatggtctcgatctcctgacctcatgatctacccgcctcggcctcccaaagtgctgggattacaggcgtgagccaccacgcccggcccacttgcacattttcaaagtagtccgcaaagctgtagtttctaatagcttcatagctcacatgtaataggggttctctgtgtgtttatagagcaggctactacagtggaactgtttctgtttcatctgacatccggatagatgccagccacccccacattccaaggtgagatttctgactagcagtgacttttctagggccgcttggaaaagttgataagtatccttttctgcaggacagagtaga

SEQ ID NO: 201926 - DNA, 753 bp, Homo sapiens
gacgagcacttcatctttcaggtgtccagcaagaccatcacccagagggtgctgaagttctccgtctaccacgtggacaggcagaggaagcaccagctcctgggccaggtgctcttccccttgaagaatgagaccctagtgggggactgccggcgtgtcatctggagagacctggaggccgagagcctggagcccccctcggagtttggcgacctccagttctgcctcagctacaacgactacctgagccgcctgacggtggttgtgctgcgtgccaagggcctccggctccaggaggacagaggcattgtcagtgtgtttgtcaaagtgtctctgatgaaccacaacaagtttgtcaagtgcaagaagacttcagctgtgctgggctccatcaaccctgtgtacaatgagaccttcagcttcaaggccgatgccaccgagctggataccgctagcctcagcctgactgtggtgcagaacatggaaggggacaagcaggctactacagtggaactgtttctgtttcatctgacatccggatagatgccagccacccccacattccaagattccagttctttgatgaaagtctctattccacccatcaagtctgtgtctgataacaccaatatctgggtcattagtggctccgttttgttgtgtctgttttcccctccttcctgttttgtggtgtgtttgatcacttattgttgaatgctaaccattataataaattttagtggctccaggaaa

SEQ ID NO: 201927 - DNA, 542 bp, Homo sapiens
aaaaaaagtctggtacctttgtatatcatgagctgatgtgaatggtaatggcgccagcctcctggactaagattccaccagtttcccctgtgatgcaggccatcccccacccgcaccccagctgaaacagaactgaaactcagaaaacctagctatccctgcattaaaaaatatatttgcaagcatccagggattttatttccgtcctcaaaaaattgagagcctcaacatttattttgtgcagaggcagagaaagtacccccatagtctgtgggctgaccccaaaactgagtgtctgtggctatgactatttgataactgggctgctacacttgtaaggtttcatttctttatttccttcaaaatgaaacaaagataaacagtgagagtagtattttattgtttgaacaccagtttctccccttaacaatcctgtgttagtatgctattttcttgatgtgattttaaacctcagtgtgtacccggccagttctgtattccagaagctactgtctactgccaagagctattaatcaaaataa

SEQ ID NO: 201928 - DNA, 449 bp, Homo sapiens
aaatagcactatttttatacaaaaaaagcctaaggaatcttaaaaaaaaaaatttactggcactaagactgaattcagcaaagtcacaggacactgtcaaaacactaaaactatactgtctctatacacgagaatccagcaaagtcacaggacactgtcaacatagtaaactatactgtctctatacacgagaatccagcaaagtcacaggacactgtcaacatagtaaactatactgtgtctatacaataacagcaaatattggaaaggtgacagtcttcaaaattctactcaaattatcatcaataatacaaaattcttaggattaaatttatcaaaagataggcaagagctcctctaaaaaacatacgctagtaataactgtttgcttggtgagctgtgtggccagggttgtgaaatcagaagagacacccagccttctccaggtg

SEQ ID NO: 201929 - DNA, 781 bp, Homo sapiens
tcaggttggtctcgaactcctgacctcaggtgatccgcccgcctccgcctcccaaagcgctgggattaaatgcgtgagccaccgcgcctggccctagttttccttttgacatccttccgagcctctgtttcttgctagttaatcctaacagggtatcatggaggcttgtcacttgttcacgacttagcagtgattctcaacgtggagggaggtaaggggagtttatctgtaagggcaaatccaaattgagggagggtgctcttgattactttttttaaaaaagcacatttaggccaggcatagtggctcactcctgtaataccagctaccctggaggttgaggtgggaggattgcttgagcctgagaggtccaggctgcagtgagctgtgatctcgctattacagttgagcctgggtgacagagtgagaccctgtctcaaaaagaaaaaaagtatctattgaacatttactgtgtgctagacactgtgccaggcagtagggtgcagagtgaaactgaagaactcaagatctattggaggccaagtgcaagttgctcatgcctgtaatcctagcactttgggaggccaaggcagtcggatcccttgaggacaggagattgagaccagcctgggcaacatagggagacccccaccgctacaaaaaaactagccaggcgtgttggtgcatgcctgtagtcctagctacttgggaggctcaggcaggaggatcacttgagtctaggaagtcaaggctgcagtgagccatgattgtgccactgcac

SEQ ID NO: 201930 - DNA, 538 bp, Homo sapiens
ccctatctctactaaaaatagaaaaattggctgggtggtgggcacctgtaatcccagccactcgagaggctgaggcaggagaattgcttgaacctgggacgtggaggttgcagtgagccacgatcatgccactgcactccagcctgggcgacagagcaagactctggctcaaaaaaaaaaaaaaagctagaatggaaacgggcttccacctaaaaatgcagtgtcctttctcttctcctagaaccactaccaccctgatgagtcaagcctttccttagatcaaacctttacaaaaaccacttatcttggatatgaaaactccttctttggcctttctgtctcttagttggccaccttgacctctttttgccaggtcttcaccccaacccgcacctacctcagcaggggtcttatttcccagctgctgggagatgatgctgaaggtctgtggctgtgccccttgctcctggcacatggtgaggatcacacggtcagcttccctgtaacccaggtatcatgattaaccctagggagccac

SEQ ID NO: 201931 - DNA, 614 bp, Homo sapiens
ggattccacttgggattggtctggccttggtcatttgtggccgtcccttggactaagcagttataaaaacatggcagcgtttgcctgttggcgttggggaaagaacagtccccagagaggggaaagggcctgccaggcagtttcaggcaggtctctgtccgagtaatagagctggatggttctggacatccgtgggtctttaccgtgggaatctgtgagggccagcctgatgagcaccatgtgctgtgttgtgtgtggattggagaattcatggtgtccttggtggagcgtcagtagctttgattatattctccacaagctctggtttttggaatagacaaagaccatattggatacatcataattttttttttttttttttggttcatgggtttttatttgggcactgaaagaagataaggaaactaagttttaaagtgatttgagtgactgtgaaatgactttgactgaataggacataataaggcaattacattaaaattaaaattagacattagatgaaattattgagtggaacccagctaccattcattcaagaactagtctcctcaaactatttttttgttctttttaatcttcagaggaaagaaaca

SEQ ID NO: 201932 - DNA, 810 bp, Homo sapiens
gggagagtgaggccgcgggggctgggaagggaccggtgtatgggggacagcaggcgaaggtcactcgggaaccagcccagctctgaggctgcgggcaggtcggaaagggagcaggacggcgacccccgtggcctccagagctctgtgtacgagagccggcgggtcacagaccccgaacgccaggacctggacaatgcagagctgggaccagaagacccagaagaggagcttccccccgaggaggtggccggggaggagttcccggagaccctggatcccaaagaggcactttctgagttggagagagtcctggacaaggacttggaagaggacattcctgaaatcagccggctgtccatcagccagaagctccccagcaccaccatgaccaaagcaaggaagaggaggaggcggaggaggctcatggagctggcagagcccaagataaactggcaagtcctgaaagacaggaagggacgctgtggtaaggggtatgcctggatctccccatgtaagatgagcttgcacttctgtctctgctggccctctgtgtactggaccgagcggttccttgaggacaccaccctcaccatcacagtgcccgcggtgtcccgccgcgtggaggaactgtctcggcccaagagattctacctggaatattacaacaacaacaggacgactcctgtctggcccattcctcggtcctccctggaatacagagcgtcgagtcgcctgaaggaactggccgccccgaagattcgtgataacttctggagcatgcccatgtctgaggtgggtgccccgtgcccc

SEQ ID NO: 201933 - DNA, 872 bp, Homo sapiens
gcgagcagtggagctgcggttggtccaggccttcgtggtgccaaagtcctccctcagagacccctcgagggaagggagaggcgggtgggcagggtgagtgcagacaaaaggcgcttgagcaagacccacgcttctctgggctcccaaacgcatcggggcgggaaagcagctccaacttcaacgtggaattctcccaaagccggctgtccatcagccagaagctccccagcaccaccatgaccaaagcaaggaagaggaggaggcggaggaggctcatggagctggcagagcccaagataaactggcaagtcctgaaagacaggtgtcccaggtatccagggcagcccaaatggcagtccccagctcgcggatcctccagttgtcaaagccgaaggccccagccaccctcttggaagagtgggaccccgtgccaaaacccaagccacatgtgtcagaccataaccgcctccttcacttggccaggcccaaagctcagtcggacaagtgcgttcctgaccgagatcctcgctgggaggtgctggatgtcaccaagaaggtggtggccagcccccggatcatctccctggcaagcccaaagtgcgcaagggcctcaacgagggatacgacaggcgtccctcgcctctatgagcttgccacccccaaaagcatcaccagaaaagtgtgatcaacccaggctggcctctaagaactccgctcccagtaaacacctcaggcaccctaacctgtgtatgtgatattctgagcttttggctggagaagggagggcggtaaaggcaaagaaggttggagggcatattttcttttgctccacaaaaaaaacgggcctttgggggcggaaaaaggtgaaggcg

SEQ ID NO: 201934 - DNA, 355 bp, Homo sapiens
gatttggctttactacaggtgcataggttgtcttgttaatgactgcacggaaagatggagcagcaggcatcacctaagtgaactcagatattgattaagctgatacgcaaaacaaaacaaaaaaaagtaaaagagtaacatgctctttttaaagacagttgtgtgagctcataggctctggaatgttagaagaaatagagcacagtccaacccacacccctgcatttgttcaagctacctcctcggtgccgaaaaaaaaaaaattctatcattggagctctattcgttcgttttatccagtgatttcactttggagctcctctgggggagcacaaggggaacccacgggggatcc

SEQ ID NO: 201935 - DNA, 113 bp, Homo sapiens
ttacctaatgaaataaagaaaaatgtattatacttggtctctctctgatgcccaagttttctttgagtcagcatcccttgagaggcttaaatgttgaccagtgacatagctgg

SEQ ID NO: 201936 - DNA, 352 bp, Homo sapiens
cctctctctccacttgcacaaattcaaagctctaataacactagaccaccctccatttcttaaacatgcccaatccgaaattataacttgagaaccaaaaaataataattgtctgataatgtggcagtactcatgattaacaagtaaaaactatacaaaacaacagtctaaccagagttattctaataaataataaaaattattattcgtttaatatttacttttgaggagacagggcaaatggcaataatttttttaaaaaagaaatgtcaacttttatacatttgcattgagggaaatataaattttctgctgcataattcattcattcaatcattttcttcgatgctag

SEQ ID NO: 201937 - DNA, 446 bp, Homo sapiens
tgtaaattgtagatatattgaagtgatggaagcctcactcctgaagagacattgcataatatttggaatgatatggttgatgtattaagcagaagttacaaaaaggcataaaatctagtgtatgagtaaaaatcaaaagcaaaaacaaaaaaacttcccagtttatgaaaaactcgcaaagtaaaattcacttcattatagcaatgacttctccaaagatatattagctgccagaatgcgctgtgttcatgcttttctgctgaatttaaaatgcagatgcataattgtaaagttaaatatcatttattttttaatgtttatactttcatgctgccattttgttttatgttttttagagagtgtattttactgtcttttaagaatacaagaaatataccttgtcatgaaaataccagaaaaatacaaataaaagaagaaatttatat

SEQ ID NO: 201938 - DNA, 664 bp, Homo sapiens
ggggagaaaccatacaaatgcaatgtgtgtggaaaggattttgcgtatagctctgttcttcacactcatcagagagttcacactggagaaaaaccatataaatgtgaagtgtgtggaaagtgcttcagttacagttcatattttcacttacatcaaagagatcacatcagagagaaaccatataaatgtgatgagtgtggtaaaggcttcagccggaattcagatcttaatgttcacctcagagtccacacaagagagaggccctataagtgtaaggcatgtggtaagggcttcagtcgtaattcatacctccttgcccatcagagagtgcatatagatgagacacagtacacacattgtgagcgtggaaaggaccttctgactcatcaaagactacatgagcagagagaaacattataaatgtagtaagtcagggttcaattagtaaaacagaagccacactgtattccagatgatagaggcttactcagcctgtgggagggctaggggagcaaaagacagggacactgccatcgataatgtcagcctgcagcactgaagtgtgccaggcaaggactgtggatttcaagaacttctgtgaagctcccatcaactgctgtatgctacaatggcaaagaggttacttttgacaaatgggtggttt

SEQ ID NO: 201939 - DNA, 423 bp, Homo sapiens
cactatgctgaggttgaggaccagatacactatgctgaggctgaggatcagatacactatgctgaggaccagatacactatgctgaggctgaggatcagatacactatgttgaggttgaggatcagatacaccatgctgaggaggatcagatacatctccttcctgtcttcagggcaatgaatgaaggagaaggaaagtagttctcaggaggtttatgaatttttgttttcaaaaagctttactcataaataagtagattttaaaccaagaaatcatacactgctgaaaggagtatcagcaactttcaagaagggcaattaggtcgtatctatcaaaagacaaacgacaaatgcttatagctgtggcccagcttttctaattctgggaattatctcacagtaaatatagatgttattcattgc

SEQ ID NO: 201940 - DNA, 366 bp, Homo sapiens
gagggacagaaccaggatgcaatccccagccgcctggctccagactcgggttcccaaggtcccactacacttggtcactccaaggaggatcagatacatctccttcctgtcttcagggcaatgaatgaaggagaaggaaagtagttctcaggaggtttatgaatttttgttttcaaaaagctttactcataaataagtagattttaaaccaagaaatcatacactgctgaaaggagtatcagcaactttcaagaagggcaattaggtcgtatctatcaaaagacaaacgacaaatgcttatagctgtggcccagcttttctaattctgggaattatctcacagtaaatatagatgttattcattgc

SEQ ID NO: 201941 - DNA, 764 bp, Homo sapiens
ctgaggaccagatcacaccacctgagtctgaggaccagatacactatgctgaggatcagatacactatgctgaggttgaggaccagatacactatgctgaggctgaggaccagatacaccatgctgaggctgaggaccagatacaccatgctgaggctgaggaccagatacaccatgctgaggctgaggaccagatacaccatgctgaggctgaggatcagatacaccatgctgaggctgaggaccagatacaccatgctgaggctgaggatcacatacaccatgctgaggctgaggaccagatacaccatgctgaggctgaggaccagatacaccatgctgaggctgaggaccagatacaccatgctgaggttgaggaccagatacaccatgctgaggttgaggatcagatacactatgctgaggctgaggaccagatacactatgctgaggctgaggatcagatacaccatgctgaggttgaggatcagatacatctccttcctgtcttcagggcaatgaatgaaggagaaggaaagtagttctcaggaggtttatgaatttttgttttcaaaaagctttactcataaataagtagattttaaaccaagaaatcatacactgctgaaaggagtatcagcaactttcaagaagggcaattaggtcgtatctatcaaaagacaaacgacaaatgcttatagctgtggcccagcttttctaattctgggaattatctcacagtaaatatagatgttattcattgc

SEQ ID NO: 201942 - DNA, 217 bp, Homo sapiens
ttttagtatagatggagtttcaccatgttggccaggctggtctggaactcctgacttcaagttatctgcccgcctcagcttcccaaagtgctgggattacaggtgtgagccaccacttccagcctgtaccatcattttgatagtaaagaattccatatgtgtccatttatttacattagtgtatagctttatatttatatatgtttttatgatgctg

SEQ ID NO: 201943 - DNA, 230 bp, Homo sapiens
aaaaacctgtctcttctaaaatacaaaaaaaataaaaaagagagagagagaaaatattcgctgggcacggtgacacccccctgtagtctcagctatttgggaggttgaggtgggagaaatgcttgagcctgggaggcggaggttgcagtgagccgtgataatactactgcactttagcctggacaacagagtgagagaaaaagaaagggaaggggaggggaggggaggga

SEQ ID NO: 201944 - DNA, 401 bp, Homo sapiens
gctgacaaggtggagaacccagagagcctcagctctttcggcacaccaggaaagggacagcaggctaagctggcagatgtgagagtaaccctccctcggtcccacacttctgatgcactgaagtaaaggcagctgcctcttgctttctgtcttctcccatctgcccacctccttgaagatatgggacaggaagagcaggagacattcatctattttggcctgtttcttttcagtcatttattcattcatttcttttttttttaagataagagtctcatgagtcccttcaaacggttgagcctttaggagcctgcactctactttgtacctgggagggtacttaacagacacttggcttcatttgtgcatttgtctttcagctctgtgcagtgtgcctagaa

SEQ ID NO: 201945 - DNA, 748 bp, Homo sapiens
aaagaatgaccagacagagtatttgtaacatacaggacattctacaaaagagcttaggaaatgcctttgtccctgaaatgttttcaagtttatctcctcctttcatatctgctagttgcagtggagatggagggcagaaagacaataggagaggtacttatttggtaccttttggatgtaaatgtgaagaacataaagagatcaacttgggtgactgctaggtgtttgtttgttttcttttcatttaacctgaggctagacagtactatattatgataaagtaagatcaggttctgaagaggggaaggacagtgaatttcaggcaacagtgggacagaaccggttgagctgccctctaaacagtggtaaaggggaatggagaaaggtctgggctggagatttatgagctctgattcatatgttgaggtggaagctacaggtgtgtatgaaatcatccaagtacagcacgaagagggagatgagaaatctgcccagggagcaatcctgagaaactgcaaaatgtaaggcctttacaaggggagagatgcaaattaaacaacttaaaaggggccaggtgtggtggcttaagcctgtaatcccagcaccttgggacaccaaggcaggaggatagtttgaggccaggagctcaagaccagcctgggcaacatagcacaattccatctctacaaaatttttttaaaaattagctgggcataaaaaacaaactaacaaacaaaaaaacaaaaca

SEQ ID NO: 201946 - DNA, 374 bp, Homo sapiens
cctcctgagcctgggtcctcctgaacctggggtcctcctgagcctgggtcctcctgagcctgggccctcctaagtcaggatcctcctgagcctgggtcctcctgagcctgggtcctcctgaagctgagtcctcctgagtcagggtcctcctgagttggggtcctcctgagcctgggtcctcctaagcctgggaactcctaaacctgggtcatcctgagcctggtaactcctgagcctggggtcctcctgagcccggggccctcctgagtctggggtcctcctgagcctggggtcctcctgagcctgaggccctcctaagtcggggtcctcctgagcctgtgtcctcctgaacctgaggccctcctaagtcaggg

SEQ ID NO: 201947 - DNA, 347 bp, Homo sapiens
tccctttcttattcctgacaatcagtctcttctgaatcattatataaagtaggcttacatttgctggtaaagtcagttcagcatttcttgtagcaaccctctcctttttgcttaatggccttgtggtagattaaagatggccacaaattctttgacattcttcccatggagagacagggtctatgtcctcattctccgaatctgggcaggctctgtgactgccccaacgcactgaatatggcagaagtgattctatgtcaacctgcaactccaggccttatgaaatccacagctccctcttgctattgcttgaaatgcttgctcttgggagagccagccgccatgta

SEQ ID NO: 201948 - DNA, 408 bp, Homo sapiens
aaaaaaaaagaacacacaattgcttgatacacagagcaaaaggagtgttggttaatcagagtaaatgttggctccgcttgctgtattctgcattttctctagtgcacactggtataattagtccatacttattgaggaaactaagttctgattagcatgacgtgttcagggcaaaagaacaaattactttcactgcttaaggcatacagatctgcatgaatttgtttcaatgccagtgccagaagggaaaactaaagagggcaagagacaggggatagtagatagtcttttttttttttttctgagacagtcttgctctgtcaccaggctggagtgcagtggtgcaatctcggctcactgcaacctctgcctcccaggttcaagcggttctcctgcctcagcctcctg

SEQ ID NO: 201949 - DNA, 703 bp, Homo sapiens
agctatttagcacattctgctagtggctccgcaggatatatctgatttaaaaaataggaaccacaataataatagctgcttatgcttatggagcattgccatgtgctagataggcaccatcctcagcccttggcaggtctgagctcctttatttcttccaatcaacactatgaggcaggttctgtaaccccccttagggttaggccactcgggaaactgaagcacagagagtttaagtaacttcctggaggtccgacgcgtaacatgtggaggtgctgggattcaaaaccaggcaatgtgggtcccgggcactcttgaccagtgcctgtacttcttccaaggaatagagcaagggaggtcataccgaatatcacagtgtcacctaggaagcccaagggaggtattcccgttaatctgcagccaaggccgggcgcggtagctcatgcctgtaatcccagcactttgggaggccaaggcggatggatcatgaggtcaggagttcaagaccagcctggccgagatggtgaaaccccgtttctactaaaaatacaaaaattagccgggcgtggtggcggacgcctgtaatcccagctactcgggaggctgaggcagagaactgcttgaacctgggaggcagaggttgcagtgagctgtgatcatgccactgcactccagcctgggtgacagaacgagactccatctc

SEQ ID NO: 201950 - DNA, 1045 bp, Homo sapiens
ctctagtgatagcagtgtatatatatatgtatatatatatatatatatatatctcttctggggactgagtgactctagtgatggcagtatatatatatatactgtatatatatacagtatatgtatatatactgctatcactggagttacttagtcctcagaagaggcctgggaaagtagtagtgctattatcctcattagttcagttcagagaagacaacttgcccaaacataaacaaacagataagtactacaacgaagcctccttagatctactaggctccagaatcttcatgctgaagagaaactttgttattttgaggcaaatgagataccatccatgtgtatagttcttatacctttgcaagctgtttcacatatatttggattttattctcaccccatgaggtcagagtgccaggtttcactttcctctgttttgagctaagagggaaactaaggttcagagaggtaatggaaacttccacacgtcacagaactagttagtgacaaaagtccaaagttaactcagagctcttgggcccagttccctgtagcatgccaataagaccactaatccaggctcctgatctcttagattaaactgggcaagtctgtatctcaacttccccagtgagtaggagttcatttagcaaatatgcatcgagatgtgatgaatgaacagtgtgtcaggcatagtgccaggctttagtgtgatagtgacagataatacatagttgattctggctgggcacggtggctcacacctgtaatcccagcactttgggtggccgaggcgggcagatcacgaggtcaggagatcgagaccatcctggctaacaaggtgaaaccccgtctctactgaaaaaaaaaaaaaaaaaaaattagccgggcgtggtggtgggcgcctgtagtcacagctacttgagaggctgaggcaggagaactgcttgaacccgggaggtggaggttgcagtgagccgagatcgcgccactgcactccagcctgggcaacagagtgagattctttctcaaaaaaaaaaaa

SEQ ID NO: 201951 - DNA, 481 bp, Homo sapiens
aaaaacaaacaaacaaacaacagcaacaaaaacgaagatttggataattcatgtgtcttttgttttgatctcagaatttcctcattaacagatgtgaaataatttaccaagtttttcttcaaattgactaggcctgtataaaataacagaaatgccctttgcagtgaaagcactttgtattagggattgatcactcaattacattctggatgagaagaaaaaaaaaatcctattggtgtttttatgtgattacatttagggagaaaaagtttggaaagctaagaatcttttgtgggaagacaaaaagaaagagcttttaaggggcactttgaatacagagagtgactttagatagctagcaatgctgtttaaaagttacatcatggctttaagcaaaatcaacagcagtgaaacaaactgaacaagcagaaaaaaatataactcgaaacactgatgagtagtagtttttgaaagtgaattc

SEQ ID NO: 201952 - DNA, 326 bp, Homo sapiens
ctcttgatttgacccatttacatgtggagtatttactaggtatgatattccaggcatttattcaataagcaataggaaaatcattatacctgaatgggaataaaagcttattaagtgagattgttttactttattagcatactttgtatatagtttctttgatagcattttatagacattaaattatatgaactgtaggttttgcctaatggaagttgccacttaacaatattggcccctattttttattcactataatatatttttgagttacacattgactataatcctaggagtactttcttaattcttatgttataatactg

SEQ ID NO: 201953 - DNA, 1117 bp, Homo sapiens
  misc_feature (139)..(139): n is a, c, g, or t
gggaaggccaaaagcattgtggacaaagaaggtgtcccccggttctatatccgcatcctggctgacctagaggactatcttaatgagcttgggaagataaggaagggaagaagaagatgaacaagaacaatgccaaggntctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaacggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtccaagatcaagttcaatatcatcgcctctctctatgactacaaccccaacctgggcacactcaactggaaggccagacaatagcggcggacaaggccccaggaccgcaaacacggactccgctccaaacaaccggcaggagagtccccagagaaaggtcgagaacgaacaacacgcaaaaacaagagaaaacagagaaaacgcagacaaccgagcgaacacgacgacgaagaaaaacggaagagaaaaacaagaaagacatacacacaagac

SEQ ID NO: 201954 - DNA, 465 bp, Homo sapiens
caggtgtgagccattgcgcctggcctaatttttgtatttttagcaggggaggggtttcaccatgttggccaaaactggtctcaaactcctgacctcaagtgatctgcccacctcagcctccgagagtgctgggattataggcatgagccaccgcacctggccaccaaatcctgctcttataggaagctttccatccctgcttccttgcttgccccactctcccattttttagggccctaaacatagaaacatttattacattatattcaaagtaaaatcaacttagaattcagtaaatagaacaggacattgcttaagagactttggatataaaccaaaataagtcacaacaaaactgcaatcagcttttgattatctaggagcatttttgttgttgagaattgggagaaagacccttactcttacttcttagattcctctttgccttgcaggaacccagctcct

SEQ ID NO: 201955 - DNA, 246 bp, Homo sapiens
ccccacattgtcctatagatttaattcaatcccagtaaagaaaaaaaaaaatgccagcaagctttttttgaagaaattaacaagctgattttgaaatttatatggaaacacaaaggatccagactagtacaggaattttgaaaagaagaacagaattggaggacttgtactacttgatctcaagatttacaagcctataataatcaagtcaatgtagcattgacataaaggcatacatcagtggaa

SEQ ID NO: 201956 - DNA, 377 bp, Homo sapiens
ctggaatttcttggagcaaaaattccagtttaaatatcaggaaaattgtctagactaagagaatggaaacggactttgtgcaaccaacatcaggtacagaaaagagaccccaacaatcatcatgaacccaaacaggcctttctcctcactaagagaagagaacacacacaacccatgccttgttactctttgagaagatgtgccctgcctgtgatctagcagctagagacggaacatacaacctgttctcaatattcaaataattttttaaaggacatggtatcacactgagcaagtgaataatgcaattctgttgtagaagaatgaacggctgaaaagacctgagcaactcatgtccaaaacttgcagtttccaca

SEQ ID NO: 201957 - DNA, 109 bp, Homo sapiens
atcccagtatcttgatatccccaggaggctccaactaatgtcctatactctgtatggagtttgtgagtcattcttctctcagccacacacatacacacacagggaaaaa

SEQ ID NO: 201958 - DNA, 234 bp, Homo sapiens
tgagccgagattgcagcaccatgctccagcctggactatagagcaacactcggtataaaaaaaaaaaaaaaaaggataagcaaacaaattatgatgaaataattgccttataaaattgcagaaataggccaggcgtggtgactcatgcctgtaatcccagcaatttgggaggccgaggcaggcgcatcacctgaggtcgggagtttgagaccggtctggccaacatggtgaaac

SEQ ID NO: 201959 - DNA, 444 bp, Homo sapiens
gttaagaatcagtaggtgtgtgtaattgtgtatataccatgatcataagcataaaaatatgttattgcatctgggataaaactaggaggaaatataaaaacacatcaaaatattaacagtggttacctttgagtgtaaaaaatgagtgttagcttttttctgtatactttttttctatctatacttttctgcatttttttttctctgtacctttttttctatctatacttttctgcattgtttttcaaatgttccccagcaattgggcagcagaggaaggaatcggcaaaatgtatattttttaagtaattgccctatcaattaagcatttagctcctaaaataatggggaccaagaccttttttttgtttgtttgagacagagtgtcgctgtattgtgcccaggctggagtgcagtggtgcaatctcggctcactgcaacctc

SEQ ID NO: 201960 - DNA, 408 bp, Homo sapiens
aagagtgagactccatctcaaaaataaaaaagatggaagcatgtatttgtattttgagcatcaataactaggtaagagaagtgcatttttaaaaccaatgagttataaaaattcaaattagatatatatacatgactaaggggtaggggggtccagttgtaacaatggcaagttctaagagataaaatcctaaggtctttgtttttatttctatggacatcgctgtgtcttcttgactcttttataagtagcatgtttttaataatcagaatatatataaatctatttttgaagtaatataatgactagccttgtacatacaattttgcatacatcttgacttccttagaattagtacccaggtttaacttatttagttaaaagaataaatttttttgaaactttaca

SEQ ID NO: 201961 - DNA, 302 bp, Homo sapiens
cccactggtctaaatccaaacacttcatacattgcctggatcccatctttaacaacctttctaggggacttgcattatcccttctgtatcttaattttctccttccctactgaacattacacattggcattttaaatatattcaagtttctctagtctttaaaatactctctgagtctgaattcttctccagataccaatgtatttcttattccttttacagccttttcattctttacaaatttcttgagagcctggatgcagtgagccagtgagcctgggtgacagactgagaccctgtct

SEQ ID NO: 201962 - DNA, 481 bp, Homo sapiens
aaaaaaacacaaaaaagcagaattcctaaaaaaaacaaaataaataaatctttagggactcaaaaatatgcttttatcttcttaagtgcagttaaaagacaacttggaggaaagggcccaacaagcttgtttggcatatcttactttaaagaagtgatcataatctaccttcctctcatcattgtccacaagaagtaaaaataattatgtggctgtttggcaataaaagaggggtggttccttagagctcttttgggaattttcctgaagattatcacttcactctgtgtgtgtgtgtgtgtgtgtgtgtgtgtgtgtgtgtgtgtgtagaaggaaatatttagtagttacctttgagcagggtgcctggagatttttagttttggttgggaagaagactttttttaaaaatgagtgttttatatagaatagtgtcagatttagagaaaagttgcaaaaatcataccgagtgtccgtacat

SEQ ID NO: 201963 - DNA, 404 bp, Homo sapiens
atgtttttgggggggagggggtaaccaagatttcagggtagtaacttaggaatctaagaactatcttctactttaggaagagtgggattagttactccctttgtataggaggactttatgctcaaggaatgtgttgtggagaaaaacacttcttcacaaacaattcagtgacaagacctcaaaggtaatgcgtattgaggaaaacagtagtgggtgaaaattcccgcttagctgtaaaatgactctcttgccaggtttccgtgtttgtctcaactgaactctgggctgagtgtttaccagggagaagagatgtgaattaaacaaccttcctgtttagtgttacctgctttgtacaagaatgaagtgcaaagccaacttactttattaatccaagttctttttat

SEQ ID NO: 201964 - DNA, 409 bp, Homo sapiens
actgtgactggcttatttcacttagcataatttttcatgctgcatctgtgctgtagcaggtattgatgtggggtttttctcattagttcagctacatctgggttcttctctcatgaccaggaaaaattaagcacgcagacacattgaagggtgaggaggacagaatttattaagtgaaaggaaagctctcagtaaagagagtggtcctgcaaacaggtttccacctcacaattgaataccaggagcacatgagttgaagcagccaggctcctcccctgcataaggcatgaatttctggtggctccacctcatccccccagtgcatgtgggcctctggtctgctgcaggcatgtccaggcaagacaagtccaggttcccttatctgcacttaacatctggtgtaaacact

SEQ ID NO: 201965 - DNA, 263 bp, Homo sapiens
agctggctgccgaaggcctggcccaccgcaccgagaaggccaccgagggagccattcatgccgtggaagaagtggtgaaggaggtggtgggacacgccaaggagactggagagaaagccattgctgaagccataaagaaagcccaagagtcaggggacaaaaagatgaaggaaatcactgagacagtgaccaacacagtcacaaatgccatcacccatgcagcagagagtctggacaaacttggacagtgagtgcacctgcta

SEQ ID NO: 201966 - DNA, 145 bp, Homo sapiens
ccttgagcccaggagtttgagactagcctgggcaatctagtgagaccttgtctatatttagtaaaattgaagaaaagagaaaaagttttcttttcacatattttcttcctaatccacttctgtaaatggttggtaatatttactt

SEQ ID NO: 201967 - DNA, 569 bp, Homo sapiens
cttcccctcccaagacgccctgtctaaccctggctgtccccacagatctgtacatggaggaagacacaggaaggtttgcccttcaacaggcacaaaaagcaagctccagatttgctcaactcgaatcaaaagggctaaacacatccagatgtttgaacggttctggaagacgaggcagagccccctccactcccatggcctcccccgacagcagccttctccctactccctcggaaggccaggggaagacctgccaagacaaaatggctgttctcggggacggtgagatgactgcgaacgttcccagggaacatggcatcaggagcacaccagaaagagcagacccacagccagagaaagaagcgatgtttatccacttgtgagacatctggaaaatgaaagaggctacaagccatctttatcacatctctgtgcatacaaatacaccacggaaaattacagatccctctcatctaccaaatgagccataataaccccgcaggttttccccgagtcctttagacactccgccttacactgtttatcacgagggagacaagtggagaacc

SEQ ID NO: 201968 - DNA, 198 bp, Homo sapiens
tgatgttgggatgaggctgactcaaagctaggactgacaaaagttcttcattcttatgtccttggccggccagccacaggtcagtttccatccccaaaagattatctcactcagctcacaaacatccttagcctaacattccctagaaaatgagacggctttaggacaaggggtccaatagttacaactaacacaact

SEQ ID NO: 201969 - DNA, 330 bp, Homo sapiens
aaagttatacagtcacatttcaggacatatctatgtaaaaatgcttgatccattaattatctggagccctctctggcctgcaatttctattctagcccaatgtttctcaaagcaagcctggtctggtcagaatctctgggacagctggttaaaaatgtagattcccagcttattccaaattgtagcatcaaaagctctcaaggttgggccagaggatctatatttttatctatatggatctatataaatctatatagatctatcttttatatgccctcccttactgattcttatgtacatgaaagtctgagtagcgttattaactggttc

SEQ ID NO: 201970 - DNA, 411 bp, Homo sapiens
tataccgatcatccctagagatcacattcagctgctccccgctatggcctcagtgcacattcgcctttgtgtcctgcgaatcgttctatgggggtagattcctagaggtgggagcatccaaggacaggacacccaccctccgaaatggctgtccccattcctggcgcccccagctctgagtgacatggcctgtttttgcatgtccccaccagtgtgacgacaggaaatggagtcttggttctgtttgcatttgtttgattctctgtctatggccattacccgctttcccatctggaggttcaccttttccaaggcagttggttttcacaggaaacgcggggctctggccagaaatgcagcgcagatgagcgcgaggagcctgtgcaaacaattccacatgcaggaatttgg

SEQ ID NO: 201971 - DNA, 518 bp, Homo sapiens
actgtctctccactgaacttaatgctttaactttacctaaaactaaaaccactaaagtatcatctctctctatttttttgtcttttttgaaacagagtcttactctgtcacccaggctgggctagggcacagtggtgtgatcatggctcactgcagcctcaatctcccaggctcaagtgatcctcccacctcagccttccaaaaagctgggactgcaggcatgcaccaccacacccagctaatttttatattttttgtagagatagggttttgtcacgttgcccaggctggtctcaaaatcctgtgctcaagctatgcacatgcctcagccttccaaagtgctgggattacaggcgtgagcccctgtgtccagcctagacttctcagttgaggaagaaaatacaaagagagggaggaaagttgggttccgttgagtttgtgggatctgtgagataagttacatgtgagatatattgaattgaatgtatcagtctcattgcagatgatccttgaaaatg

SEQ ID NO: 201972 - DNA, 214 bp, Homo sapiens
cctcccatctcagcctcccaggtagctgagatcacagatacacaccaccacacccaggtaattttttttttaagtaaggacaaaatctcactatgttgtccgggttccaaataaattttaacagcttaattttaactattcaaaaactaagcaaatacctgaaaattatttcttctgaaaaacacatgctaaataaaaatctactatacttatg

SEQ ID NO: 201973 - DNA, 258 bp, Homo sapiens
tgattcagaagacctcgtattatattcatgtgacttagagctctcactattgatctagttttatgaacaatgtttactgtaaaatagaggcatgaaatggtaattaatagaccaactaatgaaactttttatataagtgagcttactttatgacaaaaagaaaaaacactaatgattgcatactgtgcagtctgtgtgtgcaatcattagtgtattttcttcttggcattcagtcaataatatgttgagcatctattc

SEQ ID NO: 201974 - DNA, 302 bp, Homo sapiens
ctcacagtcacacctcacagtcacgcctcacagtcacgcctcacagtcacacctcacagtcacacctcacagtccacacctcacagtcacgcctcacagtcacgcctcacagtcacacctcacattcacacctcacagtccacacctcacagtcacacctcacagtcacacctcacagtcacacctcacagtccacacctcacagtcacacctcacagtcacacctcacactcagggttgatacctcacagcccacaccccatggtcacatacctcacagtcccatctcacagtccatgcct

SEQ ID NO: 201975 - DNA, 160 bp, Homo sapiens
gcttttataaaatgtaaaatgagagagaatctagctcttttaggcaagaactttaattcaccactatatactgatgctgaaaatagtagtacatttattgaatatgcagagaaggtactcaagaaatgactgtcaaataaataaataaaatcattagcta

SEQ ID NO: 201976 - DNA, 401 bp, Homo sapiens
ccttcgatctaataatcctctcagacgatttaacaatatccccagcgagttggctttattgagggctgagttcctgagaaggaaggcagcgacacaaatagctcaagtgcatggagacagtcgctggccagtcttcccagcgctgacagctctgaaatacaattatcagtgtgatctgcttaagaattcatcatcagctcctgccttctgaagacttaaaaaaataccgagacatacaaagagaaagaggtgataagaaggcatcattttcctccagcctcataactgtaaattgaagaaaattattttctttgcctccagctcattggcatataggcagcattatattataatttcataagcataaatcctttgaataaatttcagaagaataactgaat

SEQ ID NO: 201977 - DNA, 591 bp, Homo sapiens
tagacctaacccagtagacctaaccactgaatcctccggaaggaattgtagcaggccccatgaatgaagagaacttttttgaatgggaggcattgatcatgggcccagaagacacctgctttgagtttggtgtttttcctgccatcctgagtttcccacttgattacccgttaggtctacctggctaacctagctgctcaaggatggccctgtctgcatgcttcctttcaaaagctagcatagaaaggagggcccaaggtgaggaaatttgtccaaagtcacccaatgagtcgcaggaagggctagaatctggttatctggaccgtcctagagcactttcacagtgacagccggctggaatcaagttttcatttagaaaaatggctagaagttagggcattgcctgcagccactgaaaagcagctttaggagcagatgtccacgtaatagaaggagatgggctagggcctgccacggaagccagcaagcgcgtgggagctgggggaggaaaggagcaaaaggcaagaacaggcagtatgtccgcggtgcccacagtgctgtgggtacaagcaaggggaaaagagcccatgg

SEQ ID NO: 201978 - DNA, 871 bp, Homo sapiens
tctctgcacttcctggggagcgtctggcccagcttggtacctcgcgtgttagcctgctgagagctgcagctccagcccagccgcggaccgccgggaagtcacccgctctgggggcagctgaatcttgacgttaccgccattgtttggagaaatcgagtgggtgtggaactgcggcgagcgagcccaaagtcatgctcagccggaaagtcgcatacaataatatgaagttgaactttcctcggcgcagaaaggcacaataataaaccctgagatccccggaatatcagaaggaaagtgctgttgatttgttcagctacttggaaacctcgcctctgctgagaaattaaagaagctagtgacggatttatcttggaaatacacatactggaaattgatcttaccaccatgagggaagatgcaccagccttctgggttctgtctcagaattgctatataggaggaaatgggcactttaaaaagtacaacttttgcctatgatatgcgatgtaagaagatggctaagaatgaaaatattttctatctagcaattacacttaaaactaaagtgattcataagactacaaaactggcttaggaaggaaggttggcggcggtgaagagggaagaggatgatctagtaatgggctcttccaaatcgcatctggtaggttcatagccatgagtcagccaccaatcgggggcgctgcccctgccacagcagcagcttctcccgccgctgcagccactgaggctcgtctgcacccggagggcagcagcagaaagcagcagcgagctcagtcacccgctagaccgagggacagttcgctgcgacagacaatcgcggccacccggtccccagtgggggccggca

SEQ ID NO: 201979 - DNA, 623 bp, Homo sapiens
tctctgcacttcctggggagcgtctggcccagcttggtacctcgcgtgttagcctgctgagagctgcagctccagcccagccgcggaccgccgggaagtcacccgctctgggggcagctgaatcttgacgttaccgccattgtttggagaaatcgagtgggtgtggaactgcggcgagcgagcccaaagtcatgctcagccggaaagtcgcatacaataatatgaagttgaactttcctcggcgcagaaaggcacaataataaaccctgagatccccggaatatcagaaggaaagtgctgttgatttgttcagctacttggaaacctcgcctctgctgagaacttaggaaggaaggttggcggcggtgaagagggaagaggatgatctagtaatgggctcttccaaatcgcatctggtaggttcatagccatgagtcagccaccaatcgggggcgctgcccctgccacagcagcagcttctcccgccgctgcagccactgaggctcgtctgcacccggagggcagcagcagaaagcagcagcgagctcagtcacccgctagaccgagggacagttcgctgcgacagacaatcgcggccacccggtccccagtgggggccggca

SEQ ID NO: 201980 - DNA, 769 bp, Homo sapiens
gccttggagctccagcagagggaggaggtggtgacagaacaaagggacaaacctaacgtttgggtcctgctgagcagccggctctccctggccaggggaggggaccttaaaggagcccgcaaggtggcaaagggaacagcacgtgcaaaggcacagaggcgagtggaaaagcgggctggggctggggctggagtagccgctgtgggaggacccgggctgagggccaggcactccaagcccttgctttccgatggtcctggccaaggcagcgccaggccacaccccggccccagtgtaggtgacctctccccacagcatccctcctgtagaggcccaggcagatccacagtgagcagaggagactcagggtgggaagagcctgtagggtcagacaggaaggggcttggccaggggtctgaagggttcagtgttagccagacagtgcacagtggtgtctctcactggggacaggactccctgcctgcatctgtcccctgccatctctgtgtgcaccccatcagccctacatcattgtccaacctgtaggcacatccatccatagcacccaggtgctggaatccacttacatttgtcctgaggttcccactgttcaccgagaactgtgtgtttcatcccatggttggctacgacaagccatccatttcacactgggctgttcctttacttttgctccctcgtgaccaaaatatacaaggtgttgctactggaagttgcgatttgctgtcctataagaaccccacacggattc

SEQ ID NO: 201981 - DNA, 438 bp, Homo sapiens
cgcatgacccagtaattgcactcctaggtatatacccaagagaaatgaaaacctatgtccacatgaggtcctgtacacaaatatttatagcagcacagcacaaaagccagaaagtagaaaccaccaaagtgtcaatcaactaacgaaaggaaaagtggccgggcgcggtggctcacgcctgtaatcccagcactttgggaggccgaggcgggcagatcaccaggtcaggcgttcgagacaagtctggccaacgcggtgaaaccccgtctctactaaaaatacaaaaattagctgggcgtggtggcgggcgcctgtagtcccagctcctcaggaggctgaggcaggagaatcgcttgaacccgggaggtggagtttgcagtgaggtgagatcgcgccactgcactgcagcctgggagacagaactagactccgtctcaa

SEQ ID NO: 201982 - DNA, 512 bp, Homo sapiens
aaccatgatttcagagatattgcttgggatcaaaataacttggatatttaagtttttaaaaagtagtcaatttaaagaaacatggtgagtaaacaataattcaggtggtacacagctttcatgaaaattgtgaaggtggtagatgatgcgtttgggggacagcaaatttgaacaggatagaataaacggttaaggggaggaagaccacctgttcaaccctttttcatgctaagagtaacttttaaatgtggctaggcattccaagccaatacttccagtccagttgttagggcttagttataaaaccagctagttgcccctgtacatttgagcaagcatggtggatcaagcacaaaggaggggagggatagcattaggagatatacctaatgctaaatgatgagttaatgggtgcagcacaccaacatggcacatgtatacatatgtaacaaacctgcacgttgtgcacatgtaccctaaaacttaaagtataataataataaaattaaaaa

SEQ ID NO: 201983 - DNA, 683 bp, Homo sapiens
ggggactggcagaccatctgggctaccaagctgaggctgtagaaatcatggcccaaggccaggtgtgagcctacacactgctgagggactgggctatccaagaagacagtggtgccacccacaaggtgctagagaatgccctggttgccatgggccaggaagatgtggtccaggtcctgggcccccaagctgagggctgttctgtggtgtgagtgctgtctccatagcctgcactctcggagactgctccggtgctcccctacccccatctcatatatctttccctttgtgggcttcctggggttgctgggctcagcctgctctgttctggggaagaaaaccgaagatccagccaccattcacttccccttatccacccatcccctccagaagagggcccaggatatggtggggagtgggcagtgaggagtggttctgccctttggatccctactccacctcctcttattaagcctcagctggttttgctacttttgtaacccatattaaaggtgattcggacttttccgctggctctatctggctccttgggcctgtgagacagttgagtgggtggctatgaggcagaggcccagaaaaggggtgggggtccctaggctgtgggagctcagctagcaccacctaggacagctagcagcaacacaggacatgcagcagccatc

SEQ ID NO: 201984 - DNA, 231 bp, Homo sapiens
aaatttagtacaagatgccatttatagaataattgtgatacccgttacaagtttaaatctccataataacttgataataatcttgtgatagataggtatagaaaggctgtacttacaaagtatactgctaattgttgataatcatccctactcattcctcctcacctcccacatggacaaaactaagagaaaaattgtgtattataaacactcagcaaataggtctttatt

SEQ ID NO: 201985 - DNA, 185 bp, Homo sapiens
gtttctgctctaggatggatgaatcaataacaggtgtgcagaggcttgaactagacctttccctaagggttgatcttgacctaggagcagggaggagaaggaatgtatcaatgtctattttgtctgttgtttatgctgacctttgggaattagggaatttgagaacaggaatcctggtcttttat

SEQ ID NO: 201986 - DNA, 678 bp, Homo sapiens
agctttctttacaaggtccaagtttattcttttctggaagattaattcagaagttagaaaatatacatatctctgataaccattttaacctcagaggtaccctgaaatgaagggagcctcgctttttgcagaaaaatatttaccaaaatgtatttcttttagaaagtatcaaatattgttttcgatatcaacttgtaagtgatcagcaatcagaatattcacaaacacttgcgctcagggttgaggtgttcagacaccattttatttcattacttttgtccattatgatggcacagaagtaaaacgacctcatccgtccttagtgatttgcattttgtggtgaagattatattttattaaaaataaacctgtcctattcacaactagtcacaatttactggctgctcaaccaaagcgcaccccagtggcccttccggaacctgccctctgtcattccgtgttgtcgttgagcagcatttcttgaaatgtggtgtgtgtcccattggcatcatagttatcttggggtgccccttaaggtggacatttcttagtctataccagagctgttgttaaggccctggaccttgcatttgatacaagtccaagataaatgtcatgtacgttttaaattctgagaactcactgcatgatagcactgaggtcagacggaggctttgg

SEQ ID NO: 201987 - DNA, 362 bp, Homo sapiens
ttaattcatcatcaggcacatcactcatcatcaggaaatgtaaatgaaacccacaatgttcccagcactttaggaagctaaggtgggaggatcacttgagcccaggagttggagaccagcctaggcagcataaccagaccctgactcaaaaaaacaaaaataaatttataaataaacccacaatgcaatactatttggcacccatcagaatgtctaaaactaaaaaaaggccaggcacagtggctcatacctgtaatcccagtactttgggaggccaaggtgggtggattgcttgagctcaggagttccagattagcctaggcaacagggcaaaaccccgtctctacaaaaaaattcgccag

SEQ ID NO: 201988 - DNA, 504 bp, Homo sapiens
tacagttttacagtcactgtctgaggcaggaattattattgccattttaccgaaggggaaactgagtctcagaaaggttaagcaatttgcccaaggtcacagtgctaggttaagtggtaagtctaaggcctttccaccagagaggactcctactataaggcatgtggatcttctcggttacaagtccaggaaaagtccaagatgttcgatttcccaaaaaacaagatcaggccgagcacagtggctcatgcctgtaatcccggcactttgggatgccaaggcgggaggatcacttgaggtcaggcgttcgagaccagtctggccaacatggtgaaaccccgtctctactaaaaaaatacaaaaattagctgggcatggtgatgcatgtctgtaatctcagctactcaggaggctgaggcgtaagaatcacttaaaaccaggaggcggaggttttcatcactgagccgggatcacaccactgcactcctgcctggatgacagagt

SEQ ID NO: 201989 - DNA, 297 bp, Homo sapiens
catttttcaaggcttcatcagctgcttagattaaggaaggataaaaacaagagaaagagcaagagaaattaagcaactcgtatgctttcttcccctaagaatcctgattaaaatccaaccacagaagacttgccagcaagttccaatatatggcgtgctttccatagcagatctggctagtggttacttggaggaaggtaacgtgacaacctatacaatattaactcatcctaaatgttgcttagtgaaagaaatataaatctctgagataggtgacacggggatttcatttggaac

SEQ ID NO: 201990 - DNA, 505 bp, Homo sapiens
atagagtataaaattaggtaacagattggaaccaataaaaacacacacgtgaaacaggaagagcaacagaaaattatcataatatggtatataattctaaaattatcagaatatgctatttttttttagcagggacaaagagtattgtaccccccctttttgggagacacagtcttgctgctgcccaggttagagtgcagttggtgccatcaaagctcactgcatccttggcctcccagactcaagcaaccttcccacctcagcctctcaagtagcggggactacaggcaggcgctaccacacccagctaatttttataatttttgtagagacgggtcttagcatgttgctgagactggtctcaaactcctgggcttaaatgacctgcccgtcttgacctcccaaagtgctgggattataggcattagccaccacacctggcctgcagcttttcaacagtccctcagtatgcgactatattttttgaagtgtaacaacttgactt

SEQ ID NO: 201991 - DNA, 377 bp, Homo sapiens
tctcctcctacaatccttgttgtcaaaagaatggctatgacaacatcaatgcctttatgccatttgcctggaagttcaaagccttcctggatgaagcccagtaggacacttggtaaggttcaaccaaaggaggacagatttttacaatgttctgccagccttggtgcatatgtcttttatgtcacttgacttataaatacaagtactgtttattagacattgttattagtaatgctggatttatttggtattctttcttccaacataaataaaagggcattagaatcttatctcatttatcctcataaaaaaggagagaagctatttgaacttctctttctgcttctggtgtttcctcctttcccactcactcagaa

SEQ ID NO: 201992 - DNA, 230 bp, Homo sapiens
atcgcgtgaacccggtaggcagaggttggagtgagccaagattgtgccattgcactccagcctgggcaacaagagcaagactccatctcaaaaaaaaaaaatcaacacacaaagcagcagcagggacaaccacatcttcactaagagctactgtgagttacagaccgaattgtctccccacaaattcatatgaagtcctaacctccagcacctccctcaaaatacaaccc

SEQ ID NO: 201993 - DNA, 408 bp, Homo sapiens
gtccagttcaatgtgctttgaagctatttagaagtgtctgttaagagaagggagtgacgaaattacacaaatacaaagtcagtgacgggtgaccttgggtaagttattcatctcctctgggctattttcatatttgtggaatgggaataagaacaaaaatatctgactgcactccagcctgggcgacagagtaagactctgtctcagaaaaaaaaaaaaaagaataaacatatttgtttcatacttacgtacagtcagtctaatataaggtgtttgtgtgtttctaaaaaggaccacagtcttctaaatttcacaataaaacccacagagcttacggggaaaatgggtttgggagaacaaagctcctgtcagtaacatataataaaaaagcaggaacctaatacaaac

SEQ ID NO: 201994 - DNA, 245 bp, Homo sapiens
aatgatgcgaaagacaagaagcttgtattgtgaagagaaagtacacacgtaagagagaagtgcaggcatgctcatgagaacaagtcacacacaaaggaattttctattctaatgtgctcctctcaattagggggtggaataatcatgaggttttctaggaaaaaaaggtggtgatttcttagaattggggtggcacctatttttatgggcatgctcggatctgttgtggtgctggtgggtgtgta

SEQ ID NO: 201995 - DNA, 588 bp, Homo sapiens
gtttatttagatgatgtcatgttattggacattttgattattaccaagtttgcgtataaaatttaaatgtaatgaacatcattgtacattaacctttatgcacatctggaattatttctttagaataaggttccagaattaaaattatttagtttggatgatgagagcatttattagagcatctgacaggtgatgctgaattttcctcaatacagttgtgcaaattgcattcccaccagtagtgtataaatgtgaatatccctccatatattcatcaaaacatggcctttctaattttgtaaatctctgctaatttaataggtaaaaatatacctttgttgctttaaaatttttatttctaatttacacacagtaaaattcactctttttagtatatggttctatgggttttgacaaatgcacagtcatgtatcttctacactagtaccatacagagaagttctgtcactttaataatttctcttggtggctctttttgtattcaaccccttaccccatactcaatctctggaaaccatcaatttattcttcatccctatggttttgccttttccagaaggtcatata

SEQ ID NO: 201996 - DNA, 237 bp, Homo sapiens
ctgctctatgtcatttcgcttacagttgtagtttctaagaacctgtggacgctgagtaggacgtactgtaccattcagcagtagaaatgaattagtgcgacagcttctttttatcaagaaggataaatctgagaaacatagtgttaagtgagaaaaagcaaaagagtacaattagcatcatacattttaataaaaatgaaagataaacaatactaaattatattgtctttagagata

SEQ ID NO: 201997 - DNA, 548 bp, Homo sapiens
cagattgtccttgaacttgcttttattaatatttatggtacaaatttccttctgtttcagtgatgatttcctcccaaacaggtttcttcaactgtcttttgtatttgaagtcaccgtatgtaaattttatgtttgctttggtatggtttgggtaacttccttgactttcttttctcatcttgtctgagacttgcttgaattatagttgaagactggttattggtcctactcatttctttgtactaaattaaatggtgtggtttatgtcacatttgcaaggacaaagaggagaaaaaagaatttgaacagagggtaagagtagtccttgtataactaccctggtaaccaatcagaaattaaattcattgaaagaatatctttagggtttgtactgttctcatttcacataaagccgtggagatttcttctgtccttgctgagatttattaacagtaggtaaggctctttgctttttccttgactttcattatagatctgatactctctccttccatctatttgcttttaaatttgcaagtactgtcatc

SEQ ID NO: 201998 - DNA, 451 bp, Homo sapiens
tctactaaaaatacaaatattagccgggcatggtagcacatgcctgtaattccagctactcgggaggctgaggcgggagaatcgcttgaacccaggaggcggaggtttcagtgagccgagattgcaccactgcactccagcctgggcaacagagtgagactccatctcaaaaaaacagaaaaaaaagtaacaaattgcctgtaagaaaaccaaagagcatctggcttcagacttctgctctatagcaccaaatgccaggaaacaatagagaattgtgagggggaaaagttgtgactttggaattttatacatattttatatgttaagatacataattttttagttatgataaccatccaggaaatatatgagctatgtaatagtcttacaaagataataagttgtacagcaacctacgaggcttgatttaaataaaacaatgtttgcttag

SEQ ID NO: 201999 - DNA, 390 bp, Homo sapiens
aggactccgggtcccttgtctaaaacgtttccaatcagatcatggtaaagacattaccaagtactcttaggacaagtttctgataactttaagatcaaaggactaggcttgctccgtggtgcacacctgtaatcccagctactcaggaggctgaggcaggagaatctcttgaacctgagaggcagaggttgcagtgagtcgagatcgtgccactgcactccagcctgggcgacagagggagactctgtctcaaaaagacaaaaagagagaagataaaaagtcaattgtttcatgattggaatcgtatacagcaatggaaataaccagttgtaatatgcaacagattaaatgaatctcacagacataaagctggacaaaagatgcaaatca

SEQ ID NO: 202000 - DNA, 449 bp, Homo sapiens
tgaatagttgtcagtctgcagagcccagggaatgttagaatgtaagggttttaacacaatttcaaaaaaaaaaaaaaaaatgacttgcaaactgtatatcaaagcaagcactgatgtatattcaatttgcagactacttttccagaaaatgtcatagtggatcttgtctagttccaatgtatctttatggtatcaatttatctacctagtgaaattctttccaaatatctttttaaatttttcatataactttttttcagggacttttagtagcagatgaatatcaatttaaacatttaaaatatagttgacccttgaattgcatgggaacactagtgtgcagattttcttccacctctgccacccctgagatagcaacatcaaccccttctttcccccctgctcctcagcctactgaacataaagacaaggaggatgaagagcaggag

SEQ ID NO: 202001 - DNA, 323 bp, Homo sapiens
agaactttaaaaaaatcataatacatgcaacagaatccatacattttatatctatgtatactaatagaaaaaaaattttaatacaaagagttcataccagatgaattagagaggttttagctatggcttctcttctcctagcaaaccccctgacccctgctaagagaccccccaaccccttaatacagtgtaggcgcctgactaaagctaggctaaccagtgtttccctgggatgcttgtaattgatacaaataggaagaccctcttgcctgttgggccacagaggtggaaggattgaatctggggttgccaggaggtcatga

SEQ ID NO: 202002 - DNA, 402 bp, Homo sapiens
acatttgctgagtcatgcgaataggttgcagttggccatggtgggagaattgacactatggaaattagcaagttctacatattagagcttctctcccctatccccaaccccagaactggttgttaaacatttaccaggacacctctgccataagctgagttgaaaaggtttggaagacattatattgtggggatagcccaatgtagatgctattggtacctcaccctgcatccctttacctagggagtgcacttatcccccaggtgctgtgagtgttggcagctaacaactcacaggcacccctttttctaggaattgtcctcagccaacaggagttgccgtggctggaatacctgggaggtaacgccctacacccaatagtggcccgtagcccatgattga

SEQ ID NO: 202003 - DNA, 828 bp, Homo sapiens
tgttaaagagaggagaaaaaggacaccaaaacacaagtatattgatggatgtgtcttttgaaaacagaatgaatcttagtgtgattttgtgtttttggagcctcagtgaaagaaaggggaacatgatgggtcgggtgaaatgaacagcccagtcttccaaatgtcagtgtacacccgagacatcagtggctgaaagctacagtcttaggttgacttgcggactttttttaaaatacaaagtcaagcccccgggagccatttcttcagtgggtcagtgcagactggctccttgctgggggtctgacgctcgctgggaccagtcctctgtttctgtggttctttatctgttcactgactgtttggcagttgaagacttgctccccaaggccctcagtctttgccacttcattcagagcacttaattaaaagagaaaaggaatgcagttctgatgcagttataactagtaaaaagaaccaataaaaatgactataaagtgcctgacaaatagaaaatgtttagtaataccaaggtactttatgggggaagggtttacctcttggcacaggatggcagctccacccccaccccccaaccccaggcctttccctccatgatgcccttggcagggagctcttgcccagccagaacaggtgagtgaaaagattctgctgtcttggagtcacctgacttcttactacaagaacatccttcagaagtgaaaatcacagacatgtaggtcttttgctggtgatgacagataacacaagagataaagaatactttggtgatgagagtaaaagggaaaatgaggaaaagacagtagaaaa

SEQ ID NO: 202004 - DNA, 521 bp, Homo sapiens
tataagttccttaaacagcaaagaaccagaaggctttgtcactgtcaatgggctagtccagagtagctccggccgacctctgcccctcgccctgaatcaggtcctccctccagatatacagggaagaccctgcacactcccgcctgtctataccctaactccttcactcccttctcttacagctcagccttccctgtcctttttcacattgcaacttaccctgccacgccctttcctgaaatgtttttctccactgcttatcacctgttatcacaggtgttagttccttattgtctctaaaaagtatacagaaatggcggagcacggtagctcatgcctgcaatcctagcactttgggaggccgaggcgggcagatcgcctgagctcaggagttcacgaccagcctggacaacacggtgaaacccagtctctactaaaatacaaaaaaaaaattagctgggtgtggctgcatgcgcctgtagtcccagctattgggaggctgaggcaggagaactgcttga

SEQ ID NO: 202005 - DNA, 679 bp, Homo sapiens
tataagttccttaaacagcaaagaaccagaaggctttgtcactgtcaatgggctagtccagagtagctccggccgacctctgcccctcgccctgaatcaggtcctccctccagatatacagggaagaccctgcacactcccgcctgtctataccctaactccttcactcccttctcttacagctcagccttccctgtcctttttcacattgcaacttaccctgccacgccctttcctgaaatgtttttctccactgcttatcacctgttatcacaggtgttagttccttattgtctctgcccactgaagacagcaagcttttctttgaaagggtgtctgctgcctgttgccaggaaagcacccagacagtaaacgattgggcgttgctctgtaccaataaaactttatttacaaaaacaagacgtgggccacatttggccagactgctcaccccagcattactaggtatgctacgagttattttttattcctagtcctatgctgcacataggaggtactcaagtagtatttacggtaggaactgggcacagtggctgaggctgcagtgagctgagatttcgtgcagcctgggagacagagcaagaccctgtctcaaaaaaaatttattaaaaattaaaactaaggccaggtgcggtggctcacgcctgtaatcccaatg

SEQ ID NO: 202006 - DNA, 291 bp, Homo sapiens
ctgaagtactgcatgcaggaaatgcaaattcataaccacaatatgagtcaacccaaaccaagatgaaatattgtccattccaagatgtcaccaaatggctgactggcatttggcaggaattgaactctagtagggagggtgggccatagtcctagtctgtattgctcatatgtcagccctctaccagtagtaggcttggtgagaaaaaaatctttgctgttgagcctatgcatagactccatctaagacaccatagatgctccatacacaagtccattgcttaagcactga

SEQ ID NO: 202007 - DNA, 407 bp, Homo sapiens
ctccacggcgcccagtcccatcgaccacccaacggctgaggagtgcgggcgcacggcgcgggactggcaggcagctccacctgcagccccggtgcgggatccactgggtgaagccagctgggctcctgagtctgctgatctgatttatcttcctatgtatctgatgaatggtttatccagggactggcaaaaggagaaaaacaagatgcagaggaatgagactgagagtaccacagtgtgaacagtttccccaaagtgcttcattttggctccagatgaagagatgggcaccaagagttgattgcccaactctacacagctaataaatggcagagcttaatcttaaacaacagatttaagtcctaaatcctgaatacagagtccaagtttttagctgctacatttga

SEQ ID NO: 202008 - DNA, 325 bp, Homo sapiens
cagtagttcattcctttttattgctgagtagaattccactgtggatatatatacacagtttgcttattcttctattgatggacacttgagtaattttcagtctgagacaatatgaagaaagctactctatacattaaggtacagatttttgtatggacatatgtttgcatttctcttgggtaaagtcaatatcaaagagtaggatttactgtgttatgtcgtatgtgtttaactttgtaagttatgtgccaaactattttccaaagtgtatcattctgcttttccaacagcaatggatgagagcttcaactgccccacacccttc

SEQ ID NO: 202009 - DNA, 736 bp, Homo sapiens
acattcaatgtcatcctccttcgctgataactcagctgccttgtgctgagagggcactccaccatgggccctgaacatgcctgcactctcttgctgagtaggccaatccataagactttcaggctcctgatactgagcaatgtctatagctactcacacagatataactaggccaaggcaactactgtaattacctgtaactgcttgctccctagagggagtggggattggctcatttgctgcttgctcaaaaagtgctaagcccttggcccaggattcctctcctgtaatgcaaaccactgcagatacatatgtcatctgggctcattgggttgccccattagaatttgagggcaagggaaaccattgcaaataggctgacacatgctatttgctgtgccatgaataataaattcctctgtctctgaccaaggagtgtcatgactattgccaggatccatgaaacaatgacagactaacatattagcttgcaattggccttcattgtccttgcagccttttctccacgtgctccacttttgcactcacccagtagtctcccaacctctggtcccctggtgcatggggctatctgactcttagtatttgcagagaagctaaggctgtgcaaaagctatagacatccaatctacagagctcttaattcgtgattcattctgcaaatatttactaaggacctatgccaggaactattctatatgatgcaaatgcaaca

SEQ ID NO: 202010 - DNA, 395 bp, Homo sapiens
tatcttatttctgtctctataaatctgactttctgagcattctatataaatggaaaaaaaaaaagttgtaatgttttgtgcctggcttctttcaacttagcatgtttcatgcaccttgcagcatttatcagtagttcagttcttttcattactgaacagcattccattatttgtatatatgacattttatctattcaccagctggacatttggattgtttccagtttctggctaacaaatgatgctatgaacacttgcattgaagtctctgaacgtagtaagctcttattcctcccgtagattcttaggcatggaattgctagaatttttttttttttttctaattttaagccattgcagtcagctggggctggaataatctggagggctgcctc

SEQ ID NO: 202011 - DNA, 489 bp, Homo sapiens
gagcggaaaggagtaacttctaacactaatgtataggacccaagtgtctctgaaaccttccactacttccgcagaactcacttgtgtccatttgttagtgtgactcggggtacatacactgtgtagaccactgggaaaatgtgagcaggttccagagaacacagggtttgccttcaaggaacttattgtccaggtgaagaaaaatgtgtatgtggcatgtcgtagtcagatgtctcacaggaggtggagtaagagggatgggttagcctccgagaccagttacttgccttcccatgcgttatctttgtatactcatctgttacaaggatgagaaaggttaatgtggttgaggatggaggaaatcagaactgctgacatcactcaatcttcctttatcgctgtgatttgtggatattcatgaagtagtagacattctttggtttcaaaaaagctagtaatttatttttcagtgcaccttatgtcctttag

SEQ ID NO: 202012 - DNA, 501 bp, Homo sapiens
caaagaccagcttctaggaacctaaattggtgaatttaggaattagccaattgctctttccttggcatggagttggtttgggcatttccccatattttatcttattttgttgtttgttttatgattatatatattttcttcctttcaaaacgacatttgtgagcagcatctgtgtcatctttttttaatgctgggcacacatgtgtacgcagcctgagtgtttggagttgagtgttttgtatgttggattgagagcacacagaagggctacggctggggagccatgatcagcagtggaggggcttcctgtgcttcaagaaaagcctcagtggtggaagacatgggatgtgtttttgatgaggatttcaggagttgaaacataagtgaaatagtatcctacaaaaggctttgaactattgataaattaattcaagatcttaccagtttataaggcagtcatataaagagatacaaattttggtatttttataagacaataat

SEQ ID NO: 202013 - DNA, 663 bp, Homo sapiens
aataactgcttttaaattttttatgtatttccttgtgctagtttaaacatatttaattaggagcatcctgtatatggttttacatcctgcttttttccacttaacaatatatctggaacattttctcatgtcatttaatgttctttgaaaatactattttaaatgactagctaggatttcttctattccaaaatgtaccaaataattatcctattgtttgagttttggtcttttctaattcctcactgtttatttaacatacattcatttcagcactttttcgtgtcaggaactgttctaggaatatagtggtcagtagggcagacaaagcccctaccctcaaagagctttcagaatgtaatgcaatgagccaggcgcagtggctctcctgtaatcccagcactttgggaggccgaggtgggcagatcacctgaggtcaggagttcgagaacagcctggccaacatggcaaaaccctgtctctactaaaaatacaaaaaaaattagacgggcatggtggcgtgtgcctgtagtcccagctactcgggaggctgaggcaggagaattgcttgaacctgggaggcggaggttgcagtgagccgagatcgtgccactgcactccagcttggaggacagagcaagactctgtctcagaaaaaaaaaa

SEQ ID NO: 202014 - DNA, 570 bp, Homo sapiens
gatacttggtactcttttattcaaagatgtaatgttataaatgataattagttcccaggctagtccacaaacggtaggtcagatatataacactctagtaaggaaagagcagcagacaccactggcaagaagctccttgttaacttttgtttttgagacagggcatgtgaggactcacaagtggacactcggaaataaacaagtaacagagtagctcaccccttatcttgctaagctaccagaagtttccaaaagtaattgcatattgccatgtgcaacaattgttatgtctgaatactcgaataatgagcatcatactatcttacggtgatttgcttggaagtttggatgactatttggaagaaaagtcatttctgttttgcaacagtaattcactctttccacaaagactgagcaactctaatactatctgccagcctctggggatgggtgaatattcttggggaactgacactccagccagtgctcagggcttgttttaatctgactctaaatgcagtcttccttccttgtgtgcactgcagagtggggctgcagagcagaaggggc

SEQ ID NO: 202015 - DNA, 298 bp, Homo sapiens
taacaaaggactgtgcacaaacttttgatatttgatgtgatagcaaatcaagcagaaaaggcagcctcaaaaacttatataaagtgataaaaggcttctctcatcccctaaaaaagaagaaaagggggttaaaggttaagcagaagataaaacagtcatttagatggtgaaatgtcactggtcaaaaatttgactttttcctttgtaatcctgcgttttttttttttttttttttttttttttttttttttataaaaaaaaatgcaatccccttttttgggcccacaaattttttcct

SEQ ID NO: 202016 - DNA, 341 bp, Homo sapiens
aaagctatagtgagctaaggttaatttatttattactgaagaaagaaaagtttttgggccaggtgtggtggctcaccctgtaatcccagcattttgggaggccaaggcaggtggatcacttgagtacaggaattgaaagttgagagtaagctatgattgcatcactgcactccagcttgggagacagacggaaaaagatgaaaaatggtattactgtgtagggcacttgccatgaatggagcttaggagactggaagttgctctgggtgagtcagtgagtgccatgtgaatgtaaaggcctaggaaactaatgtatactgctgtaggctgtttatttatta

SEQ ID NO: 202017 - DNA, 649 bp, Homo sapiens
aaaaatgagggtgtgtttgataaaaacagtatttgggaagggaggtggactgaatttttaaaaggtgactgcacagctgcaagtatagagtttgttcaaagaggtaagagttgggatcaaaaaatcagctgagtagcaaagagaccatggggcgtggggttattaaattggtctagacttttaaaggtgcaaaaagcaagagacagaagaaagactgtaatctggcaacaaacaaggctgctcctcggggaaggaacttgaagcagtggcaaggctagatgctaggctactgaaattttgtaaaggaagggggagctcagaagtcaagggaaaaacggttacagcttaagaatttgtttttatagcttaagaatgagttcattcaacaatgataataatacaggctgtctttgtgctggacactgttctaggtgctggagacagtgtagtaaacagaacaaagttcctgctcttgtgaaactttacctttcagtaaggaggcggacaaatgaagaaacaaacaaaaatgtaaggtcagaaagtgctgctgctgatcatttctaaagcttccaggcacatgtgtaggatacttagcattcagttctaaaatgcttccagaagtcttttgacatatgtggaaaagactatt

SEQ ID NO: 202018 - DNA, 143 bp, Homo sapiens
gctttgctgggagcctcgggaccccgggttgggggccgtggggcggcacctggcgagctggcgggtgggcggcgagccgaggcttcccggcctggcggcaactcgcccctctgccctcagccctcccggctccgctcccttcc

SEQ ID NO: 202019 - DNA, 285 bp, Homo sapiens
tcaggatggtcttgatctcctgacttcgtgatccgcccgcctcggcctcccaaagtgctgggattgcaggcatgagccaccgcgcccggcctcaactgccttttattagagggaaatacgtgttctggggcctcaaacatgaggttgtattgcaattgggtggtgatagcaagaatatcaaggatgaaagtagtgttttattgtcctaaaagtcttctcaaagtcatggtcccgtttgattctcatagctatccggtaagctaagtaaaacaggtgactgcctct

SEQ ID NO: 202020 - DNA, 445 bp, Homo sapiens
aaagtgctgggattacagacgtgagccaccatgcctggccgatcatgtgatttttattctctagcctgttgatgtaacggattgcattagctgatttttgaatattgaaccagtcttgcatacctgggataaatctctgttggtcatggcctataattctttttacatattgttgaactgtatttgctaatattttgttggtaatttttgcatctatgtgagatatattggtctatagtcgtcttgtaatgtctttgtcccgttttggcattagggtgacagtgacaaatgacttaggaagtattcctcctgcttctatcttctggaaaagattgcagaaaataggtattatttccccttaaatatctgctaaaattcaccagcgaactcatctgtgctgtgtgcttgcttcttgataaatgaatgctgtgactgcagttttgta

SEQ ID NO: 202021 - DNA, 398 bp, Homo sapiens
tgagctttgagtcctgttgatttttcttaagaaatcctagatagggtacaatttattagagaaggcttcctggcttccatgtaacagtgtggaaactgatggcagattgaactggagaacatggaaaaattacctcctaatagtgcagccaactcaaaagtaccttccccagcatttctgaagacaatgcaaaaatatgatgccttataggcagccatgcctcagaacattattgaaacacttgtttcttaaaaatttacatttgctttaatgttgaagtttttcttctcaaagtctactgtaaaaaattaatgagatgcagtcagatggttatccataaaaatgttcatttcattgtaatttataacacaaaaaagtgcaaaataagaaccaaatta

SEQ ID NO: 202022 - DNA, 512 bp, Homo sapiens
agcccgggtaggatgggcagcgctggactttttcaaccagtccttgtgcaattgttgcccagtgactgaaactgatgtggagaaagaggttggaactagtataggctggaaccatataacatgccaggccctggggagatggaggcggcaaagagacaagcctcagcctctaggggaagaggactgtagcatcctagcaccaccaagtatcagctggggtaccaaacctctcctagtctcaatattctcatctgtaggaggaaacaatatttgaacttcataggtttgctgtgaagacgaaatgagctcatgtaagtgtgctcagcagagtggccggcgcctggtggactcctgtattgaactgttgaagaataaatggaattttggggtgatggttgcccaacactgtggttgctttaaatactagtgagttgtacgtttggaaatggttaaaatggaggccaggcgcagtggctcacgtttaaatctttaatgcatcttgagttaatttt

SEQ ID NO: 202023 - DNA, 648 bp, Homo sapiens
  misc_feature (386)..(386): n is a, c, g, or t
  misc_feature (571)..(571): n is a, c, g, or t
tttggcattacaatttcattatgatatgttgagttgtggactttttgatgtgaccttcttgagattaaatatgtttcctgaaactgtttaatttcattagttttagataagtacattatctctttaaatattgcctcttttccaatattctccctttctccttctgaaattctcattagatatctgtaaactttctcattctaccctctacgactcttatcctctcatttttccatctctttacctctctggattgcattatgtatactttccttagatttatttcaggtcactaatcttctttaaagctaggtctaattggctgttaaatctgttaaatataatcattaaattttgactattataattttcatttctaaaatttntaacttggttctttgtcaactctgcttaatcatttaaagcatcatattcctttgttatttcctaagttcctttgttaattactttaagcatattaaacctagttataatctgtgtctattaatactgacacaggaatgctttggtttattatgcttcgcttcaatgcactttgcagacattgtantttttaaaaaaataaattgaagacatgtggcaacactgcatcaagcaaatctatcagcaccattttttccaaaagca

SEQ ID NO: 202024 - DNA, 457 bp, Homo sapiens
tcaggatgtaggcttaaggcaaagagttgttggcttgacacatgaagcaaaatctataaagctaaaaatgaataaattttacttcttcaaaattgtaattttacctatgaaagactctttaagcagatgaaaagacaaggtacagattgtaagaaaatatttgcaaaccagatattcattaactatctagaatatgtaaagaactcttaaaagtcaacaataaactaaacaaaatacaacaaaaaatccactggaaaaatggtcaaaagatatggaaagacatttcattgaaaaggacacacatatgacaaatacagataggcagagatgttcaacgtcattaatcattagggaattgcaaagtaaaccgacaatgacaaaatagtaagaagccaagccccgtactgggaaaaaaatatttgcaaaatatatatttgataaaggactgctattcaga

SEQ ID NO: 202025 - DNA, 430 bp, Homo sapiens
ttagacatttgaaacgagatacaaaacagaagtgtgatgataatattggaaaggaagacaaaattgttctaatttgcaggtaataaagaaccttgttagggatgagacctacgtgtgacctctgtgaacgtaacacaacagcttgagtggggtgataaagttggaaccaagaaaacaaaacccatattccaggagaagaagatgaaatattatcgatgaaaggatagtaattttcaagttaatttagtggtctaccattattccagccaaactttcttgagattttccccctaacttgacggattattccaaaagtcccatctgagggaaaaataggtaagaataattgaacagatttttttacagtggattttagaaggccagtcctgtcaatgtgtgaacgtctcccaactgttgtaattacaagtag

SEQ ID NO: 202026 - DNA, 286 bp, Homo sapiens
tcttccaagtgtactttcctttcctttcttgttttacagccttttaaagtaaacttccactcatgctctgaaacttgcctcggtctctttttctgcctttatgccccgcgtgaaattctttcttctgaggagtcaagaattgaggttgctgcagacatgtatagatttgctgctggtaactcagataccttacaccaataacagtacaaaacaaccttgctttccattgtgccgacaatgaacaacagtagtcaatgtagaatttagagtggctgtaggctgggca

SEQ ID NO: 202027 - DNA, 425 bp, Homo sapiens
ataagctgttgagaagaaaggagaattcagagaaaaagaactgtcagtgaggtcataataggaactgttacagtgaactaaatatggcctgggaaggactctgtacttctagacttgagtccctgtggacaaactgaaacctaacttaataggtagaaagactgaaaacctaacttaggagtatgcacctgtaactatagctgagtcctggccaatcccaacagccaaacttctgccactcacacactgctgagtgttcagctgtgttcaaataaggcaaaagctgagcactgtaaccagtccagttgtttctggaccacattgctgagaacggtaagggacccagttgcttctggacctcactcctcactcagatttctgtacatcacgttccctttattgtctataaatcttccaccatgtag

SEQ ID NO: 202028 - DNA, 122 bp, Homo sapiens
taggactctgggggaggctggggaaatgcagattaccatgatggggctgcccccgggggcagccagacccaggttttccagagatggtctcacagagggagattggcatgcaagaagtttac

SEQ ID NO: 202029 - DNA, 649 bp, Homo sapiens
aacaggcatttcaaatgtgacagggccagacccaaactcctgccctttccctctgcaatcttatttcactgccataaagccactccatcctcttaactgcccaggccaaaatcctcatagtcactcttgacactttatctcccattccatacctagaggaaaccccttcagttctaacttcatctagtgcctctggaaatctgaccgcttctcaacaatcaggtccactaagatcttgtttttctctgctgatcactgcagccaactgtacttccacttctgtcctcctacagtccctaaccacagagcaggcagagcactcctaaggaacaaagtcagactatggcacaggttgcaggaagtcagggaccccaaacagagggaccagctgaagccatggcagaagaacgtagattgtgaagatttcatagacatttattagttccccaaattaatacttttgtgatttcttatgtctgtctttactgcaatctctaaatataaattgtaaagatttcatggacacttatcacctccccaaatcaatacccttgtgctttcctatgcctgtctttactttaatctcttaatcctgtcagttgaggaggatgtatgtcacttcaggaccatgtgataattgccttaactg

SEQ ID NO: 202030 - DNA, 468 bp, Homo sapiens
cctctcatacattgcatttcctccctaagctgcacggggcaacaccgtgttaggtcccgcgcatctgctcctgggccacatccggctccgtctgtattgttcctgaattcagtttgctgtcctagaacaaggcagcaggaggggagaacagcttttcagtgtctttaattaggcaacaggaaaaaacaaagtctggctgaaaattactatttgaagcttggccgatgccaacacagcactcgctccctgcgttctggtaagtgatggccgttgatttcaaggacgtaccaaggggcgaaaagcaagagcaggaagtcacctcgctctggaaaagaagctggttttcatctgctgtatgtgctggtcccaaacatacccttttctctttttttagtattttttttcccaattaggaattcaatgtggaaaacataccctttttcttcaacaggcttttaatgttgggaa

SEQ ID NO: 202031 - DNA, 601 bp, Homo sapiens
caaaaggttgggagtgatcatggcccaccctgcaacctcttcttacatgggccaccctttcttaccacgtgactaaaatctgttagcatttatcttggaatcatgtggctccctgtgcacagtatcttggcagtgcactctttgaggatataatgaataacccctgttatatggtgagtttttgataattgtgttgttctgaactggtgaaggtaaatggcaccagttcctgatgatgctaaatacaggatgtgtgaaaaggccctttgactaagaattccaagtatcagctagataccagaattaaaataatagaggaggccgggtgcaatggctcatgtctgtaatcccagcactttgggaggctgaggtgggctgatcacctgaggtcaggagttcaagaccagcctagccaacatggtgaaaccccgtctctactaaaaatacaaaaattagccaggcatggttgcgggttcctgtaattcctgctactcaagaggctgaggcaggagaattgcttgaaccctggaggctgaggttgcagtaagctgagatcgcaccactgcactccagcctgggcaacagagtgagacaccgtctt

SEQ ID NO: 202032 - DNA, 106 bp, Homo sapiens
tgctgggattacaggcgtgagccaccacgcctggcctagtcttaaaggataggatagattcatcctcagagcagcattcagtctggagaacatctgacaagcaagt

SEQ ID NO: 202033 - DNA, 104 bp, Homo sapiens
agagcagggctgccaaggtggtacaaaattctagaaaaacagagccctcaaaacatgcatacgtatttccctcaaatgcttggcagacatctaaataccattta

SEQ ID NO: 202034 - DNA, 528 bp, Homo sapiens
tcagcagctgctactggcgtctcgtcctcttggctctgggtctggggcactggaaggtaaactccctgctgagttggaggcagcagcattgagtgggtggctgttttccagccaggatttacccagggctttatggcttgcaaagccttcctcacagggctttgtcaggcatttaatattcacaaaaatgtggccaggatcaaaattattattatggggaaactgaggccagactgtaaagtccacaggtcaggttctttgtggctcactcttgtatccctgggccttttgcactgattggcacatggcagatcctcaagaacattttccaggtggatgaggttcagaggggccatgcagcttggccagagggcacacagccagagaggcagggattctgttctgttctgtccaagtccccacctcttttatggagccaggctgttctgtgtctttgaagagagcctctgcccttcagaaagggtcctcacctttttcctttctgtaaattaagtcgtacgcatggtt

SEQ ID NO: 202035 - DNA, 292 bp, Homo sapiens
tccaagatcctctccttttctcactttataatctctccatcactcgtcttattggctcttgagtcaattattatctgcataaagatttgtgccaaattatattctccagtccagacctcttcactgagctataaattctgtttctgtctcctcttgaatgtttcagaagcacttgaaattcagcatatctaaaagggaactcatcatcttcaattctggtctgtttcagtgtttcctctctcagtgaatagtatccagttgtataagttacaaatcttaaagtcattcttca

SEQ ID NO: 202036 - DNA, 388 bp, Homo sapiens
tttggagaatgagtcttctaagttagcactcaggaaacacttctgactttttccttatctataatatgagagcctaaaaccaagatggacattccaaggtgatcagataataatcaaactgcttgctaaaatgagaatcaacatttttctgaggaagatagtagaatccaggactctacaatatattatctacaatgtccagtattcagttaaaaaatcactaggctttcaaagaaacaggaaaacataattgataatcaaagcaaaaagtactcaaaacaaactgagatggcccaagtattagacttggcagcaaaagactttaaatgagttattaaaactattgtcaaaggctggggcacggcggctcacgtctgtaatcccagca

SEQ ID NO: 202037 - DNA, 422 bp, Homo sapiens
acagaacagatataatatacaatgttggataacatgactcttaagcaaaggatatcatacaggtggaattatacaactccataaaaagtaataggtcataccaacaccagccacaagccaaacaggaattatgtacacatatctctaatgtggaaattaatgacacattcatacactgaataaatctaaaaaagaatcaagttctgccagaggcaaaggttgagagatgtgaaaagacagtgatataaaggcaaaattgttattccctagtaggaaccagaatacagatcatatctagcattcatgcacgtgcacaatacaaacacagaagaacaatacaaaaagcatctttatgcttttctatgaattgaaaagctccttaaaacaaatcccataattatttaggctagaatatttcacaa

SEQ ID NO: 202038 - DNA, 718 bp, Homo sapiens
agcgtgtgcagaacacttgcctcgtaggccagccgtaaggaaggatgtcccaggtgcaggcgaggttttgttcatgtgttcctggaggatttttccggtggcaagtgcttctccatcctccagcatctcaggcctgtgcaccagccttcctgtgcccgttgatggactgagaggaagatgagcccttaggatgcctgccatgctcagtgttaagggttttcaaaagaaatgcaggcagcatggtgcactacagactccagcctccctttgaagccaggttccagagcttcctccctttggcctggaacctcaacagcaggattgggatgaggatggaagtgtacagatatgcatatagtattgcttatccccagctgaaatcaatgttggcatgacatgttgcaaaaccaaactgacattgaacatgacttttttcagccctttaaatagctgttcatgtagaacttagttttttatggaagaccttgataatcctgtctttagttactttagaagttaacttcctgggtggacttgaattgagtcttattcatctttaaatttccagggtttagcaaagtacctgcttcagagtaggtgttaataaagctaatgcccttcaaatcaacaagaggatttcctgtgaggggtggtcctgttttctgacactcagatggctctgagtgtggcatctcagaaaaaagaaagaaagaaaaaa

SEQ ID NO: 202039 - DNA, 738 bp, Homo sapiens
agcgtgtgcagaacacttgcctcgtaggccagccgtaaggaaggatgtcccaggtgcaggcgaggttttgttcatgtgttcctggaggatttttccggtggcaagtgcttctccatcctccagcatctcaggcctgtgcaccagccttcctgtgcccgttgatggactgagaggaagatgagcccttaggatgcctgccatgctcagtgttaagggttttcaaaagaaatgcaggcagcatggtgcactacagactccagcctccctttgaagccaggttccagagcttcctccctttggcctggaacctcaacagcaggattgggatgaggatggaaggatgaaaaacgtgttttttttatccccccacataaaatttaaagttgggggattaatttgtttaaaaaacccaaagttgacatttaaaacatgatcttttttcaccctctttaaaaaaaggtttttaaacgaaaaacttaggttttttagtgaaaacccctaaaaaccccctgttctagaggtccctaaaaaaaggaacctctcgggggggggacttgaattgagtcttattcatctttaaatttccagggtttagcaaagtacctgcttcagagtaggtgttaataaagctaatgcccttcaaatcaacaagaggatttcctgtgaggggtggtcctgttttctgacactcagatggctctgagtgtggcatctcagaaaaaagaaagaaagaaaaaa

SEQ ID NO: 202040 - DNA, 477 bp, Homo sapiens
aaggcttgttttcaagtatttgtaccatttcctgcaatcttgttgaacattaacttattccacctgggaaaatgcagttgtttatcaaggagacccttcagccccacacgagacattcagagaaacttggttgctgtctttgctgtcaggaaagaggaagactacctagacatgttgctccagagcagaatttccagcagtagattgaaccttcggaggccgagtcccagcccagtgtaaactggtaaagagtgagccctcttcctacaatctggttattgctgctgtgtaaaaagtcctcttgatttttatgtatttatttcttatctgctgccttactaaatgttttaatgttgctaatcattttgatttctgcagatatatatcattattactaatattgtaactcattttattttctaatctgactgaatttttggatacatgttaaataataacaattttaaaataaagacc

SEQ ID NO: 202041 - DNA, 276 bp, Homo sapiens
caattcttttctgacactttctctttgtgtgtgtctgtgtgtatttgatattgcctgccattatttgattgattcattcattcattcaacagaggcttattgaaagtcttttgaggttgggcccagtgactcatggctataatcccagcactttgggaggcccgggcagtaggatcacttgaggcggggagctcaagactggcctgggtaacatagcaaaaccccatctctattgttttttaacaaaataatttttaaaaagtctcttgcatagag

SEQ ID NO: 202042 - DNA, 362 bp, Homo sapiens
taatcccagctcctcaggaggctgaggcaggaggatcacctgagcccaggaagtcaaggctgcagtgagttgtgattgtaccactgcacactagcctgggtaacagtgggagaccctgtttccaaaaaaacccaaaatccttatttgagataaatactgaaatatataatagaagaactgggttctcctacagtaaagctagaatttgcttcaaaataatcaggggagtgagaaaggaaatgggaaagggtatagataaaacaattttggccataagttgataactggagctggggatggatacagggggttcattatactcttctacttctgtatcttttgtatctatttcaaattttcca

SEQ ID NO: 202043 - DNA, 574 bp, Homo sapiens
aaaaaaaaaaaaaaacttggcaggaataagaatttccagccaagcacggtagcttatgcctgtaatgccagcacttgggaggctgaggtgggaggaacactagagtccaggagttagagaacagcctgggcaacatagtgagatcccatctctaaaaaaaaatttaaaaaattagcaaagcatggtggcgcatgcctgtagtcccagctacctgggaagctgaggtaggagaatcgcttaagtctgggaggtcatgtctgggtgaaagaatgagaccttgtctcaaagaatttctcagcactgtcgatggcaggattgcttttttagttattgtacaacacatttgtgatatccatacagacattcagttggcacattaaatattgttaacctttgaacagcataattatatatataatactgaaaatgcttttcagaaacatggtttttttttttcgagacaggctggagtacagtggtgcgtgatcatatagtttactgcagactctcaattcctggctcaagccttaggctcccaagtagctgggactacaggtgcacacgaccacacctg

SEQ ID NO: 202044 - DNA, 394 bp, Homo sapiens
atgtggctttttccttgagcagatcaacgatctacttccttctgaggcatgatattgagttagattttattccttaatgtcacaccaacacaaggggcaggtgagccaggcacaaactgaactgggagaagatgaacattttcctctcaataaatcacatgggggtaactgagagtggatgtcatttataaagttcaacactgtctcccatcttttggtatgctttaggttgaatgcttcagatgatgttttttggagttaaaagaaacattttatgtttaatgaacgaatgtatgttgctggttatggattttcaatttctagtatttatgtagccagttttcataatgtaatgttttagtgtcttatggaagtaaagtcttgaagacccatc

SEQ ID NO: 202045 - DNA, 658 bp, Homo sapiens
ctgaacatagtaggtgcctgcacatagtaggtgatttgtaactgagtagagaaccaaacccaacttggattctgaagaccagtctacatgagctctcatcctggggctgctgttcttgcagctactgtccttttgcatttctcttgctttcgttgctgcctgctcatacccatcctgatcttcccttcagcacttcctttttgaggcctgttttagtcaggagggactagatgcattgcagtaacaacttagcctcaaacttcagtagcttaccttagctacagtgtatggacgcatccaggaggctctgctccacatagtcactcaggcccccaggtttcaccatggccggggagaagacagctgcagccccacactcaggcctctgctcacacctcatgggccagatctggccacagggctccccctaactccacctccctgtagggtctgggaggggtagtgggggccatagatacttggcaagcaggtaatgcttcttctgtggtaacgggacccccccgcaatgtactgtcagtaaaagttcctgggacagcacagttccaacctgtgggtctttgtggttcacggtcatcagtggtcactggtgtatcagaggaggtcctctccctgacggaaaccttgtttcaagtaaaat

SEQ ID NO: 202046 - DNA, 529 bp, Homo sapiens
gacggagtctcgctctgtcacctaggctggagtgcagtggcgcgatctcagctcactgcaacctctgccacccaggttcaagcaattctcctgcctcagccttccaagtagctgggattacaggcgcccaccaccatgcccagctaatttttgtagttttagtagatacagggtttcaccgtcttggccaagctggtcttgaactcctgctcgtgatccacccatctcagcttcccaaagtgctgggattacaggcgtgagccaccatgcctggcctctagttactctttgtacattctttgggcaactaatcatgcattactctgtgcccatattttataattatttaactcttattattgctttcattatttaacttttctcatattttttgtattgtctgtaactatactgtaagctccatgaggaattgggtcacccaaagtgccagcatactgcttacatgttggacttcagaaaatatttataacaaaaagtttagttgaaaaatatcatgtaattcagtgtt

SEQ ID NO: 202047 - DNA, 393 bp, Homo sapiens
tttttgctcctttccttcaacaggaaaaatgtatgtttcctccaaaaccttgccacctgggaaaaggaacaatttgtatttagaaacaaaaatcaaatcaacaatataatttcttacattgaaatttataacctgagatcctaccagcttcccctactttatattactttaagttcatgcttatttcccaagttaaatttacttcaccaaagcggtcttttgttgttgttgggattcatccagcttaaggaaaaactttgaattactgtgtgcactgactgagaaggaatgcaataaacaggccatgttacttccaaatccttttcattgaagaaatagaaatttctgtaaaccctgggagaataccagaatgaagaatgggaagaaaggttg

SEQ ID NO: 202048 - DNA, 670 bp, Homo sapiens
gggtggactggggagaactgaggaggggaagcgcttttttgttgcttctctgtgttttctattttattttatttattttatttttagattttcagttcttatttcacccagggaaggagacctgggtatccaccccatgtcctccagagaacttccctggccccgctcggagtcttcctgggacgccacaggctcggagagcgctccgcaggtttctcccccggcgcctccaaatctttcgattcctactcgaattactccgtcagctgctggaagaggggcaaggggtatggcgagacgcgttggtacatggggcactggggggaagggaaagcctccctccttctcctagtaattcgagaatgttgcgtccgcctcctttcttttgctggcgctaggggctcggaccagcacctgccaggcataggtgtggccactggggcgaaacctggcaggctctggaaacagcgttttactgacaggaaagagaaactgttctttgtattcatcacccaccgcagacttcctcacgcccgggtcttaggcggggctgtcagatttcagtgtgtttctcttaattctagtactaaatttgtactgggcgctggcgaagggcctggctccgccacgcgcggccctctcgaactgcccgtgggtacggcgcgcgctg

SEQ ID NO: 202049 - DNA, 305 bp, Homo sapiens
cctgttggaatgtggaacagagaatttgattctctgaattttggatttggttgaaatgattacaagtagcttcccttcatagttgcatctgatgctggtggggagctagtaggggctaaacctcgagctggctttagttctcatttgccagaaatgactgaaatgaagaaagatttctgacttgccttttcagaagcaatgagtttctcagccaaatgagtggtttcttctttgataggaagagttaaaattaaggacatgccccaaagagagatgtatcaaggcattgcaacacggtctctcat

SEQ ID NO: 202050 - DNA, 265 bp, Homo sapiens
gctgtacccgtatctctcgaaaagggggggcacgagggacgagcttagctgagctgggaggagcagggtgagggtgggcgacccaggattccccctccccttcccaaataaagatgagggtaccaaaaataaaaaaatttttaaagataattgtttttttctctgtccctaatatctttatatgtatagcatgtctctcctgataaagctgtcctgtgagcatcttaactgtttccactgttttgcgagcgatacgggtgcgatc

SEQ ID NO: 202051 - DNA, 460 bp, Homo sapiens
ttattaggtcttctttattacttagctagttaggtaggtaatcagaaagaaaagttaaatgacttgcctagaatcccttgaccagtcaatattggaaccaacactagagctaagatctgattctagcgtctgttttttccactgtacatgttgcttatctattatcttagactgtattatttacttagcaccttgagaaggcagggtatagggggatgcagtatagggtggcttagtgcagtgtgagaaagaagggcagccctgagggatacagtgctagagatgagaaaattcaggacagttacttttatagacacctacctctatttggaattgtttgtcatgagtcagacatgtgaccttatgtacctaattgatgtatattaggtacataaccaaacttgtttcagattttagctttgccatggactggatatatgtctgtgggcaggttctcttt

SEQ ID NO: 202052 - DNA, 239 bp, Homo sapiens
ttactcttcctgtttacaggggtagcatgtgtggaagaaaatccgtatgtaagtgggcccacgcagttcaaacccttgttatccaaagatcaactgtactattatccttattttacagatgaggaaagtaaggcctagagcattaaaaggcttacttaaaagcaatgagggcagataacattgcaaactttgagtataacacatggtatatttattcttagcacaatcatgtattaatt

SEQ ID NO: 202053 - DNA, 133 bp, Homo sapiens
tggtaggattacaggcgtgagccactgtgcctggccttatttatagatatttgaatatatcatactgtgtcatgtctccatgacaagacatatgtttgtttttgttatttaaagacttgttactcagtatggg

SEQ ID NO: 202054 - DNA, 550 bp, Homo sapiens
ttcagtactggtgctaaatttaccaagatttaccatcttgcttagtgaacactaggtggtgctcttggtaagccaaacttctggctgagccaagccaagtggataaaagaaacttgcgacaactggaacactaattaccagttgattcatagataggaaagaacaagttatgatctcaagttctgtgaggggacacggcaggccaagaatgtgtgcttgttcaaacaaggactgatctacagaacactttagtctccctaaacctgttttcaagcatttcacctttcactctaaacatgtaacatagtagtctcctgcaagaaagaaactggtacccagacagggcaaaacaagatcatgctcaaccggctatctatctactagacaaggcaagacctgtacttttgtactgtttcttatagtactctaaactatgtctttttgcctctacctgagaggtctgaaagagccaacaggcagcttttggattcttggtgttaagtgaatgttagggctgggtattctcatgttccatggttatacacctttg

SEQ ID NO: 202055 - DNA, 492 bp, Homo sapiens
gaccattaggacctgcccttactgtcaagttggctgttgatagtttagttagggagagcaagaagagactagtacccttcagcatactaagcgttctgaggagataaatatgagggttatggtgacacctaacttagccaaaatggtagtggtatcaggagaagatcttggagcaggtgaagtctgtttgcactttgtgatgaatgggagttagacaaagtaaacaagatgaggaaaaagtgtttaagccaggggaacaggagtattttagtgcctgcctatttataacgaggaactcagcaacacttagtgaacatagttctttttaatttatgcattttgaagagagggattttacttttaaacttctgtgagctaattttttaagaactgccagtttcttaaaattaatctaccttatatttaacgtaatgtggaattgtatcaacaggagtgtggcatcatactcttcaagtctttgtcttattgtat

SEQ ID NO: 202056 - DNA, 664 bp, Homo sapiens
cagggtgacaaattcagatgtttctggggccaggtcaccaacggcaatgagtagcggggcctggtggggactgcgctgagcagtgggaagcacgtgccctgcctcaggggctcctcggtgcaagcacagactcagagtttccacagatttatctgcttctcaggcaaggggtcagcccagatttttatgtaaaacctaccagttttgtgtgtgtgtgtgtgttttgttgttgttgttgttgttttggagatggcgtcccactctcgtcatccaggctggagtgcaatggtgcaatcttggctcactgcaacctccacctcccggattcaagtgattctcctgcctcagcctcccaagtagctgggattacaggagctcgccaccatgcctggctaattttttgtattttcagtaaagacggggtttcaccatgttggccaggctggtctccaactcctgacctcaggtgatccacctgcctcggcctcccaaagtgctgggattacaggcatgagccaccacacccagccttcttcttcttcttctttttagagacagagtctcgctttgtcgcctaggctggggtgcagtggtgcagtcatggcttactacagcctcaaactcctgggcccaagcaatcctcccacctcagcttccctagtag

SEQ ID NO: 202057 - DNA, 351 bp, Homo sapiens
aatacatcccactacgatcaatcctgcatgaaagcctagggttttaatccacttaatttactggtcaacggatccctaccaacagctcatctgcagcctaatacggcctacgtggaattgttagtcatttttatttagtattttaaaaactgtgataaaaacacatacataatatttactatcttaaccattcctaagtgtgtatttcagtagtgttaagtatccattagtcatatgtaaaaacgcagttcgccagctcacaataatgagcagatgagaactgcctcatcaccccctggctgctgcaggtggagactactaatccctttcgctgttaggccagtcgctgag

SEQ ID NO: 202058 - DNA, 426 bp, Homo sapiens
taagcaaggctggtaataattatgtactgtcataacataatttcaccacctcagggtgtcatagttaacaattgatactcatttgtgcccacagatgcaaggatagttgaccagttctctgcctcttaaataatacatattttttgagtcataagacttgggtttcaagtggatcctataaagttgatctctttgtatgctacgtttagggaagtgagtgtttgtttttaaaaatctatttagttcatccatagactaaattgtttaagcaaaacaatatatcactatatattatatattaggtttgctattgagctctaaaaagcattcagaaagaatttttgagtgaagtaatatttggaagctgtcaaagttagtacattactgaaccgaaggattagcctagccaaatatgagctgctttgc

SEQ ID NO: 202059 - DNA, 453 bp, Homo sapiens
taaatcctaccagaggtagctactttttaacattttgatatatagccttctagactttttctcttcatgcatataacgtgaatatatgctgtctgtgcggctgctaaaacaaaataccttagactgggtaacttataagcaacagaaatttattgccctcaggggcttgaaagtccaaaatcaaggcttcagcagatttgctgtctcgtgagggctcattgctcatagatggtgcctgctatgtatccccacatggcagaagggacaaacagtctctgtcaggcatcttttataattgataagggctccaccctcataacctaatcaccttccaggttccccaccacctaatcccactgcactggggattaagtttcaacatatgaattttggggggacacattcagaccatatcatagacatagatattggtgtgtatatatgaataaatgg

SEQ ID NO: 202060 - DNA, 152 bp, Homo sapiens
gtcgaggtcccgatgttgctggctggagtgtatggcgggatctcagctcactgcaggagccatgtctgtgctcccatgatacatattgatctagtattgtgtcttatacagaagtagacttagaaatatttgctgaatgagccaggcatggt

SEQ ID NO: 202061 - DNA, 253 bp, Homo sapiens
tgagagaggagaagctgatgatagagggagccatctcctggggtcacctcaatgtttactaggaggccgcgagagtcacataccgatagtgttgaaaacaatgtctgtcctaaatgccccacagaattgtaatgggtataagtgcttcaaaaagcataaagggctacgtattggtgagattttatgattatgccaaggtagaaggaggggctctcactgaaagccccagtgctgcccaaacttcctaccaaat

SEQ ID NO: 202062 - DNA, 291 bp, Homo sapiens
agaaagaaaggtatgtgatgatggaagcagagagacatttgaagatactatgctgctggcttttaagatgaatgaaggggacgtaagccaaggaatacaagaaattcagctccagaagttgaaaaaaataaggcagtggatacctgctgactctggttaaaaccccatgaaggcattttaatttcttacttctagcattgtaagagaataagtttttcctattttaagccactaagtttgtggtaattgttacagcaacaataggaaataaatacaaatagttataaacgt

SEQ ID NO: 202063 - DNA, 826 bp, Homo sapiens
atcaaatgaaaaatcagatacaaactccccctcttttcactcctcaccaaatgtttccttagggtacagctggctgtgcttccaggggaagggaggccccaggttgggggatataaggagaggccaaagagtccagttccccctcccctggaagttccagccatttctcacctccccctccattctttgggccccagcaccaggaaatgcctttggtcccttggtgccagatacacaagacccacagttaccctcagactcatacactctcacatgcggtcactcacagtcacacgggcacagccacaccgcctcagactcagacacacttacacatattcatacactcacgcagtcacacacgcacacagcccctaccagggctcacagcaccgcctaaaagcaactcttcatcatggtctaagccccctctctcagggagctcttagccggggcagacccgcatctcatcactgttacaggcccccaactagccagagatcaagatcagcagggaaggcaggcataggggcacagagagagacagagaggcaggaaaggcaaaactggaaatgcacccacacagagagaccaggggaacaaagctgtgaagaaacacacagaggtatctctagtaagacagcaatagggacagaaaacggcacgtaagggaaactgagccaagcagggaaacagaaaataaggagcagtagacctgatgctgggattcttgagcagaggaaggaggggaagccacgtgtgttgtgggtgtgtctgtcaatgctggacacttaagagaaaggtcagtcccatgggctcttgaggt

SEQ ID NO: 202064 - DNA, 501 bp, Homo sapiens
ccaagtgactgccaaagtcagtagcaaactaaagactattccatgttgattttctaaataatggcttgaaaacagaggtcttccacatttattgcttcttagtcgtatgtgataaatttgtctcctaattttaattttgaatgatttttcccctttgacatttctaataaatttaaccatgggtagaccatcttttaaggtccctttcaattctcatttgggattttgaattttttaaatatatctccactttttaatataagcatgtatttgaggtgatatgatttatgcttttatttcttactcatccaacagatatttattgagcccatactgtccacctattactggagaactagaagtgaatatagggccatgagctccctgaaggagttcactgtctagtaggggagctgagatgtaaacagatggcaacagtatatgaggggtattttctcatcaccaacttctaaatctggttttgccctatttctacgctgc

SEQ ID NO: 202065 - DNA, 403 bp, Homo sapiens
aaccagtgagtcgaagaagttacttggtaccaggcaaaatgaatgaacacagattatcacatacatgagagtattttccagaggaaaaagggtgtattacaaacatgttttaaaaaaccttcaaatgaagaaaatcaagttggtgtcattcattaattcactcatctgtattgagcaactctgcatggtgaacacattgtgaacaagacagctgcattccctcttctcatgaagtagagagaataaacagtgaacaaataaataaggcaatttcagcttgtgtaaagtgaataaaaccaggccttgtgatagtgtggcatgagagctgggtagtggactactttaggtggggcagaccaggcacacctttctgaaagagtggaatttgtgctgagatctgaat

SEQ ID NO: 202066 - DNA, 347 bp, Homo sapiens
atcaacttgagatgtgtagaaaatagaatgacttgaaaagagatgagatggaactcaaggaatttagaaataaaagattaaaatagattagaattaaaaactatgctagaagcaacacaagagtaaataaatataaaagataatgctctaagaaaacaagctggaaaacaataaaatttttaaaatcagagaaaatgaaagaggtgtgagagaaaatacagatacagaagaaagataaagatgtaatataggccaggtgcgtggctcacacctgtaattccagcactttgggaggccaaggtggaaggatcacatgagtccaggagttcgagaccagcttaggcaac

SEQ ID NO: 202067 - DNA, 219 bp, Homo sapiens
gggtccaatttgttttagaaatactgtaatcaggccgggcacgtggctcggcctggtaatagaattctataaggaaaggtgctacaactatccagagagacctgggacctgtcctgcaggttaggtatctagttagatgctagtttctgagacaaggttcaaattcaacttttgtgtttcaccaaaatggtaacatattatttagttactttcttcact

SEQ ID NO: 202068 - DNA, 266 bp, Homo sapiens
gtaactgaatttggacaggcttttgatattttaagcccatttccatggatttttgttgtgttttgaagatagggtctcgctctgtcacccaggatggtttcttaatatatttactataattattcccttggaatactaatattaatactaagttaaattctttgaaaatccagccagtgtcagttatgctaaatgaaaacaaaacactttgtacaattttatatttaaaaagagaagctctacactctaggattagaagcagtgga

SEQ ID NO: 202069 - DNA, 325 bp, Homo sapiens
aatgttatgatttcaccattctcagaaaaattacagtcccctgcctccctgggtgtagtgtcgtgaagtagaaaagccttacataaatagtaaacatagaaattcttctggtgccctctggcagccagcaggagtgggtcttgtgactaatccacatggaaaggatagtgcctgtctttcctgttcccttgccataagaaccgtgaaatctctcctttccctgccactcgtttactcatcacctcctcccatcacttccttgtctctagactagagggacccacagttttaagagctacatcatatcatttgttgttttagaaga

SEQ ID NO: 202070 - DNA, 207 bp, Homo sapiens
gtaaaagaaagccttcaaattagatataactttttaagtctccggacgcaccgtttgtgcatagaaaggttgctgaggagatgttctcagccaggataggagctgattatatagatgaagcactagggactgagaagagccagggatggatccaggaagggtcatgcaggaggtggggaggggaccccgcttgctaccagcccaccg

SEQ ID NO: 202071 - DNA, 591 bp, Homo sapiens
catgggaaggatacgtttcctttgtgttacaccaacaatacatgtggttttgatgaggaataagcattccctccaggaagacaggtcagatgccaagactacttaaaagtgttcgcaatgtaatgaaaagtgggacggtaaagatactaaactctgggaggaaagatcctattatataatggtgcataggaaaaaaatgaaagtacgccaaaatgccaataagattatcattggttgatggatttatgggcagttttaattatcctctgtatacttttccttatattccaaatttttacaatgagctatggttactcagaaaacaaatgttatgaaaaaatacttagctctctcttttacccactcaatttcactaccctcttcctgcaacctggtaaaatagtcagtaaacccactgtatataactagaggtattttatacttctgcatggtgtagattctggctaaaatcgttttaaaagaataccaaatacatcgtagacacaaaaaaagaaagagagaagggcacagtagcattctatccatgtgattctgttgggcttatttcctttaaaagcatatgacttgaaa

SEQ ID NO: 202072 - DNA, 505 bp, Homo sapiens
tgaggtgtaaaacttcaaggttccaaacggtgttgtaattcgaagtaaaggcatcagtgtaggctatgtcgggatatcaaataagtgtttacatgacagatggttttcaattgtttgctttcaaccaagttgctggatcattgaaaataattttcgatgataggatctttatggcacttttagcatatgctttggaaggactttaaacaattatgggctgatcgtggtggcacggtggccccagcctgtaatcccagcactttgggaggccgaggcgagcagatcatctgaggtcaggacttagagaccagcctgatcaacatggcgacaccccgtctctactgataatacaaaacttagtcaggcgtggtggtgcgtgcctttaatcccagctacttgggaggctgagacaggagaattgcttgaacacaggaggtggaggttgcagtgagccaaaatcatgccattgcactccagcctaggcagcaagagtgaaactccatcc

SEQ ID NO: 202073 - DNA, 325 bp, Homo sapiens
gaggccccagcttgtttgcagcccccattgcctcttgaatggtggatatcctggctgccttgctcttttcccttccggctctttcttgttccttctttaacagaatatatcccttaaaccagtgcttcccaaacttcagtgtgcaaaagaatcagcccaggatcctgctaaactgccagcttctgaatccacaggtccaggatggggtctgggagtcttcattttaaacacacaccaggtgatggccactgctgcagctgctgagaagcaaggaccaaaacaggcagtttccaaatagtaaagtcacttctgttttgcaaactca

SEQ ID NO: 202074 - DNA, 252 bp, Homo sapiens
tgaattgttttggtacctttgtcaaaaatcaattaaccacaaataaactttacaacaaacaacccatccagttaaaaacaagagcggaggacttgagtagacatttctccaaagaagatatacaagtggccaacaagcatgaaaagatgcacaacgtcagtaatcataagagaaatgcaaatcaaaaccacaatgagacatcatcccacacccattgggaagccactataaaaacaacaacaacaacaaaaa

SEQ ID NO: 202075 - DNA, 379 bp, Homo sapiens
tgatctcccatttttctcattggtaaaatttagataatacctactgtgtggggttgcagtgaaatttttaagagtgatggagagaatcatcattcaatggatacccataatgtggcggattttgtcctaagtgctttcacatacttaattatatatggggtgcagcatagtataatcgctaagagcatggatactaaagccggatagtctggattcaaatctcagcaaattccatttgctaactatgtgacctttggtgaactcactaacttcctgaaatctcagtaccccaatctgtaaaatggagataatagtagaatctaccttattggattgttatggagaataaatgagttaatatttataaagtgaacataaa

SEQ ID NO: 202076 - DNA, 348 bp, Homo sapiens
atttcagttaaacattcaagagtcacaggcacagagtctacctctggtgattccttatttaagaagggaagagacggacctgccactttgtgctcatgcctagacctaccggtttctcacaagcagatcgatttaatgattactcgggcctggcctaaagaatctgctcagttttggtacaaacagcagaggcagctcccatgaaacaatattgctggtgttattagtcagtgtatgtattttttttgttttgttttttgagacaggctggagtgcagtggtacgatcataactcacttcagccttgatctccagggctcaggtgatcctcccacctcagcctcctga

SEQ ID NO: 202077 - DNA, 549 bp, Homo sapiens
ggtcattgccatggtgacaattaggctgggaaggcgcctcattaaggtgcggttttaacaaggccagtcgtttttaacctgacatccacgtgaaagagggatttttcaagttgcttccctttcttcctttgttgtatttcagatccatttctagacacttcctgttgaacaagacagaggagaattcctgggttgagtccccctgaaaaatcaacagggcaacaggtttcttctctgtggtactactctggcatctgaaaggaggcctggttggcagaggcttggagagggaggggagggttgaggtcatgaggtcagaggaggaggtgaggaaaggactcatgttgaattttattcaacatggaactggagaccttttctggtcggtggcagggacagtgtggatggcagtggggtcgggggtagtgtcaggcctgtttctcccaagttgaagggaggaggaagtcaggaggctcaagccctgtcttaattcagagcactttgaaaagtatctatttttttcttatttccataataatacacttattg

SEQ ID NO: 202078 - DNA, 282 bp, Homo sapiens
agtcattaagagttgattcattctttttttctttgcacgaaccgaaacgaccgttatgaaaatatttaaggaagacgaaggaacaaacggaatacacctgcagttttcatcattccctcccctcactcctcaagtaacctctgttgaactatttgagctagggttttagggaaaagaaaagtaaatgaaggtaagggaaagaaagaatgggaagaaaacataggaacagagaggatgaaagacaggtagataagaaagagcagatggaggaggtgagatgta

SEQ ID NO: 202079 - DNA, 471 bp, Homo sapiens
taaagccgcactccatgaacaggctgctgctgggaatttcagttggtgtagccatctaatgggcgtctgaggaaatgagttggactttgaaatgcatagatgtatgtatgtatttatatactttggcccagcaagtcattctgtgggactttatcacacgaaaaggcatgtaaagataatgtattcaccacctgggcacagtggctcatgcctgtaatcccagcactttgggaggccgaggcgggcggatcacgaggtcaggagatagagaccatcctggctaacacggtgaaaccccatctctgctaaaaatacaaaacattagctgggcaaggtggcagacgcctgcagttctagctactcgggagggtgaggcaggagaatggcatgaatctgtgaggcggagcttgcagtgagctgagatggcgccactgcactccagcctgggcaacagagcaagactctgtctca

SEQ ID NO: 202080 - DNA, 406 bp, Homo sapiens
tccttctccctgtgcatccttgattcacagattaagatgacagtagctgctacattaagtcacgtcactcaaaactactaagcattttctacatgaagaaaggctgtttttttaaaggtgtttaaacatgtttgtttttttaaaacttgagttgttgaataaaaagtaaacttcataaattcacattttaaaataattagaactacctcatagatgcacggtaccttctaggttgctaaagccctcttcgtgtctctgaggctgaaatacacacgaaccactgctttaagtgccctgtgagacaggccctgcttaccacagaagcacaagctcacacagcttcctggaaggcaaacttcaagtaccagaatcaagttctttcaagtgctgatgctggtgctcggtt

SEQ ID NO: 202081 - DNA, 318 bp, Homo sapiens
tttgcctcctctccccattccagcaataatcagtcaaaatagttaaaaagtttcggaattccagacgcatgttccaagggtaggctaggttcatccacatacaaggtactttgctctggtgctacccactggcttctaaactcttcagtttttctgtgaaagggcttgattagcatgtggctgggaggaaaacactgcctttctgagtcatccacttatgtcttttctagatttcatttatatgaaattctagaaaagacataatgggatgatagtgggttatgggttttcagggggtcaggagaggacaattaattg

SEQ ID NO: 202082 - DNA, 350 bp, Homo sapiens
aaaccaacaacagttaaaaaagacaaaaaaaaggcactacataatgataaagggctcaattcaataagaagacttattgattctaaatatatatgtacccaatacagaagcacccaggttcataaaacaagtacttcttattttattacctacaaagagacttagataagcacacaaccacaaaaaaatagttggggacttcaacaccacactgacagcattagatcatcgagggagaaaactaacaaagaaattctggacttacattcaacactggacaaattgggcttaaaagacatctacagaacactccacccatcaaccacagaatatacattcttctcatctgc

SEQ ID NO: 202083 - DNA, 688 bp, Homo sapiens
agatacagtgtttactctttgtctgctgtgaaaaagtctgttcccatctctaggtattttgtggttgatgttttatcactgtacttgttttcctttcactccactgcatgtaaattcttgcctcacagtgtaatattggcagagtaacttgaagttcaattcagtaaatatttattacccttgaagttcaattcaataaatatttattgaatcgagccattcaatatgctaactacagagatacagagctgagtaaagcataccttccccttaaggagatcatagtctctcagaggagacagacaaatgaacaaataaaccaatagtgcaaccacagaagtatgggtgaggtacacagtaagacaaagggaaacaccggtgtttccctttgtcttggcccttacaggcagtgctcccctctgcatggcacatctttcctgccccctttctttaccctggccaagttccactccacaccaggtgtcagctgcagaccttcataagcctcaccatcacctcgagctcctcatagtcccagcatttttctatgcattctcatttgtcaaatccctgtctctcctgctactgcgggctctctgagctcagtattcccatctatcttatcaagtgctacagggcttatggtgcagcagggatgccagagggataaaaatgcagccttcatctg

SEQ ID NO: 202084 - DNA, 575 bp, Homo sapiens
caattcatcactgtaatattgaagcctacatgcagctctgcagtgctgaaaagagcctttaaagctcatcacatctacaattttacaccaagcacaaaaggggaggtgacttacccaaaggcacacagaaacttaatgacagggtgagggcagagtgaggacagaactggtcttcttaaggcctgggccagcaatctaccaccccaaaccaaccatatccctgcagccactatgtttgtattcattgtgataaactatatctaagtattaggcaagcacaaatgtaaacataaatgatcaaatatagcagaatcttcttaaccagacttctcagagctgtatgttctagctgacttaatcttctggttaccagagattgatattgaaaaacgaacctcacaattatcatcaggaaaaagaaaacaagggaaacaacaaacaacaaatactagtcctgtccttagacacatgcagagagctgttttctttttggtaaatctgtgctataaagtagtggtggtatagtacaaatagtccagccctatcaataactgactagttgtgtgatattattc

SEQ ID NO: 202085 - DNA, 204 bp, Homo sapiens
tcaagacataaaaaaaaaccatgtctatcacctcagaaaattcccttgagcccttttctggtcagtccccaaccccagaaacaaccataatttttattcttttcattataaattacttttttcttttttttagaatgtcatgtaaatatatgtcatacacacttctgtatcttgctgcttttgcttagcgtaatgtgagatcta

SEQ ID NO: 202086 - DNA, 427 bp, Homo sapiens
gtaccattagcatgattaataccattggtggtgttttcatatcatgtcttgttcactgtccattataacaggagaagagactttgctccctaaacctggaagctctccagaaatggggaaaccctgggtcagaggaacctggcttcccatctctactctattatttcctgaccctgagcaactgccccacacctctggggctttagtcctagaggaagactaagggtctggctgttgcctattaggccttaaatttaaaataatgactggccaggaaaggtggctcacgtctgtaattacagtactttgggaggctgaggggaggaatactggagcccagagttcaagaccagcctggaaaacatagggagatcccatcttggaaaaatacgccggggcattgtggcttaggtctgtgatcccagca

SEQ ID NO: 202087 - DNA, 492 bp, Homo sapiens
aatttttggaatatcaaaagaatattacattttctaaattggtcagttgggttaaacacaacaatggagacacacacaaaagaagcaatacctgaggcttatagtcaacagttacccaatatggacactcagaaatcgttgcgttacttatttttaaccacatcctatcttctttaaatagtggtatctgagatttgagaaggcagtgagttgcagttcttcgagagcactgaattcctacagatatattcattttgtttgttttctcacttaccttttttattcttgttcatcaaagccatgacataacaggtccacagatcaggaaaacagctcattacataaagggggaaatcagattcacacactacctcgactttagcccaaacccagatggcagagtctcctccagggtgggaaagtagccataagcatccgtttcagtcactccacatgtgtattcacacgacctgcggggcgccccagaggcca

SEQ ID NO: 202088 - DNA, 2076 bp, Homo sapiens
gagacagagtcttgctctatcggccaggctggagtgcagtggcatgatctcggctcacggcaacctctgcctgttgggttcaagtgattctcttgcctcagcctcccaaagctgtatatccagctaatttttatatttttagtagagacggggtttcaccatgttggccaggctggttttgaactcctgacctcaggtgatccgcctgccttggcctcccaaatgttgggattacaggtgtgagccaccgtgcccggcctcaaaataaatcttttcagatactaattattattttgattgagttttttgtttgtttttttaattgctgcataacaactagactaagttttttaaacgtggggattactgggtcagaggcttgtgtgtttttaaagcttttaatgtcattttccatttttttccttcagtggaattgttctcattttcacttcatagagtagtttgttactattcttcactaaacgatggctaattcctttgtaataaatttggtcttccttgacatcttgctgtttacatctattacatttatatttctgtattataaattaccatgtgaaagacttctccaaattcttgaagctcctcttcagtctcacagcctttgctcatttaaatgtggcgttccccatcagccaactcactttcaggaagaacattttcagaggtcctcttggtcgtgtctctagtactgcagaatacattatagagctccctacccagaggagagatgtgtttcgtttgtgtctggaatcaaggtgactttccagtaatagatactacctttggcacttcatttctgtgaagttgctttttccttctagctgccttttttgcttttttttttgtccaagacaggtttaattttattttctgtttctctttttggggaagttcccaggtcatttaccatttattccactgtagctttatcttgcttagacttgttattgagtcaaaccaaaccaattatgataagggggtctttaaataaaggtgggaaagactgtagaatgagtaagggatataaatatagggttatcacttaagcaaatttttaagaaaccacagtgtatttggttttcacatctcttcatatttatagcatggtttcccttttattctgctgagtacttttttataatttaactttctggtttatttttttaaaaacatttattgaaatataatttacacaccaagctgttgacccacttaaattgtacaactcaaatggtttttagcataatcataaccatcaccatgaccactttaaaaacaacaaaaagccccataactattatcttagcagtcaactctgtttgtcttaaccctccccgcttcagtcctaggtaagtgttacccctaacgtgttttccctctagatttgactattctggatatttcatataaatggaatcttatactatgtggtcctttgtgactgacttctgtcacccagcataaagttttcaaggctcatctatgttgtgatataatagtatctgtgattcattttttattgttgaataatattccactgtatggatattctgtattttgttcattagttgataagatatttgagttctgatttacttttggattctcagaaatagttactcagaactttaaaattgttttacacttttatgggttttacagagttactaatttttgctttgggcagctaagtttgatgtttctgtgggatggacagtaagttggctttgaagctgagagatagatctaggctaaggccaatgattgggaatactgagcacatggatggtaactgaggccacaggagtcaataggattgcccagtgtgtgtgtaaagggtaagaaggaaaagggcttaggatagagtctggaagaatcacagtgtttaagtgtgatttgctccccactctctgttatggtttgctccatgaaatggtatctgtaacatttaaatgaatttactctttgttttacatagcagttcacttctagaaattttttcaataggtacaatggggaatcttaaggcttgggttggtgttcaaaacagcc

SEQ ID NO: 202089 - DNA, 540 bp, Homo sapiens
gctaaggccaatgattgggaatactgagcacatggatggtaactgaggccacaggagtcaataggattgcccagtgtgtgtgtaaagggtaagaaggaaaagggcttaggatagagtctggaagaatcacagtgtttaagtgtgatttgctccccactctctgttatggtttgctccatgaaatggtatctgtaacatttaaatgaatttactctttgttttacatagcagttcacttctagaaattttttctacagatagtctcacaattgggcaaatacttaacgttcattgcttgtattttcacagaatcagtctaaaaagggaagaaccctcccagatgttcaggacttttgatacctgttagtcacttgatttttttttttaatgaaaggaatatgtatactcattgcacaaataaatcataaacacaaggaaggataaagaaaataagataggccaggcacggtggcccacgcctgtagtcccagcactttgggaggctgaggcaggtggatcacgaggtcaggacttcgagac

SEQ ID NO: 202090 - DNA, 655 bp, Homo sapiens
ccctgaaggtgcacctgcagtcctcgccgataagaggcagcagttcggaagccggttcctgagagatccggcgcgcgtcttccaccacaatgcctgcaattgttccagacaagatgcagaaggctatcaacaggctgagcaggcttctgaaacctggcgggatgatgcttctgcgagattacggccgctatgacatggctcagcttcggtttaaaaaaggtcagtgtctatctggaaatttctacgtgagaggtgatggaaccagagtttacttcttcacacaagaggaactggacacgcttttcaccactgctggactggaaaaagttcagaacctggtggatcgccgactgcaggtgaaccgaggaaagcaactgacaatgtaccgggtttggattcagtgcaaatactgcaagccccttctgtccagcaccagctgagaggcacctgctgccaacacgatgcaagcccattgtgtttccgggcttttttaaaaaaaaaattgtagcactgggcgtggtgcatgcctgtaatcccagccactcaggaggctgaggcggggaggatccattgagcccagcagtccaacctgggcaaaatagtgagagaccctgtatcttgaaagtaataataaaaataaaaaatataatgagaa

SEQ ID NO: 202091 - DNA, 530 bp, Homo sapiens
cagtccttggccaagaggcagcaattgcccagccaccaaagtgaaagggaagggaagagaggaaaggagaagccactgtccaagggggaagggtgtgacctgcaggggcccctcgagtgattgtctcctattcccaacctgagcacttcccacgacactcttctgaaaattctggcaagaacaattcttagtgcggttgtagctgatgatcagaaaggggaaggggcttccctttgagccaggatcaaagcacaagcttcctgctttcccatccaaggaggcgccccaaagtttggcctgtgtgcagagacgctgtatcccctggggctcccaggagaggagagcagctgtggagtctacctagctgtgagctgcttctgggtggcaggcactgaggagacctggggtgtctcttgggggagcaacagagaagggaatcatttctagggcaggtcactaactgcagaatcagaaggctgaggccagctccctgattagctgtgctgtcttgaggcattcatcttcccgag

SEQ ID NO: 202092 - DNA, 1703 bp, Homo sapiens
gatgctgttaagttctgaaaagagaaacgggagcagtggaggaggcccggagagagatgcgaagcagagggcaggactgagccagaggggctgcagcagcttcagcatgaacagaaaactggtcaggcccagaaaaggtgcccgggggtccctacccccaggcttgttcccaggagtcatggctgggagtgccgcctgaggctgctgtacggaagcccccactccgtgaccctccgggttgagtctgaatcccaggacacctgagaatgtgtctctggcttgctgcccagaaggtctggggctgctggtgtgaggagggctgggagctgggatgggaggagccaggcgagccttttccggatcgaggcagattcaggaggggagggtcctctctgctgagcccctgctgctgtgacagggacagcacactcagactgtgtcactagtccctctgggaccccaggagtgcagacaaagacgtgctttggaacagagacacgggagatacgttttcagaggtctctaataaaaggggtgacttcagtggaaaccgctgcgcaggaggcaggactgggtggtagcaagcatggcctcctgactgcggcgagtaccaggggcacttggttccccagctgccaccgtgagacccccctgggaacccagaagggcctctgcacagcccccggcccgtgtgctgcctcccagtcttgtcaaccctgaccttggagttctagcgggcgtgctcgcctgtgtcctcagctgggggcgcatgagaagagacttctgtgatgtgttaatgaggggtcagtggttcccgccagaggggaaggccagggcctgcacccccatggggaaagaactgacaggcagcagtgaggcctgagcccagcccacccggtccgcaaagattcccgtcccaaacacgagggcacagagactgcgggtgctctgaagcctcctgtgctgaggaggtgagtggtcattgtgggaacggcatggccagccactcacaaacaaggggccacccaatccaggcaggcagggcaggtgagggggacatgtggctaggtcatgaaaaccagttattagggacagggagagaaggcgcagcctgtgcgaagtcaacagttcttctcagtgcgtttttgtcttgtttctgagatggagtcttgctctgttgcccagactggagtgcagtggcacgatcttggctcactgcaacctccgcctcccgagttcaagtgattctcctgcctcagcctcctgagtagctgggattacaggcatgtgccaccatacctggctaatttttgtatttttagtagagatgggatttctcccacgttggccacactggtctcgaactcctgacctcatgatccgcccgcctcagcctgccaaagtgctgggattacaggcgtgagccaccgcgccggcctcaatgcactctttaaagagaagggcagttagcgacagggtctcatgttgttgcctaggctggggtgccctggcacgatcatggctgactgcagccctgtgcgctcaagtgagcctctcacctcagcctcccagggtgctgggactgccaacatgagccactggactcggcagtgtaaactacttttttcatgctattgcatatgtattgttcattgataatatatagaaacataactgggttttgtgtatggattttgtgccct

SEQ ID NO: 202093 - DNA, 236 bp, Homo sapiens
cttgagactgtctcgctctgtcacccaggctagagtgcagtggcgcaatctcagcccactgcctccgcctcccgggttcaggcacctctcacctcagcctcccagggtgctgggactgccaacatgagccactggactcggcagtgtaaactacttttttcatgctattgcatatgtattgttcattgataatatatagaaacataactgggttttgtgtatggattttgtgccct

SEQ ID NO: 202094 - DNA, 603 bp, Homo sapiens
tgagattttatttatttattttttgtcagcttgatgttgggtgtttttttaagaattttcaattcttgcctcctcagaagaaaggatttgactgaggggcataaggcagaagaagaaacccaggcaagtttcagagcaggagtgaaattttattaaaaagcctcagaacagtaaggaaaggaaggaaagtaaagaaaagaaggaaaggtatgtgctttccttggttgataaaccaagtgtgcctggtgatttttaatgttactgaagatgtggcatgttaaaaaggcatctttctgctagcacagtggctcacatctgtaatcccatgattgtttttgttttaaatcttggccaggctggtctcgaactcctgggctccacagatcctcttgcctcagcctcccaaagtgctgggattactggcatgagccaccacaccagcggtgtaatcccagtgttttgggaggccagggtaggaggatcaattgaggccaggagtttaagaccagcctgggcaacagcgcaagacactgtctctacaaaaattagccaggcatggtggcctgtggttcaacctgagtgagaccatgactctaaaaatca

SEQ ID NO: 202095 - DNA, 341 bp, Homo sapiens
agccttggcacatttgccagaggaaccttcaagccaacctacacaattagttgctattgttatggggttgtaagttaagcagcaaaagacaaaacaaactttattgtaacaatttatataaagtatagtcttgaacttgttgtttctcaataatatcaaaagctttatttcaagaaattattgttgatgacatcttggaatattgtagaataatggcccttatgttctatgtagacacaacttaaaacagaattactggccctttttttttgtggaatcagccgcatgccctgtgtacttgctccatattgtctatccaatacaaaaaacacatacctgtc

SEQ ID NO: 202096 - DNA, 471 bp, Homo sapiens
ctactataaagacacatgcacatgtatgtttattgcagcactgttcacaatagcaaagacttaaagccaacccaaatgcctattttctggataaagaaaacgtggcacatacacaccatggagtactatgcagccataaaaaataatgagtttatgtcctttgcagggatatggatgaagctggaaccatccttctcagcaaaataaccaactttcgatcacagcatttctctttgttttattcacttattagatatacttgacttatgtaattaacttaagaggtaatattgttccttatgtaaatgtactagcataagatcaacctggatgtataaatttataaaatcagccactcttatttgtgttagaaagcttatgcatctaacttcaacactatttgttctctctttttggtattttagtcttcaaatgcgattatttttgtggatgattttatgagaaattatg

SEQ ID NO: 202097 - DNA, 352 bp, Homo sapiens
ttaatttcttatcacagagaaatgtttatttggccaaatgacctgagcctaatcagtggggatgccgaacagagccctgtattggaaggaacctagttatcaaggtaggaacagatgcagtggggaaggaggatgtttaatgccactccccgccactcccagcagtacactataatagatgtctgggaggaatctgagaagtcacttttaataatgcagataaggacataattaatgcccttatctgcaccagatctcccccaggaagacaacaggataactgggagggaagggttgtagatttggagtcacagctcttctatggatgcctgtgattaggatgcagctgctg

SEQ ID NO: 202098 - DNA, 412 bp, Homo sapiens
gatttctaattttttttttgccatggtttttgaaatttatttattttcatttttatttttattttttgccattgttgaggacacacacccatgacacagcctccggaggtcctgacgacatgtgtccaaggtggtcagggcgcagtttgaccttatacgttttagggagatatgagatattaatcaacataagtaagataaacattggtttggtctggaaaggtgggacaactcaaagctaggagggcacttccaggtcataggtagataagagacaaatggttgccttcttttgagtttctgatctcctcttcaaaggaggcaagcaaataggcatttatctcagtgagcagggtggtgactttgagtagagtgggaggcaaatttgcccctaagcagttctcagcttcac

SEQ ID NO: 202099 - DNA, 674 bp, Homo sapiens
atagaattctcatttggaatatatccaatgttcatttggtttctttcagttgcagcaaatcttactatgatttgaggtttttaaatactatgtttttcaggaagtcttttcggtggcattttctgataatgccagcctgataatccaaaaaaaagtctgttaaaaagcagatttgcctgtaatcattaccttttttctgagtttgtaatcagaccttgtcttgaatctgtaaatcctgtggagtctcaggtgattttcctgactttccctgcatgcatggaggcaggtagcagatggatgggcctttatgccccgtcatgtgtgggtgccctggcagaaccctgctgctgccctccgtcttccccacagcaagcctgtggccattacaacttgtgcttctctgtgcatgtacagcacagcatctgtagcaaaaggagtctgcaagtattttggagagtaagacctgcatggcttgtttccttctgccagagaacctagaacaggcaaagacatacatgtgtttttcctttggaggcatcaagctccttcctggacattgaactttataacaatctgtgggtgaatccgccctattcctggacttgcagagagggtctccctggccaccttccacattcacgtggtccaagtggcatgagaaaggatggaagcct

SEQ ID NO: 202100 - DNA, 412 bp, Homo sapiens
acacacacacacacacacacacacacacacacacacacacacacttgtaaaataaaaagacataaaaccttaagttccattgacttcatgttggctaatcactttagccactgcagctttaattaaaacaagattaaaagtaagagatgtatcagcccttttattttgttacaaaaaagttagggtttctttaccatctggcttaggaacactatcactgcgtatttagttaagccactttggaagatccttaatactgcatttgtatatttcaatttactctctctgaaaaccggaagcagttccactaacacaaagaagttcggtaaatataagttgcacctaggagcatccaaaattgctgggcctgagacagtggatttaaaatagcgttcactgaaaccctaaaggt

SEQ ID NO: 202101 - DNA, 465 bp, Homo sapiens
tgacccaactgtattaggaggatggggagataggaactatccatgtgtggggatatgtgtgtgtgagggagagtgtgtggacaccaaatcctcatatttcattgcaatatgatagatgcaatgcatttagactgaaactctcatatttacttctgagaagcagaggaagctgagcaaagtaaagaatcacagagacaagccatatttgtaggaagcactttgccctgcagaagagaagacatcattgtgaagagttccacagctgcttatcaaagaagatggagaagagtaaatgcaaaattcagagtcaggtaaatgcctgctaaataggtgggcacatggctctggggtccccctgcaagtatattcatcaaaatagctggtccaggaaaactcttcctcaaagatgagcaaccacacagacaacacaggtgagagtctatagaaaattaacagaagaggaaa

SEQ ID NO: 202102 - DNA, 411 bp, Homo sapiens
agtagagacggggtttcaccatgttggccaggatagtcttgatctcctgacttcgtgatccacctgcctcggcctctcaaagtgctgggattacaggcatgagccaccatgcccagccaaaaaaaatttttttaattaaaaatttaaaaagtggactcaatttattgcgatatttatttcaactcttgtctcctcaatatgaaaagtcttccagtgacatgtctctttagttttaaaatattttagattttttacctttaaaaaaagttaaaattctggttttcattgtgctaatgagatcatttttgttattattttatcctgtattaataattcaggtatttctttgcagcataaaaatcctatcctgtaagttccaagcagttacaaaaaaattactagaatatacat

SEQ ID NO: 202103 - DNA, 267 bp, Homo sapiens
agaccagcagcagcagcagcagcagcagcagcagcagcagcagcagcatcacctgggattttgaaagaaatgcagaatctcagcccttgacctagggaatcagagtctacattttcacaaggtctccaaatgatgcatctgccatggtgaggtttgagaagcctgacctagatagacacagggcggaagagaatgaccaagggtggggaaatgccagctctgggcttcatacaaggccaagcatggtttttgttgacaccttattta

SEQ ID NO: 202104 - DNA, 252 bp, Homo sapiens
ggcatgtacctctggtccagctacttgggaggctgagatgggagaatcgttacaaaaaaacttttttttgtagagatgggatctttgttgcccaagctggtcttgaactcctgggctcaagtgatcctcctgcctcagcctacggaagtgccaggattacaggcaggacccaccacacctggctcaactctcttagtatatagattctgtcttctcctagagaagacctgcactgctctctctggcatattg

SEQ ID NO: 202105 - DNA, 252 bp, Homo sapiens
cctgaagggaggctacaactggaataaaaataagaaagctttcaaggcctggtgcagtgactcacacctgtaatcctagcactttgggagtccaaggtgggggattgcttgagtccaggagtttgagaccagcctgggcaacatggagaaaccccatctctacaaaaaaaaaaaaaaaaatgcaaaaattaaccaggagtggtagcacatgcctgtagtcccagctacctggggagctgaggcaggaggatc

SEQ ID NO: 202106 - DNA, 379 bp, Homo sapiens
tatgtatgtgatggcacacttaaggactctatactccttaagtaccgggaaattcagaaattccagcattatcaaactactgtaagacagatccatgagagcctgcgtaggtatatgaatacacagagatacagaaaataatctaaaaaaggatccagattgactagctgctagaagggtcagagaactctattaagtaggtctctatcaagaaatatccagtgtaaactggtaataaatacatctagctagtgatactataaaaagagaggatgggcacagtggctcacaccggtaatcccaaatacagtgggaggttgaagcaggaggatcacttgaggccaggagtttgagaccagcctgggcaacacagtgagat

SEQ ID NO: 202107 - DNA, 567 bp, Homo sapiens
taaattaaaactctgccctgatttctaactccatggattagttttgcctctctttgaactttacataaacaaaaacgtagtgtatttcctgtgtctggcttcttgcactccaaaatatgtttttgagaattatttatgttaaatgtatcagtagttcatttttattgcatgacagtactggcagtatgtttatgtattcttctgttggtgttcatttaagttctttctttgggggaattagtatgaataattctgtgcacattcctatatgtctttgtgcacatgtacatgcatttctgttgggtatatatctaagaatggaatggccagatcatatactatacatatggacagctttagtagatactgctaaaaagtttttcaaagtggctgtaccagtttacacaccctgcaacggtttttgagttctacattctccccaaaattgatattgtcagtcttcttaacttgacccattccaggagatgtgtggtggtgtatcagtgtaattttggtagttatttccctctctggtatgagtcaacttctttcaaataaaggttttct

SEQ ID NO: 202108 - DNA, 382 bp, Homo sapiens
tatgtctccatcaacatgaaagtgtgtgtacacacatgcctgcacacacgcacatgtgttcacatgcaccgctggggaaaaatggccagctgaaaggtaccactcagggaccaacagagaacagatgaggtctgcttaaaaaagaagcttccttggagttatactcttcttggcaaggtgggtgttaaaaataataatgctgaggttgcaccaaatgtctttaatgttggagggaagatgagaaagaaagaaagaggaagaggagaggaaatgagggaagaagagagggaaaatgcaagataaaacataagaaaacttttcaccttggcaagccaaataaccagctttaatcaggtaaagggctttatactgtgtggagaaa

SEQ ID NO: 202109 - DNA, 125 bp, Homo sapiens
aggagagcctgtaacagagaaggaagcagtgagtaccacggctggaggtttgggtgggttacactgaaaggaggtaggaactaagcctaggaagcgtggatacgattcaggcgtgtggcatttga

SEQ ID NO: 202110 - DNA, 262 bp, Homo sapiens
ggcggtcctcactaaagagacaagctcagaaagaaaaattagatgtgaaaatatgcataaaagacaggattttttgtgctaccaattctggccttactggaccataaagttaattatagctttgaaagataaaaaaaaaaaaaaacaacaactttttcttctcagcccacaatctggcaccattaaatggcccaatataagagggactcggttttataattaggttgggagcctttttcttaaatgtactgcaccacaatct

SEQ ID NO: 202111 - DNA, 673 bp, Homo sapiens
ttcttttttgtccttgtaagagggtggttggaaccatttaattgatcaatgtagaacacatggtataatgagaatttaaatgttaaattgagaaaaacagttacaggaataaatatgggtccggaacaaaaatttaaataagtaaatcttgacaaagtaaaaataattttacaacaatttaaaaaacagtccatagaggacaaaagagagggagaagaaatgtaagcaaggttgaatgtctaatcatgtggacacaaacatactgagtctctcataactgtcttaccttttttctttcactcatagagaaatattacaaaacaaggatttcctcttgttcaatatagttctcttgaagaacagcaatttctttagttctctagttactttttctttttaaatttgagtaacattgatttttttgttattaaacctatttattactaaacaatgccagttttctttctgtctcttcatccattcatcttttcatctctcttttcgccttactacaatgcccaacacttatctccataaatattcatgaagagagacagccaggtgttcacagttaacactgaaagggaaatgcatgcactttctgctttgtcaaactactatgtactgctgattgctaagtaaaataaaatactttaaaaaataaaaacaatgg

SEQ ID NO: 202112 - DNA, 683 bp, Homo sapiens
ttggaaagatggacgagaaggtgttggggataaacagggatggaaagaatccaagaagagacacaagcaatgactccaattaatgacaaagtatattttcatttgttaatctagtgatagaaaattaagctgagtaaaagaggaggctattgcctctcaaatatacaccaatttctccacaagaaaattttgtcctggactgtccagggaaaagaatatttcaaattaagcacatcagtcagtattcagtgtcctctgcccagaacctaaaccaacaaaaacagcatgtaaatggccttattcattacaagccactataaaaagatacagagatagaccacctctcagggcactcctctaaaacaccatttggccaggatccttagtcttttagcattaaatgagagtttattggatttttgatgtgttacttttcatataccaaaatctcctagaaaacacaggacatataaatatatgatcatctacaaaaaaaagtcaataatataattaagctctaaggccttgaaatcatataactggatttcaatcctaataggtacaagccaacttacgaccacatgttaccagcactactttaccccactcatggataatcagctctagaacaccttgagagctatcctgatcaaatgagtgcatgtccagtgacaagaaccaca

SEQ ID NO: 202113 - DNA, 460 bp, Homo sapiens
gcactctcaaatttgatgatgagtagtttatagaaatattttgctttatcgttaggattaagcataattcatgtatatccagttacatgaaaattttaggtcagaattaactgttgcaacacaggtgaatcagtattctatagagatagctaaacttgaaacaaagtaaatagtgacaaaaactaactgtaatttataatttaaaaatgggaatagtaagtaggtctggattgaacaactcagctgcactgatgtacagtgatgttatttttcaaaattgtaggaatttcgcttgtcttcatatgcacattatcggtagtttagtacccttgagtggcaggtagatttctacgaatcacatgttagagaacctaagtgtactaagttctcatatgttctcagggtattgtacttagtttctctttaggaatatcaaatttaatatccctcagtaagtcac

SEQ ID NO: 202114 - DNA, 456 bp, Homo sapiens
tactatactacaagaaaaatcttcaaatcttcaatcttcattcttcatgggtgtgagtcttctctggtggagaagagagttctttgctaaattatattcctgtgttagccagccaagcacacacggagtacagctgtcccttgctattcatggcagattgatcccagacactgccacccccagccctgtgaacaccaaaacccatggatgctcaagtccttgatataaaatggtatggtatttgcacataacctacacacatcttcccatatactttaaatcatcactagattacttataatacctaatgcaatgtaaatgctatgtaagtagttgctacgctgtattgcttagggaataatgacaagaaaaaaaggctgtacaacttcagtacaaatgctatcattcatttttttatctgaatattatgatccatgaatacagagggctggctgt

SEQ ID NO: 202115 - DNA, 493 bp, Homo sapiens
tcagactttcagagagtggctcgctaaatagaatagaggaatttatagctcagatgaaatggcagatatttatagctcagatatggcagttcattccaattggataagaacaagatgttcctgttttgtggtaaggaaaacaggatgttcttgtttttgtggcttatctctggaggcaaagcttttaggatttcccgttagtcaaggcttttaggaggttcccgctattcatggtttatctttgaatgcaaagttattgggaatgaaagtcttttctagtgtatggtaagtgatttgtaggcagggttaggctaagggcaagatattttccttttctcctctctgtttgctgtgcccactttaatatagtttcctctagctcagaatctcctccacttcctaccatagctaccatacaaagtaaacgttatcatagattgttgctgtgggtttgttttactttactccaggctggagtgcagtggcgcaatct

SEQ ID NO: 202116 - DNA, 151 bp, Homo sapiens
aaatttatagagacagaaagtagaataatgttgacaggggctaagggaagcagaatgagaagttaatgtttaatgggtataagatttcagttttacaaaatgacaagagtttttggaaatgggtggtggggatgtttttcaccacattatg

SEQ ID NO: 202117 - DNA, 450 bp, Homo sapiens
ccgatttgtggtctggcaggcctggtgaggaaagagtgggccaaagaggccactaggaggcaggagctgggcctcaggaggctgccataaaacaggagctgggactcggaaggcagacatgaagcaaaagctggcctttggaaggctgatgaaagggagaagccgggcctggtgaggttgacttgagaaagtttggggcctggagagatccatgggaggcgggagccaaacttgtagacgctactggaaggcaggaggtgggcctgtaatcccagttacttgggaggctgaggatgggcatggacttcctatcgaggactttctggtgcgggattctcagggaagaggaggccggaggggctggggtccccaggactgcatgcgccaggcaggcggaggggaggccgagccaggagccgcaggcttctcaccgccagaccaacgccaccc

SEQ ID NO: 202118 - DNA, 610 bp, Homo sapiens
gttagaatataagcaccatagtccagggggagagtaatgaagcccttggctgtggctgtcccgtgaagtggaaaggaagtagtatcttcagaaggtatttggagtcatgaataagagaggacacaattaaaggtgactgtaagttttctagcccaaattgactagaggatctgttaagccaactgaggaacttaaaagaggtagcagaggaaaagaatacttttcattgtgcaaccccagtggagatgtccaatgttggcttggtgtgaggagaaggtcatgactagaggcttagatctggatcccttttacataaaggtattcattgtagctaagggagtggttaaaagcacatagaaaggatcatgttttaaagaacaatggaagaacagccaccagccgataagactgaaatggggtcttcgaatatataagaaaagaataaagaagaatgattcgaagagtattttcagggggcagtaacaattaaaaccatatacttttcttaggggaggtccccagacagcctaggattgaagaaacctgaattatagtatcttctgtaggcattcactccaggcattctttgcaacttttgacaaattactta

SEQ ID NO: 202119 - DNA, 279 bp, Homo sapiens
gttagaatataagcaccatagtccagggggagagtaatgaagcccttggctgtggctgtcccgtgaagtggaaaggaagtagtatcttcagaaggtatttggagtcatgaataagagaggacacaattaaaggtgactgtaagttttctagcccaaattgactagaggatctgttaagccaactgaggaacttaaaagaggtagcagaggatccgcatacttattcacttctcaacctcaatatctatatcccgattgtgcctgctgtgcggtgaagtc

SEQ ID NO: 202120 - DNA, 493 bp, Homo sapiens
agaaaactatcagggttaactcaaagaattgtttccatcaaagagatttttacaagcacttgaagagaaaagccaggcctaccatagttttagtcatgcagtggtggaacttagcaaaagacggacattgtatatctttaatttccttgctgtctccttccagtatactatagacctcggaaaaatcatggcagtggaatataccatacataaaggcatacatgtctttaaacatctagattttcttttgctataggaaattcattattcctttgaccgtcttagctcatcattgacatgcagtgctcatcgggctgagccacctgcatggtaatggggctgtcaagggaactgaaagcagcaatgatgatgggggcttcttgcattctaagatacatatgttgaatcatatgtcagatagcactttggtcctttatgtttgaaggggggggacagagcttgagttttatattccttttctgtgatgtaagtt

SEQ ID NO: 202121 - DNA, 771 bp, Homo sapiens
  misc_feature (758)..(758): n is a, c, g, or t
tttggacagggtctcgctctgtcacccaagctggagtgcagtggtgtgatctcagttcattgcagcctctgcctcccgggttcaagtgattcttgtgcctcagcatcccgagtagctgggactacaggcacgcaccaccacgcctggctgatttttgtatttttagtagggatgggattttgccctgttggccaggctggtctcgaactcctggcctcttgtgatccacctgcctcagcctcccagagtgctgggactacaggtgtgagccgctgcacctggcccccatctctaaaaatattaaaaagaaaaaaattagccaggcttggtggtgtgagtctgtaagtcctagctcctcaagaggctaaggtggaagcattgcttgagcccaggagtttgaggctatagtcagctattattgtgccactgcactccagcctgggcagcagagtgagaccccatctaaaaagaaaaagaaaaaagtctgtgtgatgaaatgggaagtatgcataaagcatatctactgcatgctgaagaaagatagtttactcaaggaaaagtagttgtgggtgtgagccactgcacctggcccccatctctaaaaatattaaaaagaaaaaaattagccaggcttggtggtgtgagtctgtaagtcctagctcctcaagaggctaaggtggaagcattgcttgagcccaggagtttgaggctatagtcagctattattgtgccactgcactccagcctgggcagcagantgagaccccatct

SEQ ID NO: 202122 - DNA, 561 bp, Homo sapiens
tctaaggaccttccctgcactaagtttgcaaattagtcacaacctggtttacgctggtgcagttatctgagtaagccgataatgctttgcatacatttcatttccttccactaaggagctgagagcggtttctcatgataagaaacttggcagtaaaagagtccactagacctcacattccctgaatatctcaaaagttggctttgctttcctaacaagagcaagccatttcttcaatttacacaatctcttcagaatccttctggaaaaatgaccaggttttacccacgatgtcaaaccagcaagaaggcgaaagacaacccgtgctcaagctgcctgatgaacgcgctgggctttgtctggcctaacctgtgaactccttcaagcaccgtcatgaacgccaccctctgcacggcgacagactgtcattcttcccgcaaacaaatttgcttcctgagcaatgatttttggtttaaagaactgttgacagtggttgtttgacagagacagaaggcagagacagaaatgggagcagttttggaaaagcaggaccaaaagaat

SEQ ID NO: 202123 - DNA, 324 bp, Homo sapiens
cgtaaaggagctaatataacatatctaacatatcattaaaatatgtttgtgggcttttaaaaagtgacagctgctcttcagagtgatagacaggtgtccacatttcagctttctttgtttgtcactgtgtgtgtttgttcttaccagtaatgcctgggaagggcggcaaacactgttgtgcttggatacgaaaaccaaggcctgattagcgtaagcgtttgttgaaaaagcattttctctgcacactaatctctacatatcctgtggggaaatcctttcaatcccgtacctgataaataaatctggcaagtgaataaacactct

SEQ ID NO: 202124 - DNA, 487 bp, Homo sapiens
cccatacagagtagctgggactacaggcgcccgccaccatgcctggctaattttgtttttgtatttttagcagagatgggtttcactgtgttagccaagatggtatccatctcctgatctcgtgatccacccgcctcggcctcccaaagtgctgggattacaggcgtgtggctctgcatttattaactgtggattaataactactctgtatgggggatctcgagatccccatacagagtatacagaatggcatcacataaatgagtctaaatatagataggcagcaagaggcacaataaatagcaacatttatagtacttccacaatcaaaataattctatgctatcacaggaaaagacagtcaatgacaccaaccagtgagtccagaagtcaaatagatgagaatttagtatttgatgtgtagaactttaaataagtgagcaggcacaggggtacttgcctgcagtcacagatactcaggaggctg

SEQ ID NO: 202125 - DNA, 625 bp, Homo sapiens
ataaaatctgaactatggtcaggcacagtggctacaccaaagtaatctcaccactttgggaggccaagacagaagtaaggagtattgcttgaggcctggagttcacgatcagcctgggcaacatgacaggaccatatctctacaaaaaaattttaaaatattagtcaggtgtggtagctcatgcctgtagtcccagctgcttgggaggctgaggcaggaggattgcttgagcccaggagttcaaggttacagtgagctatgatcacgccactgcattccatcctgggtaacagagcaaaaccttgtcactaaaaaaacaaaacaaaaaaaccctgaaactgataagtgagcagatggtgggtcaagttctaacaaactggccatatttttgcaaactcactcaaaatacagtcacggtctgtctatggtgtatgaacaaactgtggaatctaaaatgaaaggatctctggcccatagaaaggactctggataaactgaagctgtcaccaaacgtaggcctaaattcaatgcataggaactcagaggcagcatctacaaaagctgagggtgcacaggtttctaagtgggttctaagagggttctaagaggacccagtaatgcactg

SEQ ID NO: 202126 - DNA, 175 bp, Homo sapiens
ctgaattctccacaccactttgccttaatatctttcaacacttttatttattttatctgacaaatgtaaaatgttatatttgataccctttcttcaacatttttttggcctaattagatggtattggccattggtatcgaaccacatctttaataaagaatctgtgtttattgtt

SEQ ID NO: 202127 - DNA, 574 bp, Homo sapiens
acataagcagagactcagcagagagtctaagaaaggggttacaaggcagaatagaattaagggaaaatgatgtctcctgctctgaccatatctaacatatagtgccatcaccactctaaagggacagggaggagggagcaactacaaacaccctggctgtaagacagggttgctgtcaggggtcttcagtagagaagcagcaactgtacctgcagcccagcatggggacactattccatgacttcatcctcctcctccaaccctgaacaggagccagcagtcaagggagcccatcagtgcagcccagaggcagcctgtggagcacagagctaggtagagaggaggtgcagttctagtctgaggggggccaaaggagatgatccagcaaagcagctctccagcctcctctcctaaggcttagctgaaggaacctgaagattcaggtgggcaggacaaactgctcctgcaaccagctatttccgctgcctggtgcttcctcagacatatctattcacagatctacatgttactcatttcccaaactctacaataaaggcccagttctccttgaaat

SEQ ID NO: 202128 - DNA, 225 bp, Homo sapiens
gtaacgctctgtttaacattttgagaaactgccaggctgtttttcaaagcagctgcattattttacatttcctccaacaatgcataaggtcagcctcctttctgcttctattctcctcaggttctgtatttctctgctctgggctggaagcagccctaggctctaggaattccacaagacttttgtttaaataggtgggaaatgatccatttttctctgttcagc

SEQ ID NO: 202129 - DNA, 581 bp, Homo sapiens
tttcagaagtaaagtttgcaaatatttcctcccaaactgtaagttgtctatttactttgttgatgatttcttttgctgtgcagaagctgtgagtttaattaagccccatttatttatttttgtttttactgtatttgcttttggggacttaagtcacacattctttgcctaggtcaatctccggaagaatttttcataggttttcttctagaattttttatggtttcaggtcttacatttatgtctccaatccatcttgagttaattcttgcatttttaatagtgtttgttttgtacatatagatgctgttatttggtgcaaataaatatgtttctcatttatgctacacatgatctacttatcacgtttaatatctgaaatctacttagcctcaaattattattgttgcctctgtttacttttcgtgtcatttgatgattaagcttttcctcattcttattttttccagtttgctgtgtaattttattctaggtgagattttttgtaaggaacatctagttatatttcctaacccaatttgaaggcttttaaagctttaactgtatacattttatgccag

SEQ ID NO: 202130 - DNA, 195 bp, Homo sapiens
acctggcccaaaaaggtttttttttcaatttacttaaaggaggtcaagcattttaaggcataagagccgtttatttaaaacagtaaattcagtacatttattcctttcagatcaaaattaacatattccgtattagtaaaataaataatgctatctgctttttttttttttttttttgagaaggagttttgctcc

SEQ ID NO: 202131 - DNA, 547 bp, Homo sapiens
taatctcttaacacagacacaaacacacatccaacaaaaacctccatcttctgagcaaataaattgcaattgagagtacaactaggataaagactatttcattggcttcctgttcaggattttttttatagagtcttttacttgagcaaaaagtccctttatataccctcatgcactattgctctttcccactacccaacctgacttccatttttagtatcacactaagtttaagcaatatatcttaaatagacagaggtgctatattgcctaatttgtatataaaaacattaagagatattcatatgcactttctggtagaagtttttcggacctctttttctcacttgctatttttgaatatatgtaaccaattttttcttataaaaaatatctctacagaaaatgttgaaacgcaggtaaaaataagaaataatcatttgttatattactctttatataacctttgcatatacataactttttaccaaaataagattttatgtatactctttataaccttttctattcaatatatattacgaca

SEQ ID NO: 202132 - DNA, 579 bp, Homo sapiens
tgatttgttcccaaaaatatttgaccagaaaacagcctactatgtgctgggcacttttcatgccttggcttattccaaggcatacagtcacatgacagcagtgtctgaggaggaggtgaccccaaatgggaactggttggatagaaagaaagttctgatggaggttgaaggccagagatgaacttccccttgagtttgttttgtctggggttcagaaccagtggtaactgagagcctttgtaaatataagaatgagatgatttggctaaggctttttaagaagaattccagggccagatatggtggttcacacctataatccaagcactttggaaggccaagacaggaggatcacttgagcccaggagttcgagaccagcctaagcaacatagcgagaccttgcctctacaaaaaatcaaaaatttagctgggtgttgtggcgcacacctgtagtcccagctacttgggaggctgaggcaggaggattgcttaagtccaggtggtggaggctgcagtgagccatgatcatgctactgcactacagcctgggtgacagagcaagaccctgtctcaaaaaa

SEQ ID NO: 202133 - DNA, 329 bp, Homo sapiens
ttctgccaaggaacactgccaacaactgacacagagagcaggagagaatgcggggtgtctaatgtcccttccacccttacaaataatccccaaataattccattagacccaatgtggagaagacaggaccagcctacaggaagggtgtgtctgtgggcacattctctgagctgttacttctggcctggccatggtgtcttttattggtggattatactttttcctgttggagaagaaacaacagcaaacagggccactgaagaatatttttttttggatatggagtcttgctctgtcacccaggctggagtacagtggtgcgatctcgg

SEQ ID NO: 202134 - DNA, 167 bp, Homo sapiens
tccaaaatgtaatggaaatgaatgccttatgaaatccaaccctgaccttctcatcacacacccttcttaggagagcccacactagctaacgactccagaattctggatccaaaatgtaatggaaatgaatgccttatgaaatccaaccctgaccttctcatcaaaca

SEQ ID NO: 202135 - DNA, 395 bp, Homo sapiens
ttgaaaggttttaattagtatactgttagatgcagcacagatctaaaatgatgtctagtcgtttttcatgtaatttgatcaagacctttttgttttggataaaatgcaatgaagactgtgtggggaaaacagccaaagtattttaaaaatcttatggggcctccattctgactaagtactaaactaaatcagaatttccaactatcattcttcgtgtattaggaagaaaaagatctaaatcatttatcaaacctttaaaatacaaagagaaatggaaaaattaacaattgcttcaccccaggattttaagagactggattccatgtgtagattgtttctaaaagtaaatcctatcccctcaaaagataccataaaataaactattttaaaatacc

SEQ ID NO: 202136 - DNA, 322 bp, Homo sapiens
gtggtctcccttgcaacacattcaaagatctgtaggtcacattgattcttagttaaacctaacccacagctttgcatatgggactgctttaaaacagctgccctctgtgatccattaaaaataaaaaagccatttaacatggcaaattcatagtttcatagattttatcttgatgtcatctgaactttggaattataattcagcagatgttttaatactcttgtacattaaatcagatgtcaatgggatacagaaggaaccaagctgcaataaaacagcaaaggtatatacaataatatatgttgaggaccattctaattgt

SEQ ID NO: 202137 - DNA, 214 bp, Homo sapiens
gtctcaggatttcagaaatactaggtttggggatataaaagtaatctctacattaactacttgctatttatgcctgattatcacatagcacaatcataaaatatgcattttttgaattccaacatcattcattttttcagcaaacatgtactgaatgactgctgtgtgtcaggcactgggaatacaaagacactgagattggtccctcctgttg

SEQ ID NO: 202138 - DNA, 273 bp, Homo sapiens
tactggagtcaacaacttaaaatgaaacagtaaattataagggatgaatgcttacctacagactttcagaattaggtaaagcaaatctttaagcagtacaaagaatcaggtactcacaattatgtaattataaaccttacatacacatcaaatacctttacaatgtgatatatttgcacctatgtccagttctaggtgaggggagaaaatgactggtgtaatcacaagcactagagagatacagaaaaccatgctgtactcaaagagccactt

SEQ ID NO: 202139 - DNA, 319 bp, Homo sapiens
gaaagattgaaacagtgagtacagtatgctatcatctggataaaaaagaaagctggaggagaagtatatatttgtttgtaaacacataggataattgtagaaaaacccaagaaattgcctttttctttttgtagaaacagggtctcgccatgttgcccaggctggagtgcagtggtgctatcctaccttgccgcagcttcaatctcctgggctcaagcaaccctcctaccccagctaatttttgtattttattttattttttagagacggggtctcgctatgttgcccaggctggagtgcagtggctattcacaggcgc

SEQ ID NO: 202140 - DNA, 567 bp, Homo sapiens
catgtgcttcctggaacctcagaatataatctttttggcaataaggtgtttgcagatgtaattaattaactcaaaatgaggtcctactgaagtagagtgggccataaatacaaagtgattgttatctttataagaagacaagagaaacacacacagagaagaagttgtgaagacaaacacgtgaggagaatgctgagtaaaaatggaggcagagattgtattcttctacaagccaaggaatgccaagccttgctggcaactaccagaagctaggagagatcctctccaataatcttcagagagacatgaccctgctgatactttgatttcagacttgtggcctccagaaccacaaaaacaaatttctgttattttaaggcaagtttgtggtacttcattatagcagcccatggaaactaatgcaaacctcatttgtaaaatgattaataccaattcattcaaaagagctaatatgaggattaaatgaaataatatattacacataaagtactttgtcttgtctgtccagaaaaagtgctcaataaatgttaatttttttaaaatttg

SEQ ID NO: 202141 - DNA, 264 bp, Homo sapiens
cttcaggagggatgaaggctgtagggatgagcaaattggacaaagaccaaaatataagaacagtggtcactagagtagctcacacagacttatgatcgtggatccaatattcaaatccctgattttttagggtaagcatttatcctagattttacagatctgttctggtttactcctgctgctttgtttttgtttttgtttttgtttttttgagacggagtctcgctctgtcgcccaggctggaatgcactggcgccatctcac

SEQ ID NO: 202142 - DNA, 566 bp, Homo sapiens
aagcatccagtaattctgaatatgacgtgaacaacgtaaaaatagctcctgtatctctttgcccccacccttctccccaacaacacaaagggcagaagagagtgacacccctaacaaacagccccagcctcctacatctggaccagctgctgtgagccaacagggtattctaaattatactttaattaccataatttttcacaggtacctgaaaccagatcatgacgacggtgcaagaaatccccaaataggatgcacgaggtccaagttaaagctagtcttctaaacacacaccttttctcacatgccttttatttcatgtagcactttacagtctgcagagtgctttcatgggccttctctctcccacaggctctggattaagacaacatggttcaattccagcctccaaagtatcctgccctctccagagacccttcacctatcaccatttggtgcaatctgtaacagaaaaaaaaagaaaaagaaaaagaataggaaatgggggagaagggggtcttatcttatcccatgggttactaggaatgttaaggattaaatggaaa

SEQ ID NO: 202143 - DNA, 455 bp, Homo sapiens
aaatttaaaaaaattatttgttttgatgacaaagcaattatcattgaaacaagatgattttcaaatgaaaatacgaggttaatgcagtccagtcattagcagggaaaaaaagaataaatatttaaggtttttcttgttaggttgctttgcacattggagtagaaaatagttttgggcttggcgcgttggctcaggcctgtaatcccagcactttgggaggctgagggggacggatcacaaagtcaggagctctagaccagcctggccaagatggtgaaacaccgtctctactaaaaatacaaaaattactcaggcatgttggagagctccggtagtcccagctactcaggaggctgaggcaggagaatcgcttgaacccgggaggcgtacattttagtgagccgagatcccaccactgcactccagcctgggtgatggagagagactcagtctcc

SEQ ID NO: 202144 - DNA, 218 bp, Homo sapiens
tacatgaaaatgaaaaggagaaacactgcattcttgctgccaaaagaaatgtaaaaatatgaatgaaaatgattgctgggtgtgccttccatgagattccatttaaacaacattccccatttacttacatctctacaatctgatgggcttacatattgcaaaatgaaataaaagcacattttatgaggaaattaaaatgttatgaactgccctgggtg

SEQ ID NO: 202145 - DNA, 111 bp, Homo sapiens
gaggggtgttaaaatattcaactatgattgtgacattgtctgtttttcaatttagttctatccatttttgtttcatgtactgtggagccattattagatacatacacattt

SEQ ID NO: 202146 - DNA, 218 bp, Homo sapiens
cggtaatgtgcaagtgtctagtttcttgtcagcatcgggatgagctgtttgtagtgaagagcctgggcctggtgagcccccgggatgatgggtggggaccatctgtgctctcctggaaaggaaattgtggtttctttcttttcttttttctttcttcttcttttttttttttttttttttttttagtttatgggaaagggagacttgtgtctcaattg

SEQ ID NO: 202147 - DNA, 282 bp, Homo sapiens
ttattgtatgtagataaaccattaaatttaatgtatgtaatcatttaattcatcttttaaagcaaagaaactgctagtagatgtctttcttcactgatttcactggtagttttcatctctttcttatgttcctcatatatgctttcttattcctacctaatggatttatgattttttgaatctcctaaaattttattaaaaatactatatgttggctgggactacagctgtgagccactgcccagccgaatatatgtaggtcgactgcttggattacaagga

SEQ ID NO: 202148 - DNA, 304 bp, Homo sapiens
aggtcccccaaggaaaaccacagaacctaagctcatcttagctctaatgtctgtaaatattgggacagcaagtatttctttttttattttttgagatagggtttcgctctgtcgcccaagctggagtgcaggggtgcgaccttggctcgctgcaacctccgccttccgggttcaggcgattctcctgccgcagcctcccaagtagctgggactacaggtgtgcaccatcacacccagctaatttttgtgtttttagtagaggtgaggttttgctatgttggccaggctggtctcgagctcctgg

SEQ ID NO: 202149 - DNA, 271 bp, Homo sapiens
accaaacaccttacagaaacgtctgcttactattccatttacagaaactactcaatgcttgtgtaaataaaattattagctgggaggcatccctctgtcatttcatgtaataccagttattttctcaaggcccagcatccccttttaatcattcaatgtattatacaaaccagtgtatataaaaatacgaaacaaaacattaacgagactttggaaataaatctacatagcaatttccaacgactccctccccttgtgtttaagtttgact

SEQ ID NO: 202150 - DNA, 253 bp, Homo sapiens
agggaaggagagtgaagccaagctgcaagcccatcctgctcttagccattattccaggaagcattcaatcagtgtctactgtgcacgtagactgtgctgtttggcagtgaacgcagtttctgtcctgaatgagcttatctgctaaggtggggaagagagaaaataaattagtggacaaaccagcaattgcttaggttcagtatgtgattagagctttgaaggaaagcactagggacagtaagcagacttgggg

SEQ ID NO: 202151 - DNA, 358 bp, Homo sapiens
gattacaaagtgaagtcccacgatgggccatctgcaagctggggaaagagagaagacggaagtggctcaagtccaagtccaaatgcctgaaaactagggaaggccacagtgcctccctcagtctacggctgaaagagatggagttgatgtccaagggcaggaggaacagaagcaaacgtctctcatgggaagaagaaaaaaagccagaagactcagcaagcaaacttatcccaccttcttccatctgctttgttccagctgcactggctgccaattggatggtgcccacccacattgaagacgggtcttcctctccagtccaccactcacatgtcaatctcctctggcaacacaacac

SEQ ID NO: 202152 - DNA, 973 bp, Homo sapiens
ccgcctatccccttatctccaaccacacccaacccaaccctctctgcttggcaggccagcatcctccttgtcctaggaccaggggagctccattcagctccttcgcagctactctcctctatacagagaaccccatactctttgtcctttcctctttatctctccagatgttatcctttgaagctcagctagtctatggccagaccaccctgatcactcccgatctcatctgaagctcacctcaactccttccttctccaggtcacctttgtcaccttttttaatctgcatcgggaatggcaaacaggtttcgttttatgtaaaccaagtccatgccattgacaatggttgcatagagaattctattttatttatttattccagagtcttactctgtcacccaggctggagcgcactgccgcgatcatggctcactgtagcttctacctccagggctcaaacagtcctcctgcctcaatttctgagtagctgggactacacgcatgcacccccatgcccagctaattttgtttgctttttgtagagacaggtctcactatgttgcccaagctggtccccaactcctgggctccaaggatcctcccacttcggcctcccaaggtgctggggtggcaggtgtgagccaccgtgcctcgccttgcatggagaattctgaaagcctgcccatgttcaaaggaaaaagagtcctgtgatcatagtggtttttgccataggcaaaagaaggaaaagtgccagaatgaatgtgacatatttttcatccagattataataattatttagacctgtgatgtccagtacggaagtccctagccacacaatgggttatttcaaattccgatttaccacgacgaaaaactagggctggaccgccgctgcttcacgcctgtaatcccagcatcttgggaggcgaagacggtgggatcacggtcaggagtcaagaccgctggcatat

SEQ ID NO: 202153 - DNA, 328 bp, Homo sapiens
attcacagaccaagcaaaaaagcacatcttttccagaaaaaatcacagcagcctcaaaaacaacatacaagaccacaggaaccccagaagagtcagaaaaaactgaagattccagaacaacagttgcctcagacaagctcctgacaaaaactacaaaaaacatacaagagaccatatcagccaatgagctcacacaatctctagcagagcctacagaacatggaggaaggacagccaatgagaacaacacaccatccccagcagagcctacagaaaatagagaaaggacagccaatgagaacaccacactatccccagcagagcctac

SEQ ID NO: 202154 - DNA, 561 bp, Homo sapiens
tcaaaggctaataatattccctgaattggcatggatatggggactgaatagctataaatctgttattctactcagccactatatcctggaaaacagctttattcacattgacctgtaagggagtaaattgataaaatattactgaatagcaatcatactgcaatttggtaatatgtttcccaaatcttaagtatatgttgaagagtatttggctgaggaattatggctctaaaattttattctaaagaaatacttaaagtaattctattaatgtacaagattatatattaaatatatagggatactgattgcagcattgttaataaataaattgggagctgcttaaatgtccaacaacaggagattggtaaagtgcattatattgcagctacacaagttgatcctgtgcagctctgttatatgttcatgaggcccctgaattgatggcaacttgcacattgtggtcacacaaacagacgcagactgatgttttttcaccaaattgctgtaacaaaaattatgcctaagaatatattaagttcagaatgtactgagtagaaa

SEQ ID NO: 202155 - DNA, 440 bp, Homo sapiens
gatgggaggatcgcttgagcccaggagtttgagaccagtctgggcaacatggcaaaaccccgtctttgcaaaaaatacaaaagttagccaggtgtggtggcgcatgcctatagtcctagctattagggaggctgaggtcagaggatcacttgagcccaggagatcgaggctgcagagagcctagatcacaccaccaatctccaacctgggtaacagagcgagaccctgtctcaaaaaaaaaataaaaaaatcaataccactgtcttggtatactaattctaataattctaattctaatactaattctaataatagctataaaagtgctaagcacatttaatgaattctttcatttaatctgtatgttacacatcaggtatgtagtagcattcccactttacagataagaaagtttaggcttagacagttaaaaaaaaaaa

SEQ ID NO: 202156 - DNA, 654 bp, Homo sapiens
aagaaagttctggatgaagggaaatcacaccagatagaaattctgattcccaaaaagaaataaagaaataaagagcatttagaaatcattgggcaaattaaaatttgtttttaaaagtttgcttttatctttatttttttttcctctttttcttttttgagacaggtttttctctgtcatcttggctggagtgcagtggcacaatctcggctcactgcaacctctgaccctgggttcaagtgatcctcccacctcagccacccaagtagctgggaccacgggcatgcaccaacaggcctaggtatttttttttaagttttagtagagacagggtttaaccatgttggctaggctggtcttgaactcctgagctcaagcgatgcacctgtcttggtctcccaaagtcctgggattgcagacatgagccaccacgcctggccatcttacttcttttcttataaacaggtctctctatcccaaagcctgatgtgatttccttactggagcaagggaaagagtcctgcatggtttcaagggacgtaccaggaggatggtgcccaggtgagtaaggactgagcagatggggaaggcactgctgtttagaacccagcccatcagggaggcagcaccatataggtattggttgaggaatct

SEQ ID NO: 202157 - DNA, 305 bp, Homo sapiens
caatttgggcgttgtcagcatatatatggaatttaaatgaaggtggatgaaagcctatagagggtgataaggagttaaatacattttgacaactcatgccacaaataaaatgttctttagtacttgaaaagaaaatatcaggccgagtcatgtgtcagccaaatatggctgtgcccaggcgagttgagcaaaggcttcagtgagcccgggcatggctgaagacgacctggggaggcaccaaccagctgctgggagaagagcataaggctcaagatggaaaatcataaatctaatactatcaagga

SEQ ID NO: 202158 - DNA, 427 bp, Homo sapiens
ccccaaatggaatccaaacgcagtaattacttgatattttgagaaatgggttgggaaagtctggagcatgtggcacaacctagggagggttttgctatgttgataacctcagcaaaggtgactgggaagatgcacacagccagggaaagaaagcctcagggcaattaaaatctgcttaagcagaccactgaaagaaaaaagtgaccattaggccaagatatgaagttttagagatctttcatttaattcacagttttgcctgagacaggcccagattccttccttcctgggatatgagtcttctctttcttttccattttaatgcaatatcacttctgtcatatgtcagtagtaccagggattccattgggggggataactctagagacgaactaacaggcatgtcagcgtgcactgccgtcatctt

SEQ ID NO: 202159 - DNA, 323 bp, Homo sapiens
caggcagatcacttgagcttaggagttcaagagcagtctgggcaacgtggcgaaaccccatctctaccaaaaatccaaaaaattgtctgggtgtggtggcgtgcacctgtagtcccagctgttgggtggctgaggtgggaggatcggttgagcctgggaaatggaagttgcagtgagtagagatcatgccattgcactatagcgtgggtgacagagtgagactccatctctctcttttttttttcttaatttataaaaaaaggtgtttggatagttattttccttatatccagtgtaagaatcattacaaggtctggctgtgt

SEQ ID NO: 202160 - DNA, 589 bp, Homo sapiens
ggcatgtgaaaagagacacggtgcaaagagaaccacatagagcacagaagaggactactctcaatggtgtcacgttctgaagtggccctgcctgggctgggagcagtgaagtgtgcctctcatcagattaccacatgaatcacccagacaacccacagggacctttagcttaggacagcgtacagtaggttttccaactgtcatctcctgtgaataatttaagagtacacttaaatggaaatctttctatgaggtaatttgtacacacgaataatgaaagcttatctcaatatcaaaagtaaatactttgagccagatatttataattaaaaaaacaaaacaaccaaacggtattacccccaggaccacagcaaacacattccccatagtacattaaatccttcttcctttatccacctttccacccaccaaggaatgaaacaagtgattgtactctagaaagaagtcatggaaggcaaaacgcagctaattacctaatcagcgccggccccgttttcaggttgccctcaactaccactgctttaaaacttaaaagaaggaaaagcactgacttctcattaaaccctgg

SEQ ID NO: 202161 - DNA, 297 bp, Homo sapiens
tcttagatttccaccatgacaagggcccacacacttgatttcgaggtggtttttccaggggtgctgacaggtgtacctggaggatggcatggggactggtatggacagcctccatgggtaaaggggggccagagtctcctccatcctgtattcctgccattctcaccaggcttctgagctgaggagaaccttccttggcctggcagagctggccagggctgtggggagggcagggtagggcagttcctcctcccaaaggaaggcactcccttagctcctcttccttctaattctcag

SEQ ID NO: 202162 - DNA, 183 bp, Homo sapiens
gggacccctgtcttagaagattattctgacagcaatgtgcagagtggattataaggggacaagaatgtaaatgaggaaacaagtcaatccccttacaaggatccaagtgagaaatgatgatggcttcaaccaagttagcaatggagatggggaggaatggggcagatccaaatgagacaaaaa

SEQ ID NO: 202163 - DNA, 813 bp, Homo sapiens
ggaaggaggctgacagaggttggaagggattgtcagggagggacatcatgtaagcaagtactaacaacataacgtgacgagggcaccagttgctttccttctgtgggcggtgatggcatgttatactgtaggtactattgttgtaggatttctcacagttcgtttgccttgactaaatggtaactgcacacatactatactataaatggactcctctagtcctttaactccttgagggctgtgatagaccttatttaactttgtaccctctttgccagtggtcttaacatagtgcaggcacggtatgtgtttgaattgggtaaattacttttactgcctagtggtagctggtgtacacaggagagggccaccaactctggggacttgtccaaaatgacaattcacttgcagatctctgatgaaatttactttaaaaggatttctaaccttttttttaatctgtcggttattttttgaaaagaagtggggcttaactagtgctctaaggattttaacaagagattccgatttagaaatctgtccccccttttggtgaaattcttattttttttagagtcagaatcttcactgttgcccagttgtctccccgggacccaagccgtcttcccacctcagcctcccacagtactggaattacaggcgtgagccaccccacccagctggtgaaattattaaaattgtagtgaaaactctgcctccattgtgaaattggaaaaaaattagaaattttagaaaaaagtacgccctttggagctaggtagagttcacatccccacatttccattgagtagt

SEQ ID NO: 202164 - DNA, 473 bp, Homo sapiens
tcacgaatgtgtgttgagcatttccttggaggaagtagagtatagtggtaggacctcagaggtttgagtctagtcctgatgtggccacttctcatgtgaaattcagcaagttgcagtctttccctcagtacatctttcttcatctgtaaattaaaagtggggtttgttccctctatttaacaaacttctgattactcctgggtaatttgtcttattttaaaaatttttactggagcatatcaaatatatagtaaagacacatattctgagtgtagcacttggttaatattttgtaagtgaacatatctatgtgaccaccaccaagatgataatatagaacatttccagcatcccacaaaccattctgtgtcccccggtcattatcctcgcaaaggttactactcatctatcatcagagattggttttgcttgtttctgagatttataaaaataaaatcttataaactgtacta

SEQ ID NO: 202165 - DNA, 429 bp, Homo sapiens
  misc_feature (39)..(39): n is a, c, g, or t
  misc_feature (73)..(73): n is a, c, g, or t
  misc_feature (410)..(410): n is a, c, g, or t
tggtgccactaacaacatcagtaccaaatctgaagttgntgaaacatatgcactgcctgcaacgaagatcagncgtgtagagacacatgcaaagtaaaaaaggtaaaaatcatgtaatcctgaatttaaattggaagtatcaatataatctcatgaggtagtttattatgtgtgtatacacacacacatatacatatatacatattatattagttggctttggctgctataactaaataccatagactgggtggcttaaacaggagaaatttatttcaggagccaggtgtggtggctcacacttgtaatcccagtactttgggaagccaaggcaggatgatcgcttgaagccaggaatttgagaccagcctgggcgacagagcaagactccatctccaaaaaaaaaaaangcaccagccggggaatccc

SEQ ID NO: 202166 - DNA, 496 bp, Homo sapiens
ggttgcggtgagccgagattgtgccactgcactccagcctgggcaacagagcaagactctgcctcaaagcaaaaaaaaaaagaaaagaaaagaaaaaaggaatagcccagtattgtttgtttggggaggggcagggtgtggttccaccaactgtgggcaccagaatggtgctttctttgatactatgctaagaggaagaggtttgagagccaagagttctttatttggatattggtatgtttgacttgttcatcagtgagtatttattgatctctaattattgatctcaaaatactgtattagctactatggaattccgttttcaagttgcttatagtcttgaggagagataagatgtatatatatttaaaaggaagaaaacagtaagtgacatgaaaggcataatgacaaccacagagcagatgctcaaatatttatttgcctactaaatgtttgttctcatctatcgataaagtgcttaagaagttggcctgtt

SEQ ID NO: 202167 - DNA, 750 bp, Homo sapiens
agtatttcattgggattacagggaaaaaaaatctatatataactgaagagggaggagaaatacattccaagcttactttatttaaggaggtaaaagagaaagaatgtatgtggcttagggaaaccagtttagcaaaagcggtcagtcagtaatgagagaggttaggattggcctgcggatattaaatttggatactattctttctataatcttagagagccactgaaaatttttagggaaaaattaatttatgaagaccacagggcctgaagtaaagaatcaggtagcaatgcaaaagacatatgagtagggagattctggaggcagaaaggctgaatgaggcctctgttataattactgaagctcaaggcggcagaaacgggaagaaaggaatggatatttaaaaagcaaaaattttaaagtctacatctagttttgcaactacatagaacatgaggaagaaattagagatatttaggattctacagttacaagcatgggaaaacggtgtactactaatccaaggaagtctgataagtatggctttagacatgttgagtctgaagaggcaaagagaaataaatccaaatggaaactcagctaagaagcaattaagagacaaaccaaaacccaaaggccagtgtaggacagaaagactaaatagctgtctaagagataaagccaagaatggtggaaaaggcaagtcaaagagcagaggctagaagaatgcacctgcacttaagaaacaag

SEQ ID NO: 202168 - DNA, 614 bp, Homo sapiens
cagggtggggaatgttgcagagatgctgttgacttggggtatgctaagttaggtgtaactatagcaaacacgtgtagacttactgtgttccagacagtgttgtaagcacccttcatgggtaggtgtctctgttatctaaaattgggaactgaatagacttgagtagcaagaggtattaatgatttaaccatcacaacaacctcatgaagtaggtactattattatcatcaacttttaattttagagattaggaagctgagccatggaaaaaggaagtggcccaaggccatataaataagctgcagaggggatttgaacccggtcagccaggctccaggcacttagccactgcactgtactgcttcagtagagcatagaggtctgtgctcaggtctaggctagagctggaaccttctagagtcagtaaatattctgtacagcaccacaagactgacagtcatggctcaatcattgtcttcgcctgtaatcaagaaaggcctggttcctcaagggtggtgcttggagatagagtggttcaggttgtgtcagaagtggcctcggattctgcagtcccccgagctagagtgtgctatgtgttcagagtaggcttcaaa

SEQ ID NO: 202169 - DNA, 844 bp, Homo sapiens
ccccagggagttgtgtggctggccttacagcacggggatgagttcaccaaactgaaagctttccagagcccctagttccaggatttccatggaggcctcatcatggagacatgatcagttatgaactcagcctccagcccctctgccctttttggagggtgggggtggggccgaaaggtccaggcttctcatcgtggcttggtctttatgatgaccagccccctcccaaggccatccaggagcccaccaagaggtgcctcattagaacagaagactctcctgtcacctgggaagtccaagggatttaggagctctgtgtcaggcacccctatcgcccctgtcactcaggaaattaccagcgttctgagagctctgtgtcaggagccaggagcaggggccaagtgtgttcttctcattctatcggtgccacagccagggccgcggttgtgcagccgtgtggatcagctcagcccgtcctcacccagccgtgtgaggaggccgaggccacacaggtggatggccttcccttagagttactttccagagcctgggtgcttagccgctatgccccatgtttaatattcttgtgttccaatgtaacaactttaaaattacacaggataacactcttgataacattttaataaatgggtgtttttcttttcaagaaattttgacttgcacttcagatttcctttttaatattttcgttgagcggaaccttgctattccataagaggatgtgtccagtgttgtggaagatttcatgttttaaatcctttgtacagaaatcctgctcccaagtcacagataggctgacgggtcagagggcaagacgtgaccc

SEQ ID NO: 202170 - DNA, 533 bp, Homo sapiens
aaagacattaatttgttcattttctttccaaatcttgaacgatttgttctcttgttccatattgtaaggcaagttaacatttgcctcctatttgtaattgttccataatctcaagttttcattgaatgtttcattgaattcactatatgtttactcttggattttgacattttaattattaggaacatttgatcacatataatcttagtaatgttcaacaataccacactgctcacatttatgcagaatgctgacagaatgacaggcagtgggagccaagattatgtgccgcgtggctgattggtgcaggggaaggcagggtgttcccatgttataatgcagtgtctcttggttactgtgcagttccagacaatacatacctgctgttttagtcagagtttgttggttgcaaagaacagaagcccactcaaattaattaaaaaaaaatcaacagaaaaaccccccaaaccttaaaaatgtagaatctctcagctaatctatatggcactggtagacccatgagggactgtggc

SEQ ID NO: 202171 - DNA, 469 bp, Homo sapiens
agctgctttcacaggctggcattgagtgtctgtggctgcacatgatgcaagctgttgctgggtctaccatcctggggtctgaggacagtggccctcttctcacaactctactaggcaacgccccagtgtggactctgtgtggggctcccatcccacatttcccttccacactgacctagcagagattctccatgagggctctgcccctgcagcaaacttctgcctgagcatccaggcatttccatacatcttttgaaatctaggcagaggttcccaagcctcacttcttgatttctctgcacctgcagacccaacaccatgtgtaagccaccaaggcttggggcttcaccctctgaagcaaaggcctgagctgtacattggccgcttttggccatagctgagatgcagggcaccaagtaccaagactgcacaaagcagcaaggccctgggcccagcatatgcagccatt

SEQ ID NO: 202172 - DNA, 312 bp, Homo sapiens
aggaatccattcaaaagttttggtgttttgttttaagatgcaggtaccattcaaaagatagttaggaaggttgggataatgtacacttccaaatgaaaagacaggttatagtgatccgtggtcaatgcctgatttgtctataattgaactgtgtagcccatttttaaccataaaaaaagcttcctggtttcagccgggtgcggtggctcacgcctgtcatctcagcacttcgggaggctgaggcaggcgaatcatctgaggtcaggagttccagaccagcctggccaacatggcgaaaccctgtctctacta

SEQ ID NO: 202173 - DNA, 383 bp, Homo sapiens
aaaaaatatgagtcaaagaactgagttgggaaggcaatttcctttaaatctacgtttggtagcagccagactttttgcttgaaaaaagtctgcctaagtcttggcatatcttttgatgtgtatgtgttcatatctgtgtgttgcctgttttaattttgttttgttttaaattatggtaaatgatagaaagtttttttctttctttctctttctttttcttttctttctttttttttttttttttttttgagacagaatctcactttattgcccaggtttgagtgcaatggtgagatctcggctcactgcaacctccacctcctgtgttcaagcgattctcctgcctcagcctctcgagtagctgggatcacaggcacgcacca

SEQ ID NO: 202174 - DNA, 318 bp, Homo sapiens
tgtgaactcttctttctattatttgaagcaaaattttaaaaccatattaattaacccaacagttttgagcacatttttgaggggccaaatgcagtgcccgtttcagtgatataaaaatacataaggctttttcctcaagataatcataatctagtggcttaattattcatcctcacattttcttgtgatttaaaaaaaaatattagcatggatacaggtggtagagattttattctcctgtccattctcagcacagcttagatctacacatatacaacttagagcagtgcgacctggcacactccaacagtggtgggg

SEQ ID NO: 202175 - DNA, 230 bp, Homo sapiens
tgctgggattacaggcataagccactgctctcggccttgctggaactttttaaaggaattttggattcgactttttaaaagcttagaaggccagaagccaagccaaggatttgctgctcgactgtgcttgtaacacctgtatgaattcctgtcttctcgagatcccaaaataccatgaggttcctgagcctgttaaaaagtgacattctttacttgccacagatcaggaa

SEQ ID NO: 202176 - DNA, 358 bp, Homo sapiens
ttaatttttagtagagatgaggtctcactatgttgcctaggctggtcttaaattcctggcctcaagtgattcatccactttggcctcccaaaatgctagggttatagacgtgagccagagtttctgtggaattgcaatagaaatcattaacaaaaagataactagaaaaattcccccaaacatttggaaattaagcaacatctaaattacacataggtcaaaggagaaataagggaaattagaaaaacattttggaatgaatgaaagtgtaaacacagtctgttacatttgtggaatgcagctaaagcagtatatagagaggaatttgtacctgcaaaagtttttattagaaaagaga

SEQ ID NO: 202177 - DNA, 262 bp, Homo sapiens
cttgtcccaagtcaagatgatcacctggcttcctcatttcctttcccacacctgagggggcaccaagctctgtcactcaggttggcaaacacaagagtcatcttggatacccccgttggcccagggtgtgaggccttagctcatgagttggtttctctcctataatctgaatccatgctctgttgtcatttgttcgtaacattccagatggctccacactagtcccagccatcctgacagcttgcctatattacgggaatcg

SEQ ID NO: 202178 - DNA, 478 bp, Homo sapiens
aataactggcaaagatgagccatattacagcgcattgcattatctagttcaatgcctctttgtagtcttgttttcttcaacccacaaactcccgcctttcatgttcccccacctctactcaactcccctatccatgttttcttctcactccagttttggttgttcctatcatcgctccttactttgaggacagtgggggaggctgtcttcaaaagtaaggtaaaaaccacttttaatcaaaattaccattaaaagtcccttaaatttcacagaaggtataactctgcacggtaatcacagtatctacaaaaccatttatatgacattcaggatgatgctacttaaagatagtagagcttagagtggagcaactgacaattcagaaagaagacatcggctagctgaatcccttgcctttcttttttccttggaccaaaaaactcaagaaagataatctgcatgacaaaattattaaata

SEQ ID NO: 202179 - DNA, 717 bp, Homo sapiens
gcctggcaactgcctttattattaaaatcacagatcaccactaaatagcttgaagaaaacctgtcctcattagatgttgctagagttgattcaattaaggtacgacttgaatttaaaataatttacatacaagttaaaatttaataacaaaattttaatattagtagaataaggcatatttcatgaagaaaagaagcactttaaatctcacctcctaatacaaccattgataagactacaatattttccttctgtttatttttcctaagaacactttttttttttggagacagagtttcactttgttgcccaggctggagtgcaatggcacaatgtcagctcactgcaacctccgcctcccggattcaagcaattctcctgcctcagcctccagagtagctgagattataggcgtgtgccaccacacccaactaattttgtatttttagtagaaaatggggtttctccatgttgctcaggctggtctcaaactcctgaccagatgatctgcccacctcggcctcccaaagtgctgggattacaggcataagccaccatgccgggcctgtattttaatagctgtaggatggaaaaaaaataaggcaaaacacactaacaggcagagtaaaggaactacccaataattaatgggacaatcaccaagaaattgtaacaaatatacacttgcatacactcaacaacatggcctcaaaatac

SEQ ID NO: 202180 - DNA, 388 bp, Homo sapiens
aagagcagggatacattagtaaatggcgcttggacataaactaaacaacctcacagaatacatgcttcctcccaaaatgatacataatcccctagaagcaaaggaaacccttcggtcaacatgtgtgaatgattctgtatgccaggcacaggggatatatagtgggtggtgtttacttccattgtgccctgcacacagcagaaagttagtgactggaagactggaagctagaaccaggtctgtatccccgctcccatcaggttctcctggcccttcctgcctttgatggtgccaccactctacttcctctgttctgaacatttgttcatttttcaatagagagttgaagaggatgcaggatggcagagaaagggtgggcatggagaag

SEQ ID NO: 202181 - DNA, 1001 bp, Homo sapiens
tttttttgagacagagtctcgctctgtcacccaggctggagtgcaatggcgtggtctcggctcactgcaagctccacctccagggttcaaaggattctcctgtctcagcctctccagtagctgggactgcaggcgcccgccaccactctgggctaatttttgtatttttagtagagatggggtttctccatattggccatgctggtctcgaactcctgacctcgtgatctgcccgccttggcctcccaaagtgttgggattacaggtgtgagccaccgcgcctggccgaggggtgagtttttaaacgtaatttcttcttctctacttttcaggaaagagtttaacaattcacggttgcacagtagcgctagcggctttgcggtttggtcctcagacccggcagccgccactggtgatgagctgctaggaagcccctgtcggcaagctcgttggagcttgaatccactgtcacccctctgactcactggcaaaaaaaaaaaaaaagttgaagcagattgtccagcaaagttcttcattggtgggcttaatacggaaacaaataagaaagctcttgaagcagtatttggctaatatggacgaatagtggaagcactcttgatgaaagagcatgaaaccaacaaatcaagaggatttgcttttgtcacctttgaaagcccagcagatgctaaggatgcagccagagacatgaatggaaagtcattagatggaaaagccatcaaggtggaacaagccaccaaaccatcatttgaaagtggtagacgtggactgcctccacctccaagaagtagaggccctccaaaaggtcttagaggtggaagaggaagaagtggaggaaccaggagacctccctcatggagaagacacatggatgacagtggatactccatgaattttaacatgagttcttccaggggaccactcccagtaaaaagaagaccaccaccaagaagtgggggtcctcctcctaagagttctgcacc

SEQ ID NO: 202182 - DNA, 456 bp, Homo sapiens
agcaacacgtcttaaagcacactttcaagcaaccgtcctttttgaccaccaccactgaagttaccagatcatttacctttataccacccctccagcattttatctccatttctttctttctttcttttttttttttttttggagacatggtcttgctctgtcgcccaggctgaaatgcagtggcgtgatcatggttcactgcaacctcgacctcggggctcaaatgatcctcccaactcagtctcccaagtagctaggaccacaggcatgtgacataatgccctgctaatttttattttaagtagagatggggttttgctatgttgcccaggctggtcctgaattcctgggctcaagcaattcacccacctcagcctcccaaagtactgggattacaggcttgagccattgtgcccagcctaccaccattttaaagattctcctgtgaaaaaaaaa

SEQ ID NO: 202183 - DNA, 517 bp, Homo sapiens
acaaaaaattaaagtaaaagaaaaacaaaaccttctctttcctttctgcctcttcaacctctatccatccaccactgaaaaactctagtctaactgcctgcatgaagccctcacagaccacttcagcctaaactaatcccagtaaactgtaacctgtcatttcaacatacactattagcataacaacagacctcctagggcagtcattttagtcaatggtattttcacccaagaatagtaaatttttcataaggctaaattattcaacatgaaaaacccctttaatctgagatgatgccctttctcttacctgtttttgttttgtttcgttttgttttgtctttaagacagagtcgcagccagtcatggcactttgggagttcgagaccagcctgagtgacatagtgagacctcgactttactagaaatcaaaaatattacccacaaacggtggtgcacacctgtagtcatgttggtcaggctggtcttgaactccagacgttaagtgatcttccta

SEQ ID NO: 202184 - DNA, 744 bp, Homo sapiens
gaacagaaaaagaagaaatcttcctaaattcatttatgcagctagaatatgaccttgataacaaaaccaggaaagaaaatgtcgggtcagttttactcatggatctattaactaatccaataatactgaaaatatataaaaccaccacgctggattcttcccagaaatgtaaggatggttttaaattagagcatctattgttatcatttaccatctaaagtatggaaggagaaaaaccaaatatataatatcaataggtgcagagaaaatattccgtactaatcacaattcttaaggaagtaagaggagaaggagaagcagggggagaggataggagaggaggagaggaaaaaaggaaggaaattacagacccacatctaacataaacacagacgcaaaattgctgacaaaatattagcaaataaagcaatatataaaaaggacaattcaaatcaaccaagtgggactttgagtgagaaaaagtatttgacaaaattctcaacctagaaatacaaatttccccaatccaatgaaaagcatctacaaaacaccctgagttaatattttacttacttaatggtaaaatactaaatactttgccactaaaatcagaaacaaagccaggatgtctactctcatcactggtattcaacatgatactggaaatcctaattagtgcagtaaggcaagaaaagactggaaaagaagtaagactgtttctattaatgggcttcatgatattta

SEQ ID NO: 202185 - DNA, 290 bp, Homo sapiens
gatggctttttgaaggagagggcactgacatagggtttgacagaggaagatgcagaggatgattccccagaataaatgaagagtgggtgggaaacactgggtgtgactgaaacactgagggcggagtagtgtggccggcaagacaatttgaggtcacactgccaggtgacagcctaaaggcccaggatgtggccttacttcagttagccatggggagccatagcgagcagaactgactgattccaaaggcggcagcagctctactgtgcttggccagttcaggactgtgg

SEQ ID NO: 202186 - DNA, 352 bp, Homo sapiens
gcatgctgcacctaaattcgtcacagtaacatgattttcatgctggaaatgaacctgtgcatgtctcccaatttcctgactatggaggagtaaaatatatgttgctgcttatcagttttttaaatgaattacctttccataaccacttattttacttgaaagtgacacaaagtctataacatagtagatacggttacaatatgcctgttacattttatagtgacagctgtataacttttaaaaagtgaaatgtaaatgtgtcccttcaggtcaacttcttatagaaatgtttatggtataattttattcaaagagaaatatgagacagattttttggagtggacacacaatt

SEQ ID NO: 202187 - DNA, 464 bp, Homo sapiens
gtgtggaggaacagttattggacttggtcttgaataaggagtagcactatagttgcaaacttatgggccttgggctgaattcagcctgcagatatgtttaattcagccagcatatggttttacatttgttgaaatccattaccactatctaagaatgtggagactttgcttagaaatctggaattctaggctgggcatggtggctcacacctgtaatcccagcactttgggaggctgaggcgggcggatcacgaggtcaggagtttgagaccagcctggtccgcatggtgaaaccacagctctaccaaaaatacaaaaattagctgggcttggtggcacgcacctgtaattccagctactcaggaggctgaagtaggagaatcacttgaccccaggaggcagaggttgcagtgagccgagattgtgccactgcactctagcctgggcaacagagcaagactgtg

SEQ ID NO: 202188 - DNA, 568 bp, Homo sapiens
ttatgtgtcccacacattgtcagccacatagtaggcagtcagtatcaactactcaaaatgacaaatgacaaatgaccagaattttgtggcagactagtttagccatgaaaaatcatttaacacccgtgggcctcagttttcttgtgcctattcaataaagcgccgagtagatggtatctacagtcatttttcatctgtaaaccccaatgaatccccaaaattcagcctgagatgagctggactagttgccaaatctatagatatatttagcatggtgtgagatagggtttttagagagaaacagacacccactgtgaactcctttgcagaaaacgtctgaatagaggggaaagtagggatggtatctcaaacttacttcgtagtgattttaaattaggaaatttagcttcacattcttgtgataaatttcttttcaccttggtttctagaagattattcaaaacatctgtgagactatttgagaagtatacttttgaggaatttcccccaagttatccttacagattatattttgacaccaactgcaaatgtaatatcttttgctcaa

SEQ ID NO: 202189 - DNA, 394 bp, Homo sapiens
gaccaccactagcacctaggtatcgaggacccctagactgacctaccaacctgttctaacaccacgacactgaagaagactcccctcctgaggaaccctcaactgcagatccccttctgtgccccagttcagcaggaagtagctagaatgatcattgcccaacttctcaacagcacttgggctttcctgttgagagggggtactgaggcactaagtggctaagttagctagacttcctgggtcaacagggacttccctaaggggacattcctctaagccaaaatgagtcatagctgcaagctaagggattgaaacttcaaccaatcaaaggggactttctcctaagcaaaaatgagtcactgctgcaaactaagtgattgaaacttcacccaat

SEQ ID NO: 202190 - DNA, 413 bp, Homo sapiens
ctggtgattggaggagaaagcaagccatctattggtgaggcctcgaaaggtttttctgggggagaagagtagaaggagttgtaactatccctttgcttccttttttctacagcagaaacatgccagcgtctttttttaatggaagatcatctatgaaaatcagaaaatggaagaggaccttctacaatgctactcaaagccaggaaatatttttagcatagttaataacagatcgagggataagacagttgagaaattcattctcaaaagtataaaaggcgtgactgtgagaccggtatttccttccttcattcatttaaacaatatttactgagtgcctacagattactaaacactgctctaggaggtagggaaacatctatgaataaaacagttagaaatccctgtcaaaa

SEQ ID NO: 202191 - DNA, 413 bp, Homo sapiens
agtctcaatcctgaaaatggttgtttgttctgtgaagagtgtatgtgtgcacagttagctcaccatttggacaatcaacagaagaatctggcatgtgtggttcaccctgtggtgcttcctgaactctctttaagctcctacaaagtgtactccaggttgaatgacccggacttggagaattgttcttctgggaggtgtggcggatcccactgtgagaaagaacctgcaggaaggggccaaggcttcctgaaaggtacgtgaaaattgtctgtaattaagtggttgttggccgggcatggtggttcatgcctgtcatcccagcactttcagaagctgaggcgagtggatcacttgagcccaggagtttgagaccagcctgggcaacatggcgaaagcccatctcaaaaaaaaaa

SEQ ID NO: 202192 - DNA, 239 bp, Homo sapiens
atcgcagttcagagaggtagcttgctgactttgtccagagctcacttctactagactaaattctaaattatcagtgctaaagtgagaactcgaagggacctcagaaatctcctaatggagtgtttccctaaccaacctgataaactttctggggtatacattaaaaacacattcccaggacccactgcagacctactaaataagttataggagagaagtttagtattttaacaagagcc

SEQ ID NO: 202193 - DNA, 314 bp, Homo sapiens
acatctttttaaaaaagactcatctaatgcagaaaattataaagacatctttttaaaaaaagactcatctaatactggctgaaggaattacaaggcaactaaaggatacttttcagattggtcttaatggtttgctaatttcaagaatattatcagccagccgtggtggctcacatctgtaatcccaacactttgggagcgtgaagtgggaggatcacttgaactcaggaggtgaaggttgcagtaagctgagattgtgccactgcacccaagcctgggttaacagagcaagactccatcacaaaaaaaaaaaa

SEQ ID NO: 202194 - DNA, 411 bp, Homo sapiens
ctaaatgtggggaaaacgctatgtaacttgatctaattaaaaaagaacttttaagtattcacttaagattattctaaaaattaccctaaaatatgtaagctcagttaataatgggttagccaaaaaggatttctgtagaagaggttaaccaatcatattcaagacatcttactgttttacaaatccgaatgcgtgtaattccaagagaactcaatagagctagtttttgtattcctgggactaaaaaattatctaaaactccttgactctgggatgtcaagtttcttctggcctcttagggctgccaagatccctgttttccgtataaattgaagcccaaaactccttggtaaaccattctggaagggactgatacaggcttggaataatgtatattagcatggctgccac

SEQ ID NO: 202195 - DNA, 253 bp, Homo sapiens
atttgagtatcatttctagatatgtatggtagtatgaacaaaaggaaagggaagaacatgaatttggggcaggaaaagattattttgggttttcttagtaaatggaggactgtaaataagctgggataagattacagaagacctggaaagcagatgaggaagtttggcctgtatttttgtcaggaagattttgtttttggcagtttttgagtattatgattgaggatcaaggtggattaggaaaagttgttga

SEQ ID NO: 202196 - DNA, 288 bp, Homo sapiens
acgtattgtaaattatgtatcagattaaaataataggatgtttttgccagaaaggaccttaaagaaaatttagtttggccccttcattttacagatgacaatgaatccgaaaagtgacctgatttgctccaggacactcaacataggaaaggacaaacagtgggtagaatgagagatcttttagctgccagtttggggatttttttttttccacagcagaattttctttttttctgagacatacagaattacggtggactgtaaacttctttttatttatttattatt

SEQ ID NO: 202197 - DNA, 433 bp, Homo sapiens
gctgcggtgggcggatcactcaaggtcaggagttcaagaccagcctggccagcgtggcgaaaccccgtctctgctaaacgtataaaaattagctgggcgtggtggcgcgtgcctgtaatcccagctacttgggaggctggggcgcgagaatcgctggaacacggaggcagaggtggcaatgagctgagattgcaccactgcattctagcctgggcgacagagtgtgactctgtctcaaaacaaacaaaatacctgagataatatccactcacttattgagttgttttgataatgaagtgagaaatgcagatcattgtttaatattgtgcattttttagagacagggtcttaccccatcaccagattggagtccttccatttctttgctccaccagattctccatacatttctcagtgtaggtttcccagatca

SEQ ID NO: 202198 - DNA, 445 bp, Homo sapiens
cggtgtttcctttgtctgcagagatgcctttctggtatgggagcagaggtaagccaacccctgaacaataatgagcattcgtttcataaagagacaggttaacgctgggcgtggtggcgcgtgcctgtaatcccagctacttgggaggctggggcgcgagaatcgctggaacacggaggcagaggtggcaatgagctgagattgcaccactgcattctagcctgggcgacagagtgtgactctgtctcaaaacaaacaaaatacctgagataatatccactcacttattgagttgttttgataatgaagtgagaaatgcagatcattgtttaatattgtgcattttttagagacagggtcttaccccatcaccagattggagtccttccatttctttgctccaccagattctccatacatttctcagtgtaggtttcccagatca

SEQ ID NO: 202199 - DNA, 107 bp, Homo sapiens
ttcacctcagcggccgcgggcggaggggcgcacgcgcgcgcagtcccctcggagggcggtggggcgaacagcaacgcgcgtaccctagctcttggctgctgtgctga

SEQ ID NO: 202200 - DNA, 796 bp, Homo sapiens
tttgtatttttagtagagacggtttcaccatgttggccaggctggtcttgaactcgtgacctcaagtcatctgcccttcttggcctcccaaagtgctggaattacaggcatgagccactgcgcccggctgttagcaagcatttttgagttactgctctgtctctggtaccatgctcaactttctgggtacaggggtgaacaagaccctgttctgacatgatttccaacctccaaaggaccaagcgcttgaaatgataagcactgagaacctctcttaagggttaagggcaccacaaactgagataatgtaacaatgtagcaagtcattggtttaatgactttcacttttaagtcattatgacacacacctaggaggactgtgggaaccctgttcatggaggctgagggctcagagaagtaaagggacccttctagacacagcaatggagctgccattcagacccaggccttagtaccatggtcaagccccatgtgccaatggacttggtccttcctgggatccctggccaattacctgcctttggctcatgggtcagggtggatatctctgtcagcctgagccattcttctggttccaattgatgtgctacatgttggggacataaacggaactaaaatactgtcctgctgatctgattttcactgatcaggagtgaaagcagatgtgtaagtaaccgggggtgagataaaggctgtagagcaccaggccctgtgatggaccgaggaggagcttaaccccagagggatcaggaaaagcttcctggagccttcattt

SEQ ID NO: 202201 - DNA, 1187 bp, Homo sapiens
  misc_feature (14)..(14): n is a, c, g, or t
  misc_feature (29)..(29): n is a, c, g, or t
  misc_feature (82)..(82): n is a, c, g, or t
agcgggcaggcggngaccggtcagctgancctggtggcggaaaggctgcggccccgcgccagagggccggtggctcctccgnggcttctgaggacccgcagggagcgggcctcatcatttctgtctcctgtttctccacttccttctctattggttggtccactgatgtatggacttgcacatgatgaactgtgaacttctagccacatgtagtgcccttgggtacttggagggagacacttaccataaggaaccagattgcttagagagcgtgaaggatctgatccgctatttgaggcatgaggatgagacacgagatgtgcggcagcagctgggggcagcccagatcctacagagcgaccttctgcccatcctcacccagcaccaccaggacaagcctctctttgatgctgttatcagactgatggtgaacttgacacaaccagccttgctctgttatggcaatctgcctaaggagcccagctttcggcaccattttttgcaggtgctaacttatttgcaggcctacaaagaggcctttgccagtgagaaggcttttggagtcctcagtgaaaccttgtatgagctgctgcagctgggctgggaggaacggcaggaggaagacaacttgctgattgaacggatcctactgctggtcagaaatattctccatgtcccagctgaccttgatcaggagaagaagattgatgatgacgccagtgcccatgaccagctcctctgggcgattcacctcagcggcctggatgacctgctcctctttctggccagctcgtctgctgaggagcaatggagcctacatgtgctagagattgtctcccttatgtttcgtgaccagaaccccgagcagctggcgggagtagggcagggacgcttagctcaggagcggagtgcagattttgcagaactggaggtattgcgccagcgagagatggcagaaaagaagactcgagccctccagcgaggcaacaggcattctcgatttgggggctcctatattgtccaggggttgaaatccattggggagagggacctcatctttcacaaggctttaaactacgaaactaccgttccgattggaaagcagcgaaaaaggtgctaaagttgcaggcgccgaagctgccatcaggcgttgcctcatggagtctctaaaaattgtctatcggaac

SEQ ID NO: 202202 - DNA, 754 bp, Homo sapiens
acctgcgttctgaaaccagcgtctctggttacaaccaaagaggttgctcagtcacactcctgaaaggcaaaaggaggttggccagtaaaaaagatgtaaaccctagatgtagttcttagtgtggaagccacaggagaacttccaatgtggccacggggatcgccgaggcttttatgcaggtaactgagctgggtgaccagctgcctggttaacagttgggcagaagtgacctattgttgtgctctgtgctgtctacttacagctaccgcatagcaacatggtagagactgtgacgttttgctcggcatcaggtgaaggcattcgggagtaagtttcacaacagaagacaggctcagaagcagatcatccgagtcgggggagagaggcggcgactagtcaggctcccccgaatcccaggctgtgattattatctgcagcctgtgtcacccaggatgaaaggggatggaaaagccgtgcatacccttggtgacaaagccactcctgctcttaaaggctggagcaggacatctgacacaatcccaggtctccatggaggcaggggcatggccggcagctgtagaccacagcctccgggctctggcgtggaggaagaaaaggaaaccagcacagaattttttttttttttgagacggagtctggctctgtccccaggccgaggttgcaccattgtactccagcctgggcagcaagagcaaaactccatctcaaaataaataaatgaataataaataaa

SEQ ID NO: 202203 - DNA, 1714 bp, Homo sapiens
acctgcgttctgaaaccagcgtctctggttacaaccaaagaggttgctcagtcacactcctgaaaggcaaaaggaggttggccagtaaaaaagatgtaaaccctagatgtagttcttagtgtggaagccacaggagaacttccaatgtggccacggggatcgccgaggcttttatgcaggggagttcagcctacacccaggaatgcacaaggacagcttggagcttagaagcaagtggagttggttcatctctttcactggctcataattttgcaacggcggtttcatctctaccctgacaataccttttagttttcttacccactggggtcgagacttaattgaagacctcagacggacagcataacacggaacctgagaccttgatttgcggggacaggcttaaagtgtattctggagttggtgcccccaccccaggggccggctcagagggttcactttccagcctaacggcaggggaaccagaggctgccgacctggatctcaccttgatggaggtcttgtcaccttcctccttggctggagagacagactgtggatgctctcctgctggccacccaaaaacaacaaacagacaaacaaatatgaatgaggaaaacttgaagaggccccacgtgccagaggtgggacagcttgagatttggtgaggataattgcagtggctcaaaacccataaagaagtttaagtccatgagttcaccgtaatctgaaacaaaaacaaaaacaaaaacaaattgatcatctttggaggctaacaatcaattcattatctagagacagacagaggctcactagtggcacgatcttggctgattgcatcttccacctcctgggttcaagagattcttgtgccttagcttcctgagtagctaagattacagatcacaagcaatcaggctgatcccgcctgagccctgagctccctgggacccagcagcagctgtgcattggcacgtggtgccctgtgtctgatcagctgactcctcaggcaaaacctgcaccattttcaccagaattgcagatgtcctcagtgtcattacaaagttcctaagtcatgaccattctgtcctgtgaaccaggctggactaagctcccatttctttaagccatcctgtcccctgcagggacttccaaggtggagctgatgagcaatagttatgagtcattggaggagacatcccagaggcgccagctcccctctgccctaaactgaaattaagacctggtgctctgggtggggcccctggaaggggatgtgcaactcagaggggaccttctccacctccacccaggagaccccagagggaccatggcagagccggagccctctttttttttgttcgttttttattttattattattatactttaagttttagccctcttttaaaaaccaaatgaaaataagcaaaagaagccaatcgtctctgtgaaatgtccagaagagggaactctgtagagacagagaggatattattggctgccggaggctgggaatgggaaggtgaggggcctggggaggtgatggttaaaagattcttctttgtggtgatgaaattgtcttaaaatggactgtggtgatagttgtgcaacttggtgaatatataagttattgaattgtacactttaaatgggtgaattgtatggtgtgtgaaacatatctcaataaagctgttatttgaaaaataaataa

SEQ ID NO: 202204 - DNA, 282 bp, Homo sapiens
agagaaggtgacactttatggttaggggtaagctggaatatcaaagcaatgttaatcataattgtgatggttacttatcaaagtattgctgggttgattctagttgtttgtgtcctaactctggatcttttccttaatgtgacgaagtaactgaaacaacctggtgctacagccgctggagtgcagtggcgcaatctcagctaactgcaacctccacctcccaggtttaagcgattctcccgcctcagcctcctgagtagctgggattacaggcatgcacca

SEQ ID NO: 202205 - DNA, 303 bp, Homo sapiens
  misc_feature (149)..(149): n is a, c, g, or t
  misc_feature (185)..(185): n is a, c, g, or t
  misc_feature (188)..(188): n is a, c, g, or t
tgctaatctttagtaaactgccatgatgtctccaacttaaccactgtcatctaataagagattaccagaacactgagctaagagaacatggaaaactattttccttttttttttttatattttttttgaaaaaaaaaaaccccctttgnacccggggggggtgggaggggcccaatcccaacccnggnaaccccccccccccaatttaaaagagtttccttcgtggtacaccccccagattctgtgtggaccatcaaggacccaccccacacccccaatattatttttgtttttttattaaaa

SEQ ID NO: 202206 - DNA, 371 bp, Homo sapiens
taagcttaatagtggtagcatggttagagaaaggcctaagagaaaggcccttatttttcagatgtgcatactgaagtattgggaatgaaatgttacgtggtctgttaaaatgcttcaggaataaaacaagataaaccaaagatggcaaaatgttaatacctgttaatctatgtgatggggtagaggtattcatagtatttttctctttagttttctgtatgtataaaattcctcataatagaaatttaaaaaaacaaatccacatggtaggcagtaaaaagtaaacttccggccaggcatggtggctcatgcctgtaatctcagcactctgggaggccaaggcgggaggatggcttgagcccaggagttcg

SEQ ID NO: 202207 - DNA, 503 bp, Homo sapiens
attaaatcaaattttaaacatatttgggatataaaataagttttgacatatttttagctggaaggtttacacattcataaacacatatttatgaatatgtacagagagatgtagatctattcacacaaacacatatatacataaggtttctaaaatgtgatatttcccccctggattagaactattaaaaacatatatattttgtgtgcataaaagtcatgctgtttgcagctagagtcacattggcaacccacagaagaagtaatgttttttttctagagttgattgatggtttactgagtaaaagcacagagggttttggggaaaaaaagtcataaaacagaaaataaatatgaactactgtggtatttggcaaccttttatcaactctgctaagccaaaagggcagtctgccaaacctcaaatgtgattgcattgtatccagagtggataaaaatactgtagcaaaataaataagaaagaaatagtatcatcttgatatg

SEQ ID NO: 202208 - DNA, 311 bp, Homo sapiens
gctcttacttgtctttcaaatctcagcttaatgtcaccacttccctgaccacccagtctaaagcagccacccagccatgttccaataactcatcctcattaattatcgcataccacataattatttccgacagttacttgctttttgttttttttaattgctccctgcctccaatattataatgtagcttcctgagaatgggaaccctgactgtcttatttcattgctctttcactaggaccctagaacagggcctgacaaatagtagatgctcaacgatgttttttgaatgaatgaagcaaaagcagaac

SEQ ID NO: 202209 - DNA, 629 bp, Homo sapiens
gtcctctccctgaactatgcaaacaatggtaaacttagcaatgacaagctagaatcttccagagtttatttattaatttgcttctgctgttgtatattaggtatacaacttaggtgatgtgtgaaaaagcccattaactttagtgagccttcatatgctgacgacagatatattttatattggtccctgggggaatgttaatgtgagctattgtctatgtctaaaggaaaacaaccactcaggatattagctagtggatacaactgtgcttgcataaagtatcctaaacatccatgtccttcaactcagagtgaatgtggccattgataagtggcacctaggaaagtagagtcatttttttttaaatttgggttttaaattaaagtaacatatagtttaaaaggccaaatggtgctaaaagacttataaccaaaaccagccatctcctgtgaccctgccccctactctcagtttcaactgttttgggtattctaagtaatatgtatgtacttctctctgggttcattcatgttagacattatctgtgtactttttattttcttatgctttcccttcctctttctccctaatcccttcagaatagctatatcataaatttttattaaatc

SEQ ID NO: 202210 - DNA, 410 bp, Homo sapiens
caggtgaggaaactgagacctcatgagactaatatgacaaatgtcctacaatgaataagcagcagatttgaacccagatctgtccagctcaaaacacccaatctcttctgcaaatgagaaaatctgattcaccaaactgtaatacacttgcccctgtcttaaaattattgtcaggctacagaaaggaacctcgctactctggtgggaggtaggggtactcctggggagtggaagggtcgggaaggcttcacagaacaacgtttgtctgagcctcttgaaccagaatgtggtcccatcacaggctacaagtagagggaggggcaaggcaggcagaggggtcacccagagacatgggcacatgggtctggccaacatctctcagccacactggagttcctgcctcttatgtc

SEQ ID NO: 202211 - DNA, 371 bp, Homo sapiens
agttcatgtttagctctttaatcctaaaaatatttgttgttcatatttgggactataatatggaaactattcttattggagctttgaggtagagaactaattttattttatatttctctgaattgccaatagtctcagcattgtttattaaacagtttatttttctccattatttttttcatttcacttttgtcatatgccaagaactcatatttgaataggtttgttttggggggggtcctacttggttcagttcatctatttctgtgccaataatgtaaaattttatttctttcaggttcgtaataattattgatctacctgatagggcaagtcttatctacctattataatttctctgttacagattc

SEQ ID NO: 202212 - DNA, 204 bp, Homo sapiens
tcctgcttaacctgaacaaaatgtcatagttacctcctagcctgttgctagaccaaggagagtcacttgaataatgaacaagactggagggaaaccacatggataatttatcattacactatcatcacatacatggaactcatcaatgaagcttacgaaaaaaattgagtcatttgtggaaaagtgtaaagagaatataggaga

SEQ ID NO: 202213 - DNA, 157 bp, Homo sapiens
tgctgggattacaggcgtgagccactgtgcccggctgcatttctgtaattactaatggtgttgaatatcttctcatgtgattggtgggcatttgtgtatcttttctgaagaaatatttattcaagcccttttcaggcatccatatgttttatgatgc

SEQ ID NO: 202214 - DNA, 231 bp, Homo sapiens
tccctggtgtcccagttctacttttatatacctgcttgtcattaagaaagctctacttttcaagaatgctggaaagagcagctttcccccgctataaactcatagccaaccttcacttatatgagaacatgcagagcatagtttcatctcctttgaaatactgtaataagagttttagatgtatttgattcaacgtgcagaatgtttattttttgtgtgcgtgtatgtgtg

SEQ ID NO: 202215 - DNA, 545 bp, Homo sapiens
ttttttttgtagcgatgggcttttgccatgttgcccaggctggccttgaactcctggcctcaggcaatcttcttgcatcagcctcccaaagtgctgggattacaggtgtgtcctgctgtgcctggctcagtctttatgcctttgcacacacttcccctgcccaactccctctttattgtctgattacttcctcgtcttcctttaggagccagctcaggtatgacctgagaattaggtttcagaatcaccctttacccttcagtgttgatttactgctccagctttctgttcacataatactatgtgctttactcttactctcacactgttttgtagtcctgtcttcactagtcttttccattaaagactgagtttcatgaaggcagaaactgtctccctctctgtatccctagttcagtatgcccaataaatgtttgatgaatgaggccaggcacggtggcccacgcctgtaatcccagcactttggggggcagaggtgggcagatcacaaggtcaggagatcaagaccatcctggttaacatgg

SEQ ID NO: 202216 - DNA, 464 bp, Homo sapiens
gctcttatgagaacttagaacaaaacaagctgactgagtttgggggtttggaggagagttccctgaggaaatgacatttaaatagaaatccaaagggtgagttggagcttattaggcaagtacaggattaggggaggtgacttcttgtagatgggcaaaatggcatgtacaacagcactgtggcaatggggagcacaaggggagtggatgacactgggcctgaggggcaggctggcgtcatatatgaaggctttgtcacccatggtcaggggtttggccttgattgccaaagctatgggaagcctgtgaaaatgtgaagaagggatataacatcagcttgcttcaccaattgattcttctctgatttaacttatttgcacattttacacattttaattcaaaaatctaaaatataaaaagccatactgtgaaaaatatatttcccgtcccttccctccatccat

SEQ ID NO: 202217 - DNA, 347 bp, Homo sapiens
ctgtcacttcgggagaagattatttactactaagagtgatgaagtgctaataaagtaggcattaaaaggaaaggtgttggagcagagattagcttttgaaagagtggtaggagagtaaccacctagtggtagggagttttgaaaaatatttaccctctttttccaatgccccagggagtgagagaatgagcttcacccacttgagtgtggtatacttggcagagaaccagagctgttgaagaggaggttcagagaacattcagtgaagaggtcagggtgtggatagttttgtttataattctagcagattccatgcagcatgatggatgatgtgcatggcaggtctt

SEQ ID NO: 202218 - DNA, 366 bp, Homo sapiens
gccaatgtggaccaaatggggggatgggggatactcaaggaaaatttagggcaccatttcttgaaaaatgtagagtaaatagtgaacgcattataataacatcccagctggccctatgattgttattacaaagcattttgaagacagaaggaaatatgagtgaccacttctgagcttcccttgtcctctgtgagtcttaagaacaggagcaaatgtcatctcgcattagcttaaatttcttaatagagtttactttttaaaaagatattttaaaacaatacactcctttttcaaaacatcattattttcaaatcatgtagacatgtatcagaactctcttaaacagactgccatagacaggctgta

SEQ ID NO: 202219 - DNA, 446 bp, Homo sapiens
ggcgtggtggcagacacctgtagtcccagctactcaggaggctgaggcaggagaatggcgtgaacctgggaggcggagcttgcagtgagcctagattgcaccactgcactccagctgggcgaccgagtgagactccgtctcaaaaaaaaaaaaaagaaaagaaaagaaatcaatcccaggcatggagaactccaaagcccaggccttactgtactgctagtgacttttgattgaaacttcatttaatcctcgcaagcctgtgaggtaggtgtttattattcccattttatatgtggggaaagtgagagtaccagaatttctatcaaaatctgtcccaggtcaaatccgtgaatttaaacgccatgctaagctaattttcacagccactttctacttgcccttctgttttttagttttttgtggtggttgttgtgtgtgtgtatatg

SEQ ID NO: 202220 - DNA, 662 bp, Homo sapiens
ataagttcaaggaaaaaaacaatttgaaatacatgacagagactgttgtttgaatggtaatggtgagtgcagattgctgtggtgtttaaattcctttggctatatttaaaggaatttttgactattttattttaaaatgtcaacacttaatgtcctgggaatcttatcctttgtaacattttaaatgtataagaaatgagatgttatctttgaaatatgtgaaggggtttatgggcttttagcaatcttttatgggaggcagaaacaaaatttgaagagcgaaacagactgtggaagactgtgctaagggcaaggaatccacctgggctaggagaagtgatgtttggctgattgcattatataagaaaatgctggccaggcgcagtggctctcgcctgtaatcccagcacttcgggaggccgaggcgggcagatcacgaggtcaggacattgagaccatcctggccaacatggtgaaaccccgtctctactaaaaatacaaagattcgctggacgtggtggtgtgcgcttgtaatcctagctacttgggaggctgaggcaggagaatcgcttgaatctgggaggcggaaggtcgtagtgagccaagatcatgccactgcactccagcctgggagacagagtaagactccatctcaaaaaaaa

SEQ ID NO: 202221 - DNA, 530 bp, Homo sapiens
agtcagagcggctggccaaacgctgcctttgtcaccctcaacatcctcaacaaatgcttgtttgagtggctgatgtgcgagctgggagggctttgtttattccagatcgtgcattgaataaatacgtcttgagctaacacagtgccaggcagcgcggggcacagagaggctgaggggacaaggcatggctcggagtcagaacagtctctgtctgaaccctggccctgcctcctgacagctgtgagtcacgctttggtcaaacctttccccttttgtgcctcagtttccccctctataaaaaagaggacagaactgcaacctcgtaggagtgctgtcagcattaaatgaggtggagtgttctggggggctttgcgtggggctttcggagctggtttatggaatagcctggagtcttttgatttttcctccagtccctgcctgccagctgtgcaaggtcaaactactctccctgttctttgactcacagattttcctatcattttcattttcttttcttttttttttttgag

SEQ ID NO: 202222 - DNA, 392 bp, Homo sapiens
gcctcttgggcagtccctagacaactgattgtccctaggcatgcccaatgctggctgatcccatgttggacttgcacttctgctttttctgaccaccccaactccaggggccactcccatttccagggcctgtggtcatctccgaggagtctttaggagactgaaaacagacagcaggaggccgaggcattccctttcctgacctctccctccactccaccgagctcctgggatgactgccctgcaaagcctccctgagcacatggccccctggccgcatcaggactcctggaaggtcaggtcattcgtttttgggttaattctcaactgccttgctttgaataagtgtaaacttcagccagccagtgcaagcacagtgttttcaactgtcc

SEQ ID NO: 202223 - DNA, 468 bp, Homo sapiens
atgtaagtctccccatgtcatcggcctctattctttctaaaaacttttcaagggatgtatttagccttcctacaagagtattttgatttgtttttgaacaggtctttctgaacctgtcccacttttattgatgctttcgctgatgtttgtgaaaggcatctgggaagggcactagccagtcaggcttttaacacctgtctgtgggttcaacaaagaggaattaagcttcttctcaattgcagatgtcgtgttgtattctgggtcccataggagatcttgactgacccaggagtggtcccctccgggaagaaggacgctcagccaccagctgcccccaggtgttcgtccccaggggtagaactcacccactttatgagcaagtctttgtcaaggaaagaagacggcaattgaaattttcattgagctgttagcatttttttcagaaaaccattttgtcccagtgtgtgt

SEQ ID NO: 202224 - DNA, 454 bp, Homo sapiens
gaataaatggcttgagctgcttgaccgaggatacatattgttactttttgattatatgctaaataagggatagattacttgtgagttttccaggaatggggtgagcaattctcagaactgagggttcctcccctttttagaccatatagggtaacttcctgcattgccgtggcatttgtaaactgtcacggtgctggtgggagtgtcttttagcatgctaattcattataattagcatataatgagccatgaggacgatcaaaggtcactctcgccaccatcttggttttggtgggttttggccagcttctttactacaaactgttttatcagcaaggtctttatggcctgtatcctgtgccaacctcctgtctcatcctgtgaaaaagagtgccttaacctcctgggaatgcagcccagtaggtctcagccttattttacccaatctctattc

SEQ ID NO: 202225 - DNA, 590 bp, Homo sapiens
tctttcactcatattatgcttatccacattgtgctgtatataatgtttcacaatattactcaatttatggatataccatagtgtgtgtttatacattggactgttttcagtttttgttattatgtataatgcagctatgaacatttatgtaagagtacaatgtacattctcttggacaaataagagtggaatggctggataatgtactaggtatatgctaaatgttctaagaaactgccaaacaataatcaaagtggttgtaccattttatatgctcaccagcagtgtgtaagagtcccattgtttccatatccttgccaatacttgttatgggcagtcttttccattttgccatcctaataggtatatagtgctatctcattgtggtcttgaattgcatttccctaatgaataatcatgttgagcaccttttcatgtgtgatttttcatctgtatatcttttttggtgaattctgtttatatcttttgccaatttttaaaaattacatttttttcttgagtgtcgagttctttattctgtatacaagacctttatcggatatatggtatacaaatatttgcttccagtg

SEQ ID NO: 202226 - DNA, 399 bp, Homo sapiens
aatgtctgtctcattacgaaagccacactttagatgcacattcctgtagatgttatcgtttccattcctgagttaagtcttctctgtgtagattgctcacttcctactacagatgatgaattgccagaacaccaggcacataccacacagcttgtacagaactacagactcagaacagacagtttggggactgtgttcttctataattattcttcaacctgctggaggtgcctcgctgcacgttccatacccactagtccacccagggggttgctgcaggcagttcagggcaggagccccctgcacccttctagcattccctggccaccagccaaaaaccaggagttgatgcctcaggagtgacacgaccagtgggggacaggagtccgtggatacacg

SEQ ID NO: 202227 - DNA, 426 bp, Homo sapiens
ggatcctccccttccttccaccaaccccacttgggatgtcccaggctggtggtgaactcgttgggcaggtcagtactgtgtttataaagcgtgtcctcagcacaccctgcaaagtgcctggcaaaacataggcatgccacagatacttaaaaaaaatgtttttcctgcttacaaaagtaagtcatgttgatttaataatatcgagaaaacacagaaaagcatacacaaaaagtcactcttcgacttagacgtgattaatatttggtatttgtgtatatgcaaatatgcatgaaagaaaagctgagaaaacatactgcagagtgttttccacgctactaattcctctcctaagacatgatttttaaaaatcgattttatcaaggtctaaattgcatgcaataaaactcagacattttaaggcacata

SEQ ID NO: 202228 - DNA, 1757 bp, Homo sapiens
  misc_feature (850)..(850): n is a, c, g, or t
gatgataggagttaagagaggactatagaaaactgggtctctaagctgatgtgtcaagtcacactgtcctctgcttatcctaagcttaccttgctcaaatttcttttttttttctttttctttgtttttggtttttattttttcttaaatttcaaggatattccttcttttgtaaatgtcacagagtatcatggctctgtcgccgaggctggagtgcaatggtgcagtctcaggtcactgcaacccctgccttccaggttcaagcgattctcctccctcagcctcccaagtagctgggattacaggcacatgccatcatgcccggctaatttttgtatttttggtagagatggggtttcaccatgttggccaggctggtctggaactcctgacctcaggtgatttgcccacctcagcctcccaaagtgctgggattacaggtgtgagccaccgtgcccgtcccaaccaggcttcttaaatgaattctaagatagaaacaacaggagctgccaggactctcttaagggctgaacctaggactgtcacagtgacatttctgccatattctgctggtcacaaggcaagcccaaattcaaaaggagagaaatagacctcttagagtttcctaataaaaggtaatttcattaaaaatacaattcataaattagccctatgtttactactgtcttttcagctctttttttattccatgcattaattgattcgtcaccacttggattgtgccaccaatgtttctatgacatgatctaaaaaaaaaaaaaaaaaaaaaagggctcagtagttttcacttaaaagacaaagaggcccactgagctattacagatgttanttaggattcatttactttaatatggtagaaagaatgctatgataccactttagtgatgaacaaaataagcttaatcacatcctaggagctaagtattctgacattataatctcttctctcagagtcccatcacagcagtcttaggattcaagatctattcttgggaaacattatagaaccagtgtgtcatgtacatacaaatgagggaaaatataatggctttggtaatcctgtagttatctttcttgtcatatactctttttttcatttttaaaaattggggcaaaatttatataacataaagttaaccattctgaagtgtacaatttaatggcatttaatacattcacagtgttgtacgacttttttttttttgaggaaaagcatatttttaggataatgtcaaaacagattaataagatgctaataagatggccagacattcactcagaagtgttttttgttttgttttggtgaaatggtatgagagatatgttgccctacacttaggccactgcattcccgcttaagtgccaggattgtgtcagcaacaggatggcctaaacaatctcagtcttgtctcctgccagccccctaaatcttccagaattgcaagaataggccaggtgtggtggctcacacctgtaatcccaacactttggaaggccaaggcaggcggatcacttgaggccaggagtttgagaccagcctggccaacatggcaaacccccatctctactaaaaatacaaaaattagccaggcaggtgtggtggtgcatgccggtaatctcagtttcttgggaggttcgggtgggatgatcgcttgaacctgggaggcggaggctgcagtgagccgagatcacgccactgcactccagcctgggcgacagaatgaggctttttcttt

SEQ ID NO: 202229 - DNA, 548 bp, Homo sapiens
ggaaggaacattgcatcataggccttgctgagaaattggaatgaatgacagtatttgaataacgctttgctcagttctgtagtttcgattcgaaatgcagacttaaaaagtcgatgaacattcagacatttctctttaaacaagacttccccttctattctttagagttggaaattattctctgcttgggaatagttttcaatatgttccagacattataaatgacttcccttctatttccatgtatttcccatgttgattacagccaggctgatcagagtaaagcaccaggtgtcatagcatcctaatattatatgaatcatgcatttatccattcatctatgcatgtatccagggaaaacagatttttccccctactttatcggttctacagattcagattcctgtatatttaggtaacattccaaggggatagatgtgctcttataaaagactgcttacttcagcaagacagtttctaaaccctttacttttgagcccaattctccaggtattctcgggggcggtgggggctggagggaagcaaa

SEQ ID NO: 202230 - DNA, 635 bp, Homo sapiens
ttggcattgcagcccttgggggaaagggtaaataggaacagccccactggcaggccattttggcagttaccacacatctgagggccttgctagcccagcagtgccatgtctggtgtgcaggaaggcagtgccatgtaagatgacagcaacagggacccagcccaaacccaaccatcacaaggggtggctgagacatggaggattccagataatgagggctggggtggggggttcctggaagatggcccagacacaggaagagacacaagctcatacccccgcctgcatggatattcatatgtaaatgcatttttaaaactggtaaagggtacatcacaagttacattcttaaccattttttaaagtgcacagttcagtgccactaagcatagttacactaagcatattcacacagcatattcacactaagcgtattcacagcgtattcacactaagcatattcacaccgagcatattcacaccgagcatattcacactaagcgtattcacactaagcattttcacactgagcatattcacacaaagcatattcacacaaagcatattcacaccgagcatattacaagcatattcacaccaagcatattcacaccgagcatattcacaccaagcgt

SEQ ID NO: 202231 - DNA, 218 bp, Homo sapiens
agccatttggctctcccatgcctcagtttcttcttctgtaaagtgggtggcatgaaccggctgggctggccttcagcacactgtgcctggcacccggcagatggggaggaagagcaggagatgcggggaggcgcccactcaggcaccagctcatggggctggggagagggctcttctcttttgaattctggagccacttgctcctcagctgccagctc

SEQ ID NO: 202232 - DNA, 298 bp, Homo sapiens
gagctatttcacccttcgcctttgctgtgagcctctctgggtttatcctagctgaaatttgtcaagcttcttaaatttgtatgtccatttctttcttccaatttgagaaagttttgtccattattttttcaaataagctctgtcctcttcctttcttctctttctggaatttcctaaattggacctgtcctaaatcggacaccttgatgtgttccataaatcccttgagctctcttcattttttctctttgctcgtccagttcagtgatttcaaatgatcagttttctaaggtgtctg

SEQ ID NO: 202233 - DNA, 498 bp, Homo sapiens
aaaagaaagaactcatattccacaggtaccagtattcattatttggttaagatacagtttagcaagtggaatttgccgctagggtccaccctgtaagacacatcctttgtgagtaaatgacctggacctgcaaatgggagtgggatggttggggaggggacaggcgtgtggtggggtgatgcacccagccacattgaatgtagatggggccgggtgctgtggctgacacctgtaatcccagcactttgggaggccgaggcgggcggatcacctgaggtcaggagttcaagaccagcctggccaatgtggtgaaaccccgtttctactaaaaatacaagaattagctgggtgcagtggcgggcgcctgtaatcccagctattcaggaggctgagataggagcatcacttgaaccagggaggcagggtttgcagtgagctgagatcacaccattgcactccagcctgtgtggcaagagtgaaactccatttcaaaaaaaa

SEQ ID NO: 202234 - DNA, 340 bp, Homo sapiens
tcagtcacatgtatccttctagtctagagggaatgttttaggttgtctcatgagactgaattttgataagaaaatgtgaatgtgaagatccttgcaagggagaaaagttacaaaataagaagattttttagtttttctttttctttttaagcaaattcctctgcccattttgtgacagtgttttaagaccagatgggagtgtccctggatcctttcagctggtggcactgtatgagttttctattgctgctgtaacaaattacaacaaacttagaggcttgaaacaacaaaaatttattatctgatagtctggagattagaagtccaatatggtctcaat

SEQ ID NO: 202235 - DNA, 558 bp, Homo sapiens
cccagggttgcatcctcttcaacttcttgttcaacaatgaaagcacctgatgtttccaatgtaatactagatttcatccaactaaatcagagttaaaacatgatcataagtttttataaatatttccttacatgttttatgtacgtgcatgactaacaatattacagagtgctgcatatcagaagattgggtaggaattcaagctattcagtttatcacacaggtcaaatatagttcacctgctcatttccacagcaccagacagttatagaaaatgcaagtaaagtgaaatttaaatagagctggtctacagtatcctttgttgaatggatttagcaaccttctgcttttgggaaaaatctgtctatactaattttttatttcctataactctcttctgcatgtcatatggcattctttgtgaattccggcacatttggaaagcgaggctatgatccattataaccaaatcgctttgctactgctatgaacaaacacaggagaaaattaggataccaggtagttcagtaaagtaattcacactgcagatacctgtgt

SEQ ID NO: 202236 - DNA, 382 bp, Homo sapiens
tagctgtaactgtattacctgtaaaacaaacaaaataagtgaaagggagaagaagtgctttaaatgcaagaattcctaatatcttttttagtataaagataagcacatataaggaaaaagaagacaagaatattcattgatggatggatggatgattcagttggtttctacattagcaatgactcatgctgtaaaattggaatgtttagaaaataaatcctacaattgtaccagaaaagacaagaacataatatgatagagatccaagcatgccaaaaacatcattttcttttctttccatatatgacttttgagtgttctgaatactacccttgcgtttaatgatatagaaaaaggaaataaaacggtaatcacagtctgt

SEQ ID NO: 202237 - DNA, 629 bp, Homo sapiens
gaactgagtatgcatctaatcttcactggatcccttcttcttggcaaaggtgactgggaccgtgtctgtcttgcttataaccgtacccctagctgggtgctccatagagcaggtcctggtcatgcctgcgtggtccatctcctctgggattgatcgtggtgctggtagtgttgatgcaggtccccaggctcaggaaccaaagttggagagttagataaacagttctggctggtgtcagggaagaaatgagaagtgaagtttgggggtagagatgtagtttggccaattcatgggagggagggagttctgtgaaaagcactggaaagccaaagcattgttctctccgggctgggcgtggtggctcatgcctgtaatctcagcactttgggaagccaaggcaggtagatcacaaggtcaggagttcgagaccagactggccaatatggtaaaaccctgtctctactaaaagtacaaaaattagccgggtgtggtggcacgcgcctgtagccccagctactcgggaggctggggcaggagaattgcttgaacccaggaggcggaggttgcagtaagccaagattgcaccactgactccagcctgggtgatagagtgagactccgtctcaaaa

SEQ ID NO: 202238 - DNA, 310 bp, Homo sapiens
cacacatacacttacaactaacaactcacacagtatttggcacttctaaatgttctgtgtactaagaaaactagatatccaagtaaagatatatattaaagaggcagaaacagcattaatattagtaggagctctggtttgaagtagtttaggtttaaatcctcactatgccacttactagtggcatgaccttagttaggtaaattatataatctctctcggccttgagtttttcatctgtaaaataagaatatatctatgtacctctcagggtattttgagaattaaaattttaaatgggccaggcacg

SEQ ID NO: 202239 - DNA, 145 bp, Homo sapiens
gaatggcaaacataaagaagttatagcacttaattaatcatagtagcttaattggacatttaccaaattttttttggtaaatttcttattcagaatagtccaggaatcaactgcttacgtgcttaacttaacaaataactgtggg

SEQ ID NO: 202240 - DNA, 592 bp, Homo sapiens
atacgacctattaattttcaaagaatcactaagtatacaaaatgaaaacacattcagtaaatcccttatcaccatcgttatcctgatcatccatttctgtgcaacaaatcaccctagaccaaatggctgaagacagcagcagtcctttagtaagtctcccagtttctgtgggtcagggattcaggctgttcagcttctagtgtcatgccactgcgccagatggtcaggtcacctgggggctagtctgggctacctcacagcacaggggtctgaaggcagttggaatgcttacatggcacttaaagacttcaaccgttgagtattccagtgagcaagatagatgttgcatcaccttttctgaccttccctcacttctgcctcatttctgttggttataggtaaggcaaaaatccacccagattcaaggagagggcactggactctgtctgttggtagtgaagtggcaagattcttggacatgtggggcaggagatattgtcatgggcatctttggaaaaaacaatttgctatctatctacgctctggccacaacaacttacatctcttccatgtctaaaatatgctcttgagc

SEQ ID NO: 202241 - DNA, 244 bp, Homo sapiens
ttggagtggagtaaagcaatgaggaaatacctcgcggaggagtcaactttcttcttaactaaaacctgaatgaggaggagttttgagacgggtttttaaagacaggaaggatatattggcagagaaagtaagttgtttttagactttggtagaagaatgaatgggggaaaaattacgcagaagtgattgttggtttagattgcttggttagagtggatttcccagtgaacttgaaactctaagg

SEQ ID NO: 202242 - DNA, 369 bp, Homo sapiens
gtatttttagtacagacgggattttgtcacgttggccaggctggtctcgaactcctgacctcaggtgatcctcccgccttggcctcccaaagtgctgggattacaggcgtgaaccaccgcaaccagccagctttgtagattctttgtttgttttttgttcccgctttgtggtcttctggagttctgtcatgttgcccttttatttctttcttttccttatttgtataattgtttcataaaacttgtgagtttcatgtgtttttatgatagagtatcaccttttgttcccatgtttagaacttctttaaatatttctcataggaccaatcaagtggtgatgaattccctcatttgcttatctgggaaaca

SEQ ID NO: 202243 - DNA, 157 bp, Homo sapiens
gctgcaatttctccagatcttaaagagtaaaaaatggtgacctaacacctgcttagtagatatttgtgaaatgtgtttactttgttgctatatttgaaccactgcaaaatgctgaatattgattaactttttagtgtatgtaacacccgccatcacg

SEQ ID NO: 202244 - DNA, 344 bp, Homo sapiens
gccaggtgagtgcagctggagtcgggcacccagggccccgtgtccagcatgtctgtgcctgctggcgtgtgctgcgtctgtgcccatgtgacgtcccacagggctcccagcccgcctgtcctgtccgcatgatcaccctctgtctggcaggccccatggccgccctgtgactgtccgtccacgcacatgggctctgagccccatggccccacacggcccccgtcactgtgggtgtccgtgtctgtctccacctatcctgtctccaagacgggagcactcacagccccgacccctcctggtggcttgactgctgcctcatgctcaccctgcccctccacagggcc

SEQ ID NO: 202245 - DNA, 462 bp, Homo sapiens
aaaagttgatagcattttttagagtagtttattttatttaaggacatttcataagttccattaatttgaaaagctagagataattattttaaagatgagatagagaggttttgatttattcatgtctaaaaaaattatatggaaaaaaggtgagaattgaaaatatgaaccctggatttagattccattttattgtggaattaaatggaattaaagatatatttacttttcttgaaggttattcctgtaccacattgcttgagggcagtgccactgtatccgttttagaagtaccttagtatttggcagaggatatgctatttgcttatgatgattcgataaagcttttgtttcttaatttctttgccggggcattttgtgatgttgcagtgagacatggtatgaagtgtggcacagcatgtagttatagtcaagatgactggctaaattacatgatttctg

SEQ ID NO: 202246 - DNA, 468 bp, Homo sapiens
tcactacagttgccttgcagataaagcagacagatattctaagatccattccaagcttttctctagaatttggtatttttcaggtctgggcacttgaaatggagttaatttttcctttgaggtcattaattatgtttgataaagtcatcatattgtactttattcaactatgagtctttgctgaacttcacatttctttgataacttacaggaaacattaccatataatcttaagaggaaaagatggcatatatacatatatatttttttcctgaaaaagttaagattctaactggaatgtttaatatttctttaatatttatctaaacttcagtgttatttttaatatttataaatgattcctatatctgaacatggttttattttaggtatttatttctcaacgttgagttgctacatgaacttacaaataattttcccttctttaagaaaatgtaaaattttgcg

SEQ ID NO: 202247 - DNA, 374 bp, Homo sapiens
tgtatgtggcaagactgacagacaaaactaatggaacctggtacctagaagaggatgagaaggatccccgtgaaccctagagaagacaaggggatgtgaccgggcagaccctcagggggcacaagacacagattcaactggcatccaaaggggacagtctggaattttttttttttttttttttgggtttatgtttgttctttggggcatcaaatactgcacccaaatatgagccattcatcttaagacaactgctttggttataagaatcctgttctgatattcacaattaactctggacaacttaaaacttattagtgacactgctatctaataataaaatatttcatcataggccgaatacaatttttttt

SEQ ID NO: 202248 - DNA, 517 bp, Homo sapiens
tataagttatagcttgtagtactgtgtaaagataggcaccatgcttacaagatcagaattcagcttgaggctgtgtgagtttacgacaacactgtagtgtgccactgtacttctctaccttctgtatcgccgtatggaattactacacaaaattagcactaagaaacctaaatttccttacagtagaaataagcttatatgaataattctcttatagaaattaaactatctgctgcagttgtcagcagggtttaatttttagcataagctgaggccatcagtttcttagcagtcctattcttaaataatcatttctgtttaagagatcattttactgaacaatttcaaagcactaaatatcttcgagattgaaaaaataagcacctatagatggagcagaaactaaagaagaacaatttaaggaaaaagacagtccttaactatgcacgcatcctatgaattatccatgctttcagctggtttccttttactgcactgtctaaaactccatatttaa

SEQ ID NO: 202249 - DNA, 454 bp, Homo sapiens
cggagatgcgattttactctgatgcccagtttgaagtgcagcggctgctatgtcagctcactgcagcctcagcctcctgggctcaggcgatcctcctgcctcagcctcctgagtagctgggaccacaggtgcatgccaccacacctggctaattttttaaatattttgcagagacgaggtctcaccttgttgtccaggctggtcttgaactccaggactcaagtgatccatctacctcagcctcccaaaatgctgggattacaggtgtgagctaccccgcccagcccttggctaatttttgcaacatttttttgtagagacaaggtctggccttttcactcaggtgggtcttgaactcttggctttaaggcattctgcctcagcctcctacagtgctcggattacaggcttgagccactgtccccagcctggtgaagcatttgtttagagtctc

SEQ ID NO: 202250 - DNA, 540 bp, Homo sapiens
gccctcaaataaactggctattgcattataggcccatttgttgggggcagtctgttggtccacacctacttgcttaggcaggtgctctggtctcacccctgccccttggagtttaggtgcagcagcctctacattcctgttccaagcatgggaccaaggaggccggaacctgtcactggaagccaggtcaaagccatgagcagtggcccacggcttgttgggttcgtctgtatcattgaagctgcctgtctgcatgtatcctctggctcgcgtgctgttggctctgcagtacaatatgtaaccaataaagctccctcctttccatgtaaaaaacaaacaaaacaaagtgtgagttatcccatcagataggccatctagaccagcagaagtgatggctgagactgagaagaatctagaatgaatagtaaagggtggagattgtgagtattagttgtgactttacgacgactgcaccagttgggctacactgttcctgctaaccttcctcttatatattttgccagaactgtgaccaaacag

SEQ ID NO: 202251 - DNA, 495 bp, Homo sapiens
catgctgacaggttttctgagcaaggagggtaggggatgacatgagacagtttgctgatggggatggggttgggatgcggattaggtcggcacagcccctgctctggtgtgaccctcagctccagcagtcactggtgggatctacagtcaagttgcttcacctctctaagtttcagttttctcatctataaaattacagtacttaacctatacgtttgaggtaaagattaaatatgataaatgtatgggaaaaacaacttagcatattgcctgaaccatagaaaatatgagaaaacattgtggcttttgttgttcttatttttggcttaagtgaggtgtgaatgtttggaacaaccgccaagcaagtgagagagggagctaagaacaatagaaggtgttctgagaacccaattgggagatgaaacaataggctacagtgtcacagtcggcctggtggcatgtgttcctctaatagcattgggctgatcaggcgat

SEQ ID NO: 202252 - DNA, 618 bp, Homo sapiens
aaagaattttagggttaccaatggattgctggcattgcccaggatggtggccctcatgattacgaacactgtgatatcttccatcctcaaggaatccatggggatggctcccactcgcacaccttgttgagacctttattcaatgtttaaatctattaaaatccttcattcctggatctatatgtttgtcaaaagactatactgaaagctatatatcctaactgctggccaaaaaaaaaagtttttactcatattctttgaacaaattgaagaaaatagatcaagaaatctgccagagctggggatagtatgcataagttcagactagaatttctactgtgcctaaaggctggtagaagagccatagctcctagatctcggtaggacattatcactgatgtctcatttgattcctgggcaatgaaaaaatcatattcatggagtacaagcacctgctctctaggagcttacaatctcttttgggagataagaaaaatatacataaaattataacttaaaatgctgagaagtaaatgctaagtgcccataaatgtaacagaagctctcaagagtaagaaatatagtggttgttttctttttaagaacagataggcaggt

SEQ ID NO: 202253 - DNA, 409 bp, Homo sapiens
gtcaatgaagagattaagaaggaaattgaaaaaatttctggaaacaaatgattacagaaacaacataccaaaacctatgggatacaataaaagctgtactaagagggaaatttatagctataagtacctacatgagaaacaagaaaaacaccctagcaatgtattttaaagaattagaaaagcaagaataaaccaaacccaaattagtagaagaaaaagcaataatgaaagatcagggcagatacaagttaaactgaaaataaaacaacaaagatcaacaaaagaaaaagttgattttttgaaaagttaaacaaaattgacaaacctttagccagactaaggaaaaaaaaagaagacccaaataaagaaaatcagatatgaaaaaggagacattgcaactgacactgca

SEQ ID NO: 202254 - DNA, 826 bp, Homo sapiens
  misc_feature (19)..(19): n is a, c, g, or t
tctagaggactcccagtcnatcgaggacacgtgggtgtgagtggtcacctgaggtgcacacgtgagggtggatatcatgagggtggctgtcaagagggtggatgctggttcagggctggcatgaagaccctagtcaggagggagccaaggcgtccaaggaggccctcaggctgcaagtgttggtttggccccagtcttggtgatgacaggacctttgggaatctgaagcccggtgaccttgggctgtggggagctggcgggctttatctgcccagcgtctctgccccagttttgggcctgtctgtgatgctgggcacctgctgatgtgcgcagcttcattcattcctcctccactcacccacctgaccactgtgtggggcgcccctgctgtgggccaggctggttccagggtccatcagcaacagaaacaaaaatgcctcttggggagacacaaccagcaacaagagaacagcgaaggaggcgtaggacatgcggctgatatgggcttaggggaaacgcaggcaggagagggggctgcaagctcaggcgggagctttggggccaggaaggcctggctcagaggggacttgggtcagggtcacaacagggaggtgaagccactgacccggagctgctggagagcttccgggatggacagagtccgccccacgggtccctcctgccctccctcggtgcctgccctgggccgtggagatgactggggagctaggtttggctgggtgacagcaagggctggacagaaagtgcttcagacaaagccaaggataacagtccaaggacattaaggttaacaaaaaaaagaaag

SEQ ID NO: 202255 - DNA, 550 bp, Homo sapiens
taagagaattctagtattttaggaagagttgagtaaatttaaggatgtacttaatttgctcattttcctactagtgtgttaaaagttttcagctatcacatggaaacacaggaaacgtattgtcctgttgcataaacgaacagcttcactttagagctgtaacctcaatagttggcagtatgtttgcagaataaactcatagtgaaaaatattaatctgtaaatcatctattctttgaagaaatagggcttttaaaagttatatttggggctgggagtggtggcttgcacctgtaatcccagtgctttgggaggccatggtgggcggatcacctgaggccaagagttcgagaccagcctggccaacatggcgaaaccccatctctactaaaaatacaaaaattagctggatgtggtggtgcgcacctgtaatcccagctactcggtaggctaaggcacgagaatcacttgaacccaggaggcagaggttgcaatgagcagagattgtgccactgcactccagcctgggtgacagagctagactccatctc

SEQ ID NO: 202256 - DNA, 1038 bp, Homo sapiens
gtttgctaacacaaagaggttctctttgaggtgatgaaaatgttctagaattatgtaatagtggtagtttcaaaatattgtgaatatgctaaaagctattaaattgtacactttaaaatgattaaaaccgaggcaggcaagtcgtttgagcccaggagttcgagaccagcctaggtaacatggtgagacaccgtttctacaaaaaatacaaaaaaaaaactagccaggagtggtggtgtacgcctgtggtcccagctactcaagagactgaagtggaggctgagcccagaaagtcaacgctatagtgagccgtgatggtgccactgcacttcaacctgggagacaggctgggagacagggaccctgtctcaaaacaaacaaacaaacaaaaaatgattacaatgctgacaagttacttgggcgttttttgtttgttttttttgtttgtttgttttttaaagaaaaactgcagagctagtatgtaactaagccaggataagaaaccggggcggtctaacaccaaagcctaaatccacagctgtgctgccgagcatgaaaggagatagttatcaatctgaccagggaaagggagtggtcatcaaggtcatttgggcttggttataaaggtcagaatgactttgccaagtgaagaaattaacactgggcccactccaaacagaaaaaaatggtacatgcaaagctacagagaacctctcgtgtacgccatcttagtggttttggtggctggcatgacttaagcaggtactggtaagaaatgaagccagagataatggcagagctgttcccagaacaccttctgtgccatacaaagaaatcctacttttaagtatggcagaaacataaccaactatacagtcaaatttaaagattcaacaggtgattgagatttaaaagcaaaattaaaaaatcttatatcatgctgggggaaaaatattaaacttcatggagctatttataaggcttgtcaattcaccacaattcattttgtgtctgtactcccacacagtacccctcagg

SEQ ID NO: 202257 - DNA, 281 bp, Homo sapiens
tatggtggaagcgatgattatagcagttcacgtgacggatatggtggaagtcgagacagttactcaagcagccgaagtgatctctaatcaagtggtcgtggtcgggttggcagacaagaaagacggcttcccccttctatggaaatcctccacgtgattcccacggcaattcaggcggtggagcaccaagaggtggtggcagtggaggaagccgatctgatagagggggaggcagaagcagatactagaaacaaacaaaactttagaccaaaatcccagtt

SEQ ID NO: 202258 - DNA, 253 bp, Homo sapiens
ctgtgttgtacattctatgggttttgacagaagtgtaattatgtgtgtcgactattgtactgtgaaacagaatggtttcaatgccctaaaaatcccctgtgttccacctattcatccctcactttcccaaaacctctggcatccaccgaacttttcactgcctctgtagctttgctttttccggaatgtaatatactcagagtcatatggttatgtagtcttttcgtattgacatcttcacttagtactatgc

SEQ ID NO: 202259 - DNA, 423 bp, Homo sapiens
aaaagttggatgatctgactattcaatacttaacagtagtcctgtcaacacagtaggtgctcagagaatatacgttaaatgaactctggttgagttgatatttgtactcagcaaacactagaatgacgtagtggctccattctttaggtgtttagtctgggctctccttggggttctagactacttcagagttacttttctgtcatctccttggcccttgtattaatagccattggagtaaatatcagttcccaataactggccattttgactagtgagattttaatatataatagtaatgcctccagtatcatgattacatagttttccacataaattgatattccagatgccgaactttatgacacaattatgacaatattttttttgttataaacagtattggtcgaaaggtgttgaaaa

SEQ ID NO: 202260 - DNA, 460 bp, Homo sapiens
tagatcagtggaagctgtttcgtcagctcataaaaacgtgagagatctaaatttttataataaatcattttgctgagcaaacaatatgtgcggttattacagactttggaaaataaatgattttagaccaatgtcaggctgcagatactgatgtggttagttgagccttcagcatgaagagaatgaaaaatctttggaatactgttgacactcacaccatgaaaccacatgccatttaattcattactgcgcttccaagattacatttacagttgtggtattaacccctgggcatttttgtattacttattgcagacagtttgtcaggcaggattaattcagtggggggaggaggcagcagtttggagagaaagtggatgattaagactggggtggggctgggcgcgtcggttcacgcctgtcatcccagcactttgggaggccgaggcgggtggatcac

SEQ ID NO: 202261 - DNA, 324 bp, Homo sapiens
aaagtctcctgcctgacctcttcagacttacctacaatgctttccttcttcctatccctgggtcattgtgaataagttgcagtttcccagaaagtgcttgtttcaattctttcctcaaccccgtttgcccagatgatatctgtttcacctgttaagtcttagtctaaggtttagctctggtctttcccaattgtcctattctacatgttcttcctatcgtaggaccttttttttttttttttttttgtgagacagagtgtcactctgtcacccaggctggagtgtgcagtggcacagtctcacttcactgcaacctttgcctcc

SEQ ID NO: 202262 - DNA, 727 bp, Homo sapiens
attatctggtgatgaatgagcacctgtgtggcacggagccacggaattcgcggccgctgtagatccaggcccacatcgacagggacggctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaagccagtgttgatggctgcgtcttaccgcttactgagccaggaggcaaggcgagtacttcaatgtgcctgctgccaccagaaggaagtgaggccaatgaagaactgcggcagaaatttgagagggacaagatcagtcagggaaccaaggtcccggacagaaaaagagcgaccaaacactgtctccaagattttggaccaacaactggcaacagagaccggatgaaactgaccgatttcactttcctaatggtgctggcggaaaggcagctctggcacaggtccatgcttcagaacgaaacaggcacagatgactctatgctgtcaacaatcctgcagcacgacgtggcgatc

SEQ ID NO: 202263 - DNA, 999 bp, Homo sapiens
ttgaacccaggaggcggaggctgcagtaagccgagcttgcgccactgcacttcagcctgggcgacagagtgagaccctgtctcaaaaaaaaaaaaaaagaaaaagaaaagaagcagctatgggtcctgggcaggccccgcttcaaactcctgacctttgtttggttttcctgcctcacacactcttgggccatggggcagtggcttctgccatagcctgaggtggttgggagagctgggctaaggcttcttggtgcagccctatcatcatgaggtggcggaaggttgccgtggcaggtggtaatgtgctgagcctcttcttggtgcaaagggtctatttctgtcactagcatcagattgaccttattttattttttttgcctagaaagatgtagaagacagctcagcaaaaagaagcctcagggccgagatagatctatccctcgttgtgccttgcttgcctcttctctttctcttctttttcctttcctccgcctcctttctttttgagccctacttaccctttcttctgcatcctcccccacccgccatcctttgtttttttcctcactgttgcccttcttgagaaattcttgtaatgctactgcagtgcgcagagcttgggattgaacctgttttctgtgtttttaaaggggacttgcagtaaaaagtagggcatctaaaatagggagactagacatcttgaaactgtcccctcttcttctccattcccaccccaagtcataaaggataaaatctaaactctggccttggccgcaaggctcatgcagtctggtgccatatcactttgctgccttttgtcagcagcatagtgcttaatacccactgtttccctgtgtttctgcccagtagaaggttccctggatgtgccaggctgtatcatgactttgttttgactacagatagtccctggtttacagtttgacttactgattttttgactttatgttggttacaaaagtgatatgcattcagtaga

SEQ ID NO: 202264 - DNA, 924 bp, Homo sapiens
cctgggtgacagaatgaaaccctgtctcaaaaaacaaacaaacaaaaaccaaacaaattataggaaaatcaacattttaaaccaaagaagagaaggagaaagaagggaagggaagccataaaagtgtctttttcaaatagatcatgggggaaaaaaaaaaaaagtatgacttggaatagagacagccttacaagcaggatctaaaactcagaatccatttttttaaattgtgataaatttgactatagaaaaatgtaaactttggatacaaaagtaccatatttaaagtaaataagctacaactattacatgacagagaaaatgtcctcaaacttctaaggaacttctaacaagtagaaaaaaaacacacacaaccccaaagcaaacaccaatagtcaataaatatatgaaagtgttcaatgttactcataataaaggcatacaaatcaaaccatgaaatgctatttttcattaatcacaactttgcaaaaattaaatgattagatctgatgtcaataaagatgtagagagatggaaggcaatttgataacttctgtcaagattttaagtagtcactaaaccaagttccagtactaggaatgaatttgtcctttaagtatggtacttaaggatgttgactgcagcattatttgaaatatcaaaaactgaaaatctaaaagtccatcaataaaatctagttaaatacattttcaatccatcaacagaattaattgctatgaagttgttttaaaaacctatacatatagaaatggaaaatgcctaagatatattacatgaaaaagataagatacagaatagcgttgcaaaggtagaagttcatttgcattttaaaaactgaaaaggagaaataatacatatgtgcacagaaacattctgggaagctactcaaaaaactattaatag

SEQ ID NO: 202265 - DNA, 436 bp, Homo sapiens
ctgtaagacctcctcattgcttcacatagagatcccagctcataacactgtggataagatttggcctctgcatcctcttcagtcccttcttctatcactccagctctcctccttcaagccatagagtgttcttctcatggttaatttcgcttcactgactcagtcttccttatatcaccacctgagttagtcctgctgttaaggttcttagagtccttttcactctgccaccactgtatttacctctttttattaattatatggtatgtgataatttgatgtttattaccttggttctcccccattattctttgagctactttcataactagcacctggcacaaagcccagaagagaataggtgctcaataaatatttgttaaagcctgaatgaatgattgaaaataaattataatatgtttgctataaaaagtaa

SEQ ID NO: 202266 - DNA, 534 bp, Homo sapiens
atagtactattaatgatgttcactcaacagtaatctgtcattcctaagcacggaaaatgttagaaagtaaattatatattgcagtgacctttcaaataagaaccacatggttcttttgacactaattttttatggaaaactctatatttcagcttaataacccacaacactcagaacgactaactctctagatttcagagaagtgtccaaagtcacataaacgtatacatgacaaatacagtagcaatgacactcagcaaacatccacaagatacaaagtgatgtaacaaaaaacagcaaacattcaacaggtctagcaccaattgctatgtgactaaattactatgttaggcaaagttgcatatgctgttcctccaagcctctttccctacctgtaaaactgggaggatggcaatcttataaataagttggatagattcaaatgtaccagattaagcaaaatacatcaacataaataataaaattaatcatctaacattttattgagcccttgcgttaaagaattacaatata

SEQ ID NO: 202267 - DNA, 636 bp, Homo sapiens
aacatgactaactttaattgccagaagtaaaagcttttattttacatgattacacttcattgtactagaatatatcacaatctctatttccttgagacaaacagtttccctaatatggtattataaaactgtttaaacatataaaaatgttgtgggaagtgcatatttatagtccaaccacttagattgtacaattatcattttgttatatttgctttactacatatctctcactctatccaccattctatccaattatcaactcaccgtttcttatttatgtcaaagtatatatttttcttacatacttaacatatgtagcattattgttcagtatttgtgtacagctcattttttttaagttactaaggttttttattaacacctcagagtagaggttatgaaaggaccctgaattgttctaggaattttcttcagtgagcatttgtgaagactcggggatcaaggttgggttaaactttgtgatgggtccattggcagtctagtcacaagcacctcctcgatccttaggtcccagcggaaaatgatgccagactcttaaactgccacaacgtagcctggaaagaactctacagtccagaaagagcctggaaagtggttttgtgagatgaaatt

SEQ ID NO: 202268 - DNA, 680 bp, Homo sapiens
taattaaaacaaatggccaataaagccaaacagacactgagtcttttgttggtgtaaattcctttacacatttcataatgtcttctatgatattggtttacttttgggaattgaaacctttacagaaaactatcagtttcactaagattttaccatgaaattatatattagatcatcttcatttatttaataaagtgttaaacacaaagttatttctaattttatttgggttttctatgttttaaaaattaagactgcgtattctttccccgacaaaatccagctctgggattcattaatgtattcgaatattttttggttttctatttacttttcaatatgatcttttttcatttaatatgatctatcattttatgatattccaatggcctcttttgggtataaggtggaatcacattcacaggtcagcctgagatccaccggctgatagccctgccctggggccagcagacccttggcctcctttcgactgcttggctccggttgcgagactgttggccacccaaacctctcctctcaagagccctattcttatctcacccttccacaaggcagtgagatctaaggcaggaaacccatcctggtctcatgaccatgagcagctcagaagccaattggcccaacatgtagatgggggagcagaaagaataaacatgggg

SEQ ID NO: 202269 - DNA, 1899 bp, Homo sapiens
aggattttcattttcatttatggcacccgttgtgtttgagaacatggaccaatttatggattagttttaaacccccagtctgtcacactcaatgaacaattctaagttggagagaatccatatgaaaggattagaatgtgccacagtggagcttacacatgactgtttcaactaaatattgcccagctgcctctcctgcagtattatttttttttttttgctacttagttaaattgctagtgtctctaatttcacacattgtcagagctttttttattttgtaaatatactgccacaataaatgtatgtgatgtttcatttattcaagatggggtctgataaactgtaggactaggagactaagaagagaagtcaattttgagtagaatgtgcatctttcaaataatattgctgggcccttctttggataccttgtttgactgtactcataaaatagccagagagtgactgttaagaccgtacacacttaatgggttttcaagaagatgggattgttttttcttggccatataatataaatgtataataaatttgctctctttgtaattaaaattaagagacagtagctcagctaggccttttaaatgtctatataacccaacaccaccataagtccagctcaattttttgtgacctgtttttctcatgggctagctcaaagattttttttttttaaggcagcagcaagatgaggttttaaaaaggctttgttagggcaattagacattttcatttttcaagctgattatagcatttatcacttacattgaaatttagtatttgcattttgcctctacgcttagaatgttacccaacaatatggtcaccacacaagttgattcacagggtgtgtttgcacatttctccagttttctgattaagataccctaataaatcctgcctcacagagttgcactcacttcagagccagggtgtctgtggtttctgcatgaagtcataacgcaattatgaaggagaattagattctgtcatcgtggtctcctgcagggagcacaaagttacttctaaagaatgttttcttaattctttacttgaaaataacctctgttcaagtagcataccagatgctcttagagaaatggagtcagtgactccccagacacaccatcaatcttgctctgaactttgtagccagcctgtgtttctcctgcagtctcctaccccgttgctgctccgggttttgccatttccagctgcagtaatcgtgtgtgtgacttgaacatgtgtttgctgttaaccattttagaatgtgttttttcttctcaacatccccctttcctccccttttgggtgcagttgatggatttcccatccccagaacggggaagcaagatgcactgtggattttccttcatttattttctagtactcacctaggagcagacgcctagcttcacttggtttaatttcatcttaaagctgacatgatgttgtgatgtaggaagacagtaaattggggtcactggttaatgctgatattatttttgatgactctaacccttaggtcttactccaccccccgcccttctatcatttgtacttaagtatttacctggtgaaaataaagcttatgccgggcacggtgcctcacgcctgtaatcccagcactttgggaggccaaggcagtggatcacctgaggtctggagtttgagaccagcctgaccaacatggggaagccccgtctccactaaaaatacaaaattagccaggcgtggtggcacatgccagtaatcccagctactcgggaggctgaggcaggagaatcgcttgaatgcaggaaccggaggttgcggtgagccaagatcacgccgttgctctccagcctgggcaacaagagcgaaactccatctcaaaaa

SEQ ID NO: 202270 - DNA, 320 bp, Homo sapiens
aaaggacaggttactgttactcagccctaccctcttgcagcccggagcctggctctgcgggttgctgatgagatggacctgaccctgggtcatgaggttggatacagcatcccccaggaggactgcacggggcccaacaccctgctcaggtgggggcctctgcaggccttacccgaatataattccccttattcagtagaatcaaacccattcctctggcatctcaccatacccgcccttcccaatcgaattcctgcagcccgggggatccactagttctagaagcggcgccatcgcggtggagcttcagcttttgttcc

SEQ ID NO: 202271 - DNA, 567 bp, Homo sapiens
ctcaattaaacacttcatagaatgtttagatattgctagtagcgccttaattcccatttatttatacataaacagcaaacattatttggtacaatgatccttccaactgtcattgtatcacagtatacactgcttaaaatgggatttatttaaaaacaaatctttagttcgcttgatgtaggcattaaactctcatcatacctatactctgcttttgtccatttcagctgacatctgctttagttctagtttgttctagttttggcagtagcattttggtgcagaggaggagttaattaaagttggttgagaaaaggcttaagcaataagaaattcttcgcaaaccactgattcatcagcaaaatgtcacctgctagtccataatgactggtgttcatccaacagacaactctgtggatttttttttttttggctttgtttgtttttgagacagggtctcgttctgttgcccaggctggagtgcagtggagtgatacagctcactgcagcctagaccacccacttcaattcaacaatgcaaacaatcctcccacttcagcttcccaa

SEQ ID NO: 202272 - DNA, 453 bp, Homo sapiens
aagtattaacagaaaggacatactgtgatctcacattcaaactacttcaaagataaggagatttattttgcccattacaattttctcccagagcaaataaccatttttattaaaatgctgtaagttcatccaggtaggatttgggtgaagataatttgggacaagccactgtgtactggtaatgaaaacagaaatgaattcaagcttctaatggaaaagtgacaagcaaataaattaatctccaggttattcaattttagaaagtgatataagatgtaagatataactaaaaactgaaaaggaaagttagaaagattattaaaaatgatgtcagtaaaagtctttaaccaagaccagatggttcatcccaagagtcatctttaattgtaaaaatcttcacatcttaagaagctacatgggaggctgcggagaggactggggtaccgagctcgg

SEQ ID NO: 202273 - DNA, 280 bp, Homo sapiens
tagcgctgagctttgttcgtttagtgggtataaagagaaatggcttctcccctatcaccatttcagaattgagagagaatattgtggtaatgaaatgttatatgggagcagctgaaaaaattcttctctgacttcaaggaggggaaatgtgtgtgaggatacatgtataggtgcgtctgcaagaaacagtgagcagcctgggggtcaggaaagccaggcttgtagaagtgggagaaggcagagccctgggaaaaaggcaggtgtggaagggtggtgtgga

SEQ ID NO: 202274 - DNA, 1165 bp, Homo sapiens
cactcttgttgcccagcctggagtgcaatggcgtgatctcagctcactgcaacctatgcctcctgagatcaagcgattctcctgcctcagcctccgagtagctgggattacaggcatgcgccaccacacccagctaattttgtatttttagtagaaacgggggtttctccatgttggtcaggctggtctcgaactcccgacctcaggtgatccacctgccttggcctcccaaagtgctgggattacagacgtgagccaccgcgcccgcccgcaggttagttttaacttacttataaggtaaggcttcaggtcagtttcatcactatccttgatatatacaaagttagttttgattcagttctcttcagataaagtaagaaaacttcaaatattacaaaaagtttaaagcaaatccaagcataaattaattttattaaatataatagaaataaatcactgtattttctttgaacagaattactaaagtaaaaaaatacaaattgatattattctttagcaatagaaaagaagcaacaattatgaccatatttccaatgatttagtatatattaactaactactggctatttggaaaacctgtttcaccataacaaaaatctgcactgtctattataaatttgttgttggacttaatataataataaatcatattattcctatgattactctataaagtgatatttgaaaatagtgttatacagcacaattattagatactttgaagactaagaaaaacacatgcacattgagggcaatatatttattgcctaccatttttctgagaggctgacagatttaccaatgtaaaattttgcgtgtatgtgtgtttggctggaagaggaactaccatgaagttatctaatgcttttgggttctctgttcttgttttgaactaggcaagaaagcagctgttcctgaaaataaccagagtgtacactttggtttagaatagtctgtcctttggaattaagccagcatgctcttattgactctacatgcttaataaaataatgaaaattattaagacattcctctgctcatgtgaagattagctataatagatatttttataattatcttgaatagcaaaaccaataactgttattcatttagtgaatttttagagaagaatataagcaaaaat

SEQ ID NO: 202275 - DNA, 1219 bp, Homo sapiens
cactcttgttgcccagcctggagtgcaatggcgtgatctcagctcactgcaacctatgcctcctgagatcaagcgattctcctgcctcagcctccgagtagctgggattacaggcatgcgccaccacacccagctaattttgtatttttagtagaaacgggggtttctccatgttggtcaggctggtctcgaactcccgacctcaggtgatccacctgccttggcctcccaaagtgctgggattacagacgtgagccaccgcgcccgcccgcaggttagttttaacttacttataaggtaaggcttcaggtcagtttcatcactatccttgatatatacaaagttagttttgattcagttctcttcagataaagtaagaaaacttcaaatattacaaaaagtttaaagcaaatccaagcataaattaattttattaaatataatagaaataaatcactgtattttctttgaacagaattactaaagtaaaaaaatacaaattgatattattctttagcaatagaaaagaagcaacaattatgaccatatttccaatgatttagtatatattaactaactactggctatttggaaaacctgtttcaccataacaaaaatctgcactgtctattataaatttgttgttggacttaatataataataaatcatattattcctatgattaacaataattcagattcattcctggtacagggatcagtaaatggaaaaaaattttctctataaagtgatatttgaaaatagtgttatacagcacaattattagatactttgaagactaagaaaaacacatgcacattgagggcaatatatttattgcctaccatttttctgagaggctgacagatttaccaatgtaaaattttgcgtgtatgtgtgtttggctggaagaggaactaccatgaagttatctaatgcttttgggttctctgttcttgttttgaactaggcaagaaagcagctgttcctgaaaataaccagagtgtacactttggtttagaatagtctgtcctttggaattaagccagcatgctcttattgactctacatgcttaataaaataatgaaaattattaagacattcctctgctcatgtgaagattagctataatagatatttttataattatcttgaatagcaaaaccaataactgttattcatttagtgaatttttagagaagaatataagcaaaaat

SEQ ID NO: 202276 - DNA, 434 bp, Homo sapiens
cttcagtatcccccaagtatgccctgcttatttctggtcccttctttccaactctgctatctgtttcctcctgacattcccaggttttacaacatgtcccacccatctcaaatctctaccaatgaaaattctatcgttatctcaatgcccattcaagtggtattgtctccagagcctttcatcattcatcattcatccagaaatgctctctcccacctctgagctgtataaagcagtcatttatcacattcccttggattgacagtgacttacatatacatgaccatgaatcttagtttaaccaagactgtcgagtttatattcatcctcttggggttattatgaagaccacctctcttcactctcaaacgtacacaaatttgaatactaaattatatggtcaccttttctctatataggattcacccccttcc

SEQ ID NO: 202277 - DNA, 274 bp, Homo sapiens
ccatggcaagtctttgaggacataagttatcttgagtcatcaatgactgcctattgggcagtagcaaggagtagggctggatttctattctggtctcttggtccctggtttctcttcccttcactacccatttaatcttttgaaatttccctttgcatttgtcactttcaggtactattgcttatgagataaaggccaaatttcacagtctctgaaagctctcccatgttgttccctctacctggaatacccacacatctcttcttcgcccaag

SEQ ID NO: 202278 - DNA, 685 bp, Homo sapiens
atttcttctccctgagtttgtcttccctttatttagaggtataggtgaatgctaattatatggcgacttctgaggttttccgttttcatttttaattttcttaagggcaaaggctgctgtaatctctacaataggcatctactctctaaaaataattcagtacactaaaaaatcttggaaatatcttttacatctcctgatcactcactcactacatcacatttgccattgagttatgtaattttgaattactttgtaattcaaactagcttttgaatctctccaggaagtctttcccactcttcatcttgactgcaaccattcttatcatccctcatctgaactattgccagaggctcctaagtttcctttccctgtctttatggtccctgacttcgaattcattgtccaaactgacactagagtaattggtttcaaattcagaggagaccaatcactatcctgcttccagtgattccctattaggagataaagtctaagcttcttaggaatgtgcaatcctcaaaatcctactcccacttgccactccagcttcatcttctctcgtttcccattccttccccactagactgttccctttcacaataatcatcattataatctgtaactgagaattgttgggtaatgtattcagcattctatttgtattatgatatttaagtct

SEQ ID NO: 202279 - DNA, 359 bp, Homo sapiens
tatactatggcagatgtcaacagagatggtatttaaactgcaccctaaggaataagatggaaaaaggatggagggcatttcaggaaaaggtaacatgagggtgtgagaaaacataaaatgttctgggaaaaaaaactactccagcatagcaaaagtgtagaatttcactacacacaaatgtagaaaagataagatacagagcagggaatcaagtcttgaaaaataaattggagatagagtataaaacttaaatgcatttggtctctatgttattgccaatgagagtcatatcagactctaaagaaacagagtaagacaattcatcaacccagtactttgtggctcttgttgctaccact

SEQ ID NO: 202280 - DNA, 431 bp, Homo sapiens
ttgaggtgatacatgtgctaattaccataatttgatcattatacattgtacacgcttatagaaatatcacactgtattccaaaaagatgtacaatcattgtgtcacctaaaaataaaaggggtaaaaatggaaagaaaatgcattaatatacagcctcttgatcgtggaaataatcagcagactaatgtaacaagactcagcaacagaagaattaattaggctgaaattgattaaagaaaagggggtaaaaatctgtctgggataattcaggtttcaattaaacttaagaagaaagaagaaaaatattcttttgttccattattgttttgacagcattatatggacttgtccacagaatgttaatcaaattagattttttttttttttaaagaaggaaggggtttattcggccgggggcattggcaaggct

SEQ ID NO: 202281 - DNA, 380 bp, Homo sapiens
tctgaggatccccaagccgtaatacagactcaggttattaaagatgggcaaggaccccaagatgaaggctactctgaggcttagaatgaagaatacttcctggatgtgcaaatgaagattcattgagaacagggacccagagcaaatgcttcctgaattcctattggaggaagtcagacagatgtttcccagggcactcttgtcttctgttggcccactgcatgttaacagccttccctttctgctcttgtccaccaagaatggccatcggtagtgccttgcctcttctgagtatcttacagaagatactcatcatctcccacttggagctggggatgacttgctgttccacatgttattgagtcctctaccatgtgctg

SEQ ID NO: 202282 - DNA, 427 bp, Homo sapiens
gtgctgggattacaagcgtgagtcactgcgcccagccaaacatgtaattttcattgccctcttctcctacatcattttaatagttattgctctgataaaacttttctctgggggtgctatggtctcaatgtttttgtctcctccaaattcatatgttgactgctaatctccaatgcaacaatatcaagaggggcagcctttgagaggtgatgaggtcacgagggctccgccttcatggatgggattatatccttgtaagaggcctgagagagacccctcaccctctccaccatgtgaggaggaaatgagacagtgccatctatgaagcagagaaacccttaccagacactgaatcggccggtgtcttaatctttgacatttcagcctccagtactgtgactaatacatttctgttgttcataaatta

SEQ ID NO: 202283 - DNA, 311 bp, Homo sapiens
atccttcacccactcctgtcgtcatatccacctttatacagcttggattccctaagccgtcattataatcactccttccaaatatactcactgtccttgcccctctctagctttgccaaatttcaaccctgatttatggttagatttttactaacccttcctcatgctgctgaagaaagttggaaaaaagaaaagaaagaaccaggttggctagttgtgctttgaaattcatgtctattacctaagggactttaatactacttagctcaaaaccattcactacttcattatcctagccaactatctcatac

SEQ ID NO: 202284 - DNA, 665 bp, Homo sapiens
tggatatatgtacagatatagtttttaaatggctctggattgactgtggacatttggagtaaaaacacttttagttatttattttttcagatggagtttcactcgttgcccaggcgggagtgcaatggtgcaatcttggctcaccgcaacctttgcctctcgggttcaagcaattcttctgcctcagactcctgactagctgggattacaggtgcctgacaccacgcccggccatctttttgtattttttagtaaagacggggtttcaccctgtttggccagactggtcttgaactcctgaccttaggtgatccaccccctcggtctccgaaagtgctgggattacaggcatgaggcatggtgctcggccataaaaaaaatttttatttcttatttagctttgcatagtggtttgcaggtacctaattaatatccacctagtgataaaaaaaatataggaaatggtgatgcaaaaaataaatttatctatctcaaaagactatcaaccttctaatttcagatcaccatgactttgtctattgtaggaagttttattgaagtttcttcgacaaggtagtaggcctactgaaggccccatgaacagacaaaaaatataaaaggcagcaagccagatggaaggtattagtaggtactattctccttgg

SEQ ID NO: 202285 - DNA, 495 bp, Homo sapiens
ggcttgagaacactctgtcggtggggtctggctgctttagtccctgaagccccagggtgcggacggtcattagcccctgaacctgtgtggccacatgcagttatgggatggtgtccccaaagatgcagatgtgtatgctttcattcaataatgtttttactgtcagaacaaaaggaaaaatttaacattttcatagaaaatgaggaagacctctatgaatactttcttagacccctggggccttcagactccagtgtgagagaaggttctgggcgattctgatgcatagccaggtttagaaaccagtgttataaaagctttagcagaagtggtgtgaattttgtgcaatgtgactttttcacatgctcaggaactttactcactatagcctgttaggacagtcccctcagtggaacctgcaccacaggcattgtagtccagacagttatcctctttcctgcctgggattagccccaccaccacagccttccccag

SEQ ID NO: 202286 - DNA, 640 bp, Homo sapiens
ggggtacacagcctcgacgtgagacattcttgccaaaagcaaacccgggtgaatcagagctggagaccttatttctcatttatgggaaattaaggggacagaggaataagtttatgaccccacaaggaaacagatccaggaaagggaacgttctgtaacacattggcctgcccattgccaaagaaaatgtctttgaaaagaaaaaaaaaaaggccaggcacagtggctcacgcctataatcccagcactttgggagaccaaggcaggtggatcacctggggtcaggagttcaagaccagtctggacaacatggtgaaaccctgtctctaataaaaatacaaaaattagctgggcatggtggtgtgtgcctgtagtcccagctactggggaggctgaggcaggagaatcgcttgaacctgggaggcggaggttgcagtgagctgagatcccgccactgcactccagcctgggccacaagagcgaaactccatctcaaaaaaaaaaagaaaggaaaaaaatctaggtgtggtagctcacacctgtaatcccagcactccgggaggcggaggcaggtaaatggctttagctcaggagttcaagaccagcctggacaacacagcaagacccgtctctacaaaaa

SEQ ID NO: 202287 - DNA, 608 bp, Homo sapiens
tatgttatccccaatggaatccgcacataatttatgctctactgacggtatagatgcttgttacatctagtcctacatacatacaaatgtaagaatagcatgcatcattcagtgttagaaaatgtttctcaggtgctatacgcaactgtggtgaataccaaagtgatttaagtacctcaggaatcagaattggaatgtgaaaagaacacgaatgctcagcataccaatatttcaattaggcaagagctaattgctttcatgctaaccacgtgtaaggatttggcaggcaattatgtttttttctttcttaagtgcttcctcctctggaatccttcctctaattggaacagtatctgctttgacatcagtggcatacaacccacaaactctcatgacctttgtatgcaggtgccttgtgtgttgggagcataggtcaagagatatcccttggtgagcagtgttgcacataagcgttggtgtttagggctttaggtcatgctgtgccagcacagggcatggggtcctgagagacgaaagcaccatttgcctgtaacaaagcaacataggtattggggtgcataaaatggattccattaggggggggatcc

SEQ ID NO: 202288 - DNA, 1096 bp, Homo sapiens
  misc_feature (898)..(898): n is a, c, g, or t
ccctcaccggaagctgcacgctctgggaagcgcagaggcgggggtgctgctcgcgctggggagcacgtgaggggacactcagggactgcccgcgcgaatggcttccaacgcatgcgccccaccccacatttcacagtcgccatgacgaccgggaggtccgcaacggctgcggggacaagtccgttgaggctgccaggttacatttagtaacactttttgaaaatgatcgtcatttctctcacctctcatctttggaacgggagatgacttttcgcactgaaatgggactttattattcatacttcaagaccattattgaagcaccttcgtttttggaaggactgtggatgattatgaatgacaggcttactgaatatcctcttataattaatgcaataaaacgcttccatctttatccagaggtaatcatagcctcctggtattgcacattcatgggaataatgaatttatttggactagaaactaagacctgctggaatgtcaccagaatagaacctcttaatgaagttcaaagctgtgaacggattgggagatcctgcttgcttttatgttggtgtaatctttattttaaatggactaatgatgggattgttcttcatgtatggagcatacctgagtgggactcaactgggaggtcttattacagtactgtgattctttttcaaccatggagaggcacccgtgtgatgtggacaccagctctccgtgaaaagttttcctatccttccctgtacttcagatgtgtttttcaccttgatctcaagaccttagcatggatcgaaggccctcatggacccggtttccaaggtggctaaaagctacctgacaaatgggcccagatgaatacttttaacccgatcaagccattcttaatttntcccagtaatgtgggggcatcatgtaacccagcgcagatttccgaagaaccactattgtaaccagaatttcgtacccgaagatgaacaggagtgtgggacatcctgcactttttcacatagtctcacctgctatcgaagggccgcacctaagacagctaacgtcacacgacggcggtataatcacataggtatgacgt

SEQ ID NO: 202289 - DNA, 1061 bp, Homo sapiens
ccctcaccggaagctgcacgctctgggaagcgcagaggcgggggtgctgctcgcgctggggagcacgtgaggggacactcagggactgcccgcgcgaatggcttccaacgcatgcgccccaccccacatttcacagtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggaggtggaaaagtcggtcctaggcggcgggaaactgccaaggggcgcctggaggtcctccccggggaggatccaaagtctgaaagagcgaaaaggcttggagctagaggtggtggccaagacctttcttctcggccccttccagttcgtccgtaattccctggcgcagctccgggaaaaggtgcaggaactgcaggcgcggcggttctccagcagaaccactctcggcatcgctgtctttgtggcaattttacattggttacatttagtaacactttttgaaaatgatcgtcatttctctcacctctcatctttggaacgggagatgacttttcgcactgaaatgggactttattattcatacttcaagaccattattgaagcaccttcgtttttggaaggactgtggatgattatgaatgacaggcttactgaatatcctcttataattaatgcaataaaacgcttccatctttatccagaggtgagtcataatttgagacaaataatatttgtagagtgatcctctttgtcagataaaaatagtaagcacaatcttgttaagaaagggaggggacgtttcaggtttattaattgtgtgtatccttatagttgagtagaatatcataagttcctctcttaaaatttaaagaccccagaaactgttctctcatgaactc

SEQ ID NO: 202290 - DNA, 1539 bp, Homo sapiens
  misc_feature (1341)..(1341): n is a, c, g, or t
ccctcaccggaagctgcacgctctgggaagcgcagaggcgggggtgctgctcgcgctggggagcacgtgaggggacactcagggactgcccgcgcgaatggcttccaacgcatgcgccccaccccacatttcacagtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggaggtggaaaagtcggtcctaggcggcgggaaactgccaaggggcgcctggaggtcctccccggggaggatccaaagtctgaaagagcgaaaaggcttggagctagaggtggtggccaagacctttcttctcggccccttccagttcgtccgtaattccctggcgcagctccgggaaaaggtgcaggaactgcaggcgcggcggttctccagcagaaccactctcggcatcgctgtctttgtggcaattttacattggttacatttagtaacactttttgaaaatgatcgtcatttctctcacctctcatctttggaacgggagatgacttttcgcactgaaatgggactttattattcatacttcaagaccattattgaagcaccttcgtttttggaaggactgtggatgattatgaatgacaggcttactgaatatcctcttataattaatgcaataaaacgcttccatctttatccagaggtaatcatagcctcctggtattgcacattcatgggaataatgaatttatttggactagaaactaagacctgctggaatgtcaccagaatagaacctcttaatgaagttcaaagctgtgaacggattgggagatcctgcttgcttttatgttggtgtaatctttattttaaatggactaatgatgggattgttcttcatgtatggagcatacctgagtgggactcaactgggaggtcttattacagtactgtgattctttttcaaccatggagaggcacccgtgtgatgtggacaccagctctccgtgaaaagttttcctatccttccctgtacttcagatgtgtttttcaccttgatctcaagaccttagcatggatcgaaggccctcatggacccggtttccaaggtggctaaaagctacctgacaaatgggcccagatgaatacttttaacccgatcaagccattcttaatttntcccagtaatgtgggggcatcatgtaacccagcgcagatttccgaagaaccactattgtaaccagaatttcgtacccgaagatgaacaggagtgtgggacatcctgcactttttcacatagtctcacctgctatcgaagggccgcacctaagacagctaacgtcacacgacggcggtataatcacataggtatgacgt

SEQ ID NO: 202291 - DNA, 423 bp, Homo sapiens
gcccccctgaggctccgtgttactgtggtctgcacggtcagagctgtccagccctctggaacccatggaagatgactcccttctgctgagtattcatgggaaagctgctttccttctagaagtaaagagataagtttgcagctgggcacagtggcacacgtctgtaatcccagcactttgggaagctgaggcaagcggatcacttcaggtcaggagctaaggccagcctggccaacttggtgaatccccatctctgctaaaaatacaaaaattagccaggtgtggtggcacgcacctgtaatctcatctactcaggaggctgaggcaagacaatcacttgaacccaagaggcagaggttgcagtgagccgagatctcgccactgcactccagcctgggtgacagagcaagactccatctccaa

SEQ ID NO: 202292 - DNA, 237 bp, Homo sapiens
  misc_feature (69)..(69): n is a, c, g, or t
gctgtctttcccttccagcctggaagtgttgcagaggtgtgcatcaccctttgaccaggccaacctganccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctttgctccctttga

SEQ ID NO: 202293 - DNA, 1664 bp, Homo sapiens
tgctggtgcacatgtgagcaggcagatcttgccttctctgccctgccagtgtgcatgtgtgcatgtgccctgccctgccactgctgctggcatgagtgaactcagcctcctcctccccacaccatgccatcattgcagtcaaagccttggcaggcacagagtccaccagcctcaccttcaccagtgccttgcccctgcactaacactgctgctggagtgaaactaggcagggagaacagtggacttaccacaccctgagcagccacccttgcctgcaaaaactcagacagagggtgcacgcagaccagcacctgccagtctcccgctcccatgctaacaccactaccagcgggacagcatgcgaagttgccattgggcgtgaggggcccaccttcccatgtcatgctgcctccactgctgctgccaatgcccacatggaggctggcacctgggcaccccctagcaccctgccatagccaatgagcatgcaccctgctgcgctgccactgccactaccactggcacatgtgaatgaggacagattccactgccactgccctacaaaatgctttggctggcaccacccattggagtgttgtgaccagcagtcagggagcaccttggctgcacccagcacagtgggttcctaaccttgaggagccagagaacgaagttgggcctgataccaatcccctagggttagggtatgcagtctaggagttggaagcctagctttggctccctgaaattttccagaaatgaagccagtcatttgaactcatcttataacacaagcaaaccctcaaggtcatcaaataggatacaagagaaaaaaaaaccatcccaaggacagcaacttcaaagactgaaggaacatcagtctgcaaacatgagaaagacccagagcaagaactctgaaaacacaaaaaactagagtaccttctttctccagatgaccacactagctctccagccagggttctgaacccgcacatgtacccctaaacttaaaagatttttaaaaaagagattcagagaaggactgtagctgtggacccaagctcccttcaaagcactggcaggtcaatcgtttgcaacacagacagctgtatgtagagctctgtgatccacccaattattggctcatcaaggagtgtgccacatgccagatgctctgcagaacccaacagaggggttgctcctccatggaaacaacaagaagctttgatcaaagagcctgtattgactccttcagtgaaattcttgactgaaataatcaccttcttaaaatacacacatggtgaggtttgaagaggggaaattgccatccaggtaagaaaccttggccttgtcccaatttagtagtgctgaaggtgtgttcatttgaacatagatcatgtgctaggtactgggaggatacaggaatgagcatgggaataaactttacatagctcttgttcaagcaggaactttacaatctagttagaataaagaattatctgtgagtcctggttggacagtgtgtatcccagcactatctaggggtaaggatgccttcataccaacctcgtcatgactgtgctaagtggcaggtctgatttggttatagaactggatacatcagacagttttaactttatgctattaaatatttgaacatatca

SEQ ID NO: 202294 - DNA, 1672 bp, Homo sapiens
tgctggtgcacatgtgagcaggcagatcttgccttctctgccctgccagtgtgcatgtgtgcatgtgccctgccctgccactgctgctggcatgagtgaactcagcctcctcctccccacaccatgccatcattgcagtcaaagccttggcaggcacagagtccaccagcctcaccttcaccagtgccttgcccctgcactaacactgctgctggagtgaaactaggcagggagaacagtggacttaccacaccctgagcagccacccttgcctgcaaaaactcagacagagggtgcacgcagaccagcacctgccagtctcccgctcccatgctaacaccactaccagcgggacagcatgcgaagttgccattgggcgtgaggggcccaccttcccatgtcatgctgcctccactgctgctgccaatgcccacatggaggctggcacctgggcaccccctagcaccctgccatagccaatgagcatgcaccctgctgcgctgccactgccactaccactggcacatgtgaatgaggacagattccactgccactgccctacaaaatgctttggctggcaccacccattggagtgttgtgaccagcagtcagggagcaccttggctgcacccagcacagtgggttcctaaccttgaggagccagagaacgaagttgggcctgataccaatcccctagggttagggtatgcagtctaggagttggaagcctagctttggctccctgaaattttccagaaatgaagccagtcatttgaactcatcttataacacaagcaaaccctcaaggtcatcaaataggatacaagagaaaaaaaaaccatcccaaggacagcaacttcaaagactgaaggaacatcagtctgcaaacatgagaaagacccagagcaagaactctgaaaacacaaaaaactagagtaccttctttctccagatgaccacactagctctccagccagggttctgaacccgcacatgtacccctaaacttaaaagatttttaaaaaagagattcagagaaggactgtagctgtggacccaagctcccttcaaagcactggcaggtcaatcgtttgcaacacagacagctgtatgtagagctctgtgatccacccaattattggctcatcaaggagtgtgccacatgccagatgctctgcagaacccaacagaggggttgctcctccatggaaacaacaagaagctttgatcaaagagcctgtattgactccttcagtgaaattcttgactgaaataatcaccttcttaaaatacacacatggtgaggtttgaagaggggaaattgccatccaggtaagaaaccttggccttgtcccaatttagtagtgctgaaggtgtgttcatttgaacatagatcatgtgctaggtactgggaggatacaggaatgagcatgggaataaactttacatagctcttgccatcccggcagcacccactattttcagtctcctcccctatgtcctggtttggattgccctgtgcggatcctggtcctatcccgcagtaagtaatgccctgtcagtcccttgtagtgtgtgtcaatggtggcaggttggatttggttattttatatgatgtatatccagggtggggggagtgggcggttttcatttttcgtcaccatttcatgaa

SEQ ID NO: 202295 - DNA, 384 bp, Homo sapiens
aatgaggctgggtcaagctactttaagcaaagaggatttgcctgcttacctttgacatgcaacctgagatactctgaaaacagaaaaattgctgttctgcctctaccaagctgcccagaatggctggacttcaaataaagcagaaggggaattgggagaacaaacaagagaaagggtagtgaccgatggacttccttataagggaacagtccccagatacacctcattccctcaagcagtaatggacagacaacctaaccaatgggaagcttcacctgggtgctgtagggagatagctgctggtcccagcaaactgctctctagagacagaaagtatccatttggtatgtgtctcgctaaattcaaactaacacagattcctca

SEQ ID NO: 202296 - DNA, 1958 bp, Homo sapiens
  misc_feature (944)..(944): n is a, c, g, or t
agcatatgcccagtctttgtgttatgtttctcatggatgaaaagacagtataggccaggtgtggtggcttatgcctgtaatcccagcactttgggaggctgaggtgggcagatcacctgaggtcaggagttcgaggccagcctggcgaaaccgtgtctttactaaagtaatcccaactacttgggaggctaaggcatgagaaacacttgaaactgggaggtggaggttgcagtgagccgagatcacaccactgcactccagccaggggatagagcgagactctgtctcaaaaaaaaaaaaaaaaaaagggaaggattgattgatttactgagagaagtataaggaaacaaaatgccccaagacccttgtccggaaggaagggagggagggaaaggaaaggaaaggaaggaaaggagggagggagcgaaaagacagtaaagacagtatgaacatttactgagagaagtataattatcaggggaacccgcccccaatatttcaacggaggttctattttccataagtgttggccggctgagaaataaagagtacaaagagagaaattttacagcttggccaccaggggtgacatcacgtatcggtaggaccatgatgcccacccgaacctcaaaaccagcaagtttttattaaggatttcaaaaggggagggcgtgtatgaacagggagtaggtacaaagatcacatgcttcaaagggcaaaaagcagaacaaagatcacatgcttctgaggaaacaggacaagggcaaagcagaactcctgataagggtctatgttcagcggtgcatgtattgtcttgataaacatcttaaacaacaaaacacaggttcgagagcagagaaccggtctgaccaaaaatttaccaggatggagtttcccaatcctaataagcctgagggtactgcaggagaccagggcatatttcntcattatctcaaccacataagacagacactcccagtgcagccatttatagacctccccccaggaatgcattcttttcccagggtcttaatattaatataccttgctaggaaaagaatttagcgatatctctcctacttgcatgtctgtttataggctctctgcaagaagaaaaatatggctctttttgcctgaccctgcaggcagtcagaccttatggttgtcttcccttgttccctaaaaatcgctgttattctattctttttcaaggtgcactgatttcatattgttcaaacacacgttttacaatcaatttgtacagttaacacagttatcacagtggtcctgaggtgatgtacatcctcagcttacgaagataacagaattaagagattaaagtaagacaggcataagaaattataaaagtattatttgggaactgataaatgtccatgaaatcttcacaatttatgttcctctgccacggctccagccggtccctccatttggggtccctgacttcccgcaacatataaggaaacaaaatacccccagctccttaccccagacccttgtccagatagaaatttagacttattaatatattgaattgttcaagtgtccatatactaagaattacatcagcgatgtggaactatggataggcttccttgggttcctggctccacactataaccaccgccccccaccccttaaatttctgtatagcagacttaagagtgaatatcaccatatgcagttgttcatgtacttcttcccctttctcttctagctcttgacaaaattctcagggaaaactcttcagctctggatgtctccctttttgtggatcaaacacaaagggcatcattctaaaatatatacagaaccataaaagccccaaatagccaaagcaaccctgagcaaaaagaacaaggctggaagcatcacactaccagacttcaaaatttactacaaagctctaatacctaaaataacatggtactggcattaaa

SEQ ID NO: 202297 - DNA, 350 bp, Homo sapiens
cagtcaggttttaaaatgcatgtatctttggatacagcagtcccttgcacaaggatgttcatcatggcatcacttatttacaaactggaaacaatgaaaaatacctcttgataggaaattggtaaaataaattatgctacatccaacttagtgaataccctgcacccactgaaaacagtgaggtggaacagatgaacttatgtaatgagcgcccagacatctgactgttttgtttttagtgactgtctttggagagaaggactagatctgaatgaggaagatatatacacacatgcacttttttgaacccacagatgcagaatatattgtatggatgcacataacttttt

SEQ ID NO: 202298 - DNA, 712 bp, Homo sapiens
acgagatcatgcgtatggggttcacgctgggaggcagtgcccgggccccttctttcacagctggagttttggcagcctgtcctcgggttgttcagcctggtgaccctagccgcctgtgatttactaactgttttacaaatgtttcctcgctctgggaggtttgatacactcttcatcctcctcagctcaccagagtcactcagtctctgagccaaacctgcctttgtttacaacttttccggaaattttcacagagggagagaaactctccctcctctttcagtgttttatttttaagtcaacacttttctcaagtttatttgtgctaaaccaaattctcctacaaggtattgctctgtattcaaatgggaattgctgcatttctataaatagaatgaaggtcatgtgaacgagttcagaagattctagatatcacattttacgggacctttacatttagttcactattttttgaaaataatattctatgtatggatttgtcttttattcccacattcatatttgactgcgcattatgtgaaaaattgaatttgggaaacattgagtggaatattttataagctgaaatacccatgttaaaaataacaaaatgtgtggttgcttcatcattgtaactttcttaaaaacagaattataggccctttatataatattcctagaaaataatgtctcttaaaaacagtacagggta

SEQ ID NO: 202299 - DNA, 606 bp, Homo sapiens
tttttgggcattttgccactgtgtgctgaggtgttggcaggtttatgtcacagccagctaactgtttctagattttcctagagagctttttagtgatttaactcttttgccttgcctcggagtgtctgttgtagggatgaagttcacgtgcgttcgcttttagggaataaaatagtcattaatgctcaggcgagtacaggaacaaggagagttgatgttactttgtagtgaggacagtgcttcaagacagatgaatgacaactgggaatatttcctgccacgtgaaatgtgggaaataaagaatcaccatgaatccatcaggcccttagaagcttaaatgctgctgttgtctataaagtttagtcatatgcattcgtaactttattatgaattataggagaacagataaaaatagcaaagtagccttatcaactagatgtagtttcccctccaaagaatttattaataattttatttaaagaaaatcttttgtagtttttactacttaagcaactactttcttttaaagtggtcaggaaaagcaatcatacaaaataaagatatgggagaaatttaaacattgaaatattttggagtttgtatgcc

SEQ ID NO: 202300 - DNA, 829 bp, Homo sapiens
gtagtacataactggtttctctaaaacatatggtagttatagcaatatacactatttgaaaaagaaatggtggcctagctagcttatttcagttttcgccttactgaaaactcacagatgtagattcggccaagaaagctgaaagggcctttcaagtattctcctggcattctgagactaaaggtgtcatgatcaccctaagccatttggaaattgtcatggcaaattgtgcaggaaaaatggagacaatctaactgtatatgagaagaatgagtaataaactgtggcttagtcattcaatggaatactacatctagttcaactgaatgaaaataatctccatggatcaacttggacctcccaggccctggcgtgaaggtggcactgtgactagctcttgccgatggaatgggaggagtcagttagaaattttcatatggtcaaaatacccatggaatatatgagtggcagcagtaaacaatccttgaagttcttgcttgtttaacttgactgttggtgatgcccaatgaggccctgtctgctccaagcaaattacataaaaaagatgtgaataaaaactcatcaaatactaacagagactgtgtctaagatgccaattgaagactggaacagccatatgagtgtggggtattcctggaaacctgttctagtaggcactggagaagacacaggaacctctcaatacagaatagacacactttgcactcagtaataatgcactaattgacgaatatattgacggagtgttggtttgcttcacaatctgctggtaaacatattcatttttgggtgaatttcaggccttata

SEQ ID NO: 202301 - DNA, 421 bp, Homo sapiens
ctctttgcaattactctttccccttctgccctccttaccaacaccaagctgcaagtgtgtccaggttttaatcagcatgacaatcctacctgcactgcagcatcacccagcaaatgctcaagcctggaccgcttcccccactgtttcctctgtgaacatgcttccattcatcctgtctgatgtgctgtaacctctcagctgatgaacctgcccacccccatacatttgccgccaggtattcattgttttgtatactttccaactatcattttgacgatgcccgacgagggggaaagtctccatttgccagcctctacaaaattagaaaaatacttgtaaatgtcctttggagaatatcaccaagttttatgagaaagaagggctataaaaaataaaaagcagcggctaatagcattctaaa

SEQ ID NO: 202302 - DNA, 584 bp, Homo sapiens
caggcaggcgggaaggggaagggaaaaggggaagggaaagggaaagggagagggaagtagggaagggagggaggaagggaggaaggaaagaaggaaggaaggaggaggaaggaaggaaggaaggaacaatggtatgtttttgaagagcagtttcacagtaagtaccaaaattatttaaaaatccacttctaggtgatctactcaagagaaatgaagacatgtctacacaaaatcttgcaggcaaatgttcacagtaccataattcataaattagccaaaacatgaactctataatatccatctgatggatagataaaatatggtattattcatataatagaatactttcgccaataaaaatgaacaaactactgatacatgctacaacaagaaccaatctcacaattaagtaaaagaagccaaatgcaaaagtccatctatactatgaccccagtactataaaatgtccagaaaatacaaatctttgtttgttttgagacagtctctctctgttgcccaggttggaaggcagtggcgcgatctctgctcactgcaacctccgcctcccaggttcaagtgattct

SEQ ID NO: 202303 - DNA, 216 bp, Homo sapiens
ctggctcctgttttggccaagaatatgtggattagggtcacaggagggcgagattttaatttcacaaaaatatgtaaagggaagggggagaagggggagaaaaaaaagattacttgcagagagcatgagtaccaatgggaggcatgcttaggtgactaacgacacctctatcagaagaacaaactcgatctgcatcaagcattgagacagatgagg

SEQ ID NO: 202304 - DNA, 102 bp, Homo sapiens
tataatccctgactctagaaaatataacttagtggtttgaagcagacaataaaaaattgtcccattggctgggtgtggtgcctcatgcctgtaatcccaaca

SEQ ID NO: 202305 - DNA, 265 bp, Homo sapiens
ttttctcttatagccattcttgtgatttttacaaatgactgcaaattacgttactctagacaaaaaggggagtacaggagccaaatacagcctgtagacactttttgttttgccctcaaagtttctttttttaaaatctgtttttttggtggtggttattattattatttttttgagacagagtctcgctgtgtttcccaggctggagtgcagtagggtgatcttggctcactgcaacctccatctcctgggttcaagtgattct

SEQ ID NO: 202306 - DNA, 422 bp, Homo sapiens
aattacactgacaggaaactaaaaatgaaaccatgaagaaataaatcgtgataatgggggaaaatgacctaagccatgagaaccctcactccctaggccagtgattcaaatgcactgtggcacgagttagacgagacagctcaatgccatgcagcgtgctactggcaagtaccgttgttatcttttggaagtaaaagccttttgcttctgggagcttaggagcatgtaaaaaaaaaaaaaaaaaccttagtagcagaggcctgtaacatctgtacactgaaatccatttactgggctctttgaggaactatgggatagcttgcagggctgaggaggaaaggatgaaataaaacttttttcccttaggccgtgtgatgaggaaatggtggagaggacaagttctgtactctcggaaccagtgg

SEQ ID NO: 202307 - DNA, 199 bp, Homo sapiens
agttaaagaggcagggtgacgtaacacaagaaatgtgggctttggggtctcttaatttctctgaagtttcctgtggatgaaatgggcataacaacatccaccttagcagcttgttgtgaggattagagaggaagttacatacacacagcagctgctcagtcaaaggtggctccattcattttttttttttttttttgga

SEQ ID NO: 202308 - DNA, 197 bp, Homo sapiens
tggtgttgccagaagcttggaactgacgggtcagcagagaagaggcagaggccatgaccttggggtggtcagcagcactgggtgtccgccctccaggcctcatgcctgtgactgtgcagagaccgagctgaccaggacttgctggccagtgtggctgtcaggctggtgatatcggggtgtgctttccatgtgatgtt

SEQ ID NO: 202309 - DNA, 602 bp, Homo sapiens
gatacaaagcattttgctgagattactggcactatataaaccctgcactcccagggagcagtagaaatcttgagaatggatccattagagtgtaaggcagacgttaaagatggagaaaccaacttctaatgacagcttggagcatctggatctagtcccagactttttagttataataactgcaagaaaaaatctacatcctgaaagggttgaacccatcttgaaaatggcaaaatctccatcctggtgatcactggcaccatcactcccagtacagccatcactctatgggatcctgggcactgcttagcactaggaaggcgaatggctttaaattatgattcctgtcctcaagagataagtcacattgttgaaaacctgacatcaacgtacaaagattcataatcataaaaggtaactcttgtggccatgggtgcagtgtctgccatgcagaggagaagccgctggttgtagcagcaacactccagcttacctggagcaaagtgcataaaggaaaggccatgtgaggacacagcaagaaggcggccctctgcaacctgaccagcaagatctcaccagaaaccacccctgcttgcactgtg

SEQ ID NO: 202310 - DNA, 463 bp, Homo sapiens
ataccaaagagcagcatttgtcaataacaggattcaaaggacacatgtccagcctaagaggactccatcttgtagaaattctaaaactatttctattgagtgcataaaattgtctcttttaaattgaataaaaaaacagtaggccggacccagtggctcatgcctgtaatcccagcactttgggagactgaggcgggctgatcacttgagctcaggagttcgagaccagcctggccaaaatgatgaaaccccgtttctactaaaaattggctgggtgtggttgtgcacgcccctgtggtcccggctccatgggaggccgaggcaggagggtgtcgtgagtccaggaattcaaggctgcagtgagttgtgatagatcgcgccactgtacttcagcctgggtgacggcaagagcctgtctctgaaaagtttcatagaagaggttagtactagacaaagggaaaca

SEQ ID NO: 202311 - DNA, 304 bp, Homo sapiens
ttcactttctacaccctgcaagagggccctgtggggaagggaatacaacaggacttccaaagtgctggtaaggatctctttcttgatctgagagctagttacatggatgtgtttggcttgtgaaaatctatcaagctgtaaacttacatatacatttctgtatctttcatttacttcagtaaacagtttttaaatggattgctttaatggcagactagatgtggctaaagagagaattaataaaaagggagagattactgaagagattacccagagtgtgtcagagagaaaaaaaacgatggaa

SEQ ID NO: 202312 - DNA, 484 bp, Homo sapiens
tactactactaaattcgcggccgcgtcgacagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaaaaatataaa

SEQ ID NO: 202313 - DNA, 543 bp, Homo sapiens
ccaacaccactattggagagaaagtggagaatgtgtattagaagtactagtctttgaaggcaaaacagctgtatagagtgagcttaagtgctggatccctgtggttaggaagggacactaagcctccgggatgtgagagtcccatggaaggcagtaggcccaggataaagcaggtgtcagcacagaaagcccaccatcacccagaaaagggaagaaatacgctaccaccatcactctttctgccaatgacttctttgcacacctccaccctatctcctggctcagtctcccatgttctcatagctagggaggtctccattgtaatttgtatggggaggttaacctataggccattctgatgatcccagctccctttcactacaacccccgtctgcatcctttgctttgcagtaggatttgagagaggaaggatgaagatgtagccacaggatacatttaaacaggcacagagtttgaggggtgggggggaacaaaagcaaaacaataaaaccttcaccagtcattaaagaaatgaaaatgaac

SEQ ID NO: 202314 - DNA, 411 bp, Homo sapiens
agaaaaggtctgaaaagacagtgttttccagaaggttaacagtcatcaattcagaggattggaataggttgggggtataataaaaatggcttctagctttatgtttgaaatttttattgtgaggctgtgtttatgcattgtgtaattaaaaagaggtaaaattggccaggtgtggctgcacgcctgtaatcccagcactttgagaggcgggcggatcacttgaggccaggagttcaagactattctggccaacatagtgaaaccccatctctacaaaaaatacaaaacttagccaggcatggtggcatatgcctgtaatcctagctgcttgggaggctgaggcacaagaattgcgttgacccaggaggcggaggttgtagtgagctgagattccgccactgcactccagcc

SEQ ID NO: 202315 - DNA, 348 bp, Homo sapiens
aataattgaaaactaaaagcaaacttcctatattatctggtcaacttttcaggtaaaaacacttggtaaagtgtaaagaaagtgtgacaaacttaatattgttttagtgatttctccaaattaacatgaaccagtgaagttttactattgtcagaaacttgaaacaacccagatgttcctaaaaatctcatgtatggagtgggtaaataatattgcttatagtttcatagtaactgcttgactcagaaatagtcaggttgtaaatttcaaatcaatccctagaacctcactgcacaaaacaccaggtcaagaaaataattatgtttgaggtttacggtttaggatcca

SEQ ID NO: 202316 - DNA, 621 bp, Homo sapiens
tgtattaataaatattaaatctatctcatgcaattttccctcaaactatttttcatttggaatttccttatttttttttaactgcaccttttttgtttagacacacaaatactttggaatttcaaatttatagaaaagttgaaaagatagtgcaatgaaaacccatataccctttatccagatttatctaaatattatttaacattttgcctcatttattaattttttttccatatatatacacacacacacacacacacacacacaagcacataaaaataacaggagtggtagtggtaatgtcaatgtgttctaaacagggacatgtgtatttagagctttatatctctgagtgtagaatgaaaagttttaagaatatgtagatattattgcgtgtattttaagtagatatttttacataattagcaattataagtgtagacaatattaatttcaaatatgtacagtctgaaggtaaaataactatgagagttaaataactatctctatatatgtagaggctcgattattagatgaccctcagtttgatagtctttgtctagatacaatagacaagagcacagtggtatgcataagtgcagaagggtaacgtgatataga

SEQ ID NO: 202317 - DNA, 356 bp, Homo sapiens
aaaatcgcttgaactcgggaggcagaggttgcagtgagccaagatcgcaccattgcactccagcctgggcaacaagagtgaaactccttctcagtcttggttacctctggggcttgacgggccctgtcctgccccacctctctctacagcctctggccatttattttagctgcccctccccacacaccagcctctccaggcccctgcatcacagtcatctttctaaagcacagtacagctcagcctgttgaagaacctgccttggctcctcgttgcccagaaattcaatgtagacatccttggtaggcattcagggtcccttctggtctggcccaccctgccttccacgcccatct

SEQ ID NO: 202318 - DNA, 854 bp, Homo sapiens
tttttaagctttaaaattgtctgctttaaattgtcttcccattcagatatatcaaaacaatatataattatttacaatcttgctttcagatttgcttagaaaaagtattaagcaccaaaactgtaacaatgggggttgtttgtgtgttttggtagagatagtttccctatgttgctcatgctggtttcaaactcctggtcaaaactatcctctggtctcagcctcttaaagcgctgggattataggcatgagccacctcacctggccaaaaaatttgtgtatttttgatgtgtacattaactagagttaataattatgatattctttgcttattgatgtttagcactcagttttgtttttgtgttaatattttccttctgaagtatcacctctgtcgttatgtttaattattcattactttatagagttcagagatttcaccaaattaaaccacaaatcagtctaattttctgtctacttctgttgttgatgtagaatatattttactcagattttcccaagcactactatttgaccaactccatggtttatagcatgtcatatacattgacaggttctaccaacaagtgtattttatagcctctaccagaatagaagttctctcatcctctaaccaacctaattcctccagacccacgtcaaacattaggagttcctctcatgccaagatattttttaagttccttaacttttaaagtaccccagcacctctgattagtttcactatattaaaatttgactttatgtcaaatctctaataaaatttgactttgtcagatctctaataaaatttgactttgtgtcaaatcgctaatttcctcttccactgaaaa

SEQ ID NO: 202319 - DNA, 562 bp, Homo sapiens
ccttctcttcccaggcacagagctagactctagttcccaaccttgcagttatctgtggccacaagactgggctctgccaatgaagcctaaatgaatgacatgggcacttccaggctggcccacaaacacctctcacacatgactcgccattctagttcaccgcctgcttgctaaatgcagaggactccaaggttctggaggaggacagtccacaagatacaaggagctcaggtctcagtccccatatggaagacctactgccaaccagcaacattcgcactgatccctgacgagagaaaaataatggcttattttgttaagctattaaaatgtggaggtttggccaggcgctgtggctcatgtctgtaatctcagcactttgggaggccgaggtgggcagatcactgaggtcaagagttcgagaccagtctggccagcatggtgaaagcccatctctactaaaaatacaaaaattagctgggcgtggtggcacatgcatgtaattccagctactcaggaggctgagacaggagaattgcttgaacccaggaggtggaggtag

SEQ ID NO: 202320 - DNA, 632 bp, Homo sapiens
gagatacggctatctaagtagcgtcttccatttcaactaaaaaattttctcaggtgcaggcctgggacttacaactcatgattccagttccagcttccttaaggtgaaacacattcatattttaaaaccaaattggcatggatacttcaagaggtagtacattccctctcgttggagagacttgagcacaagctggttggctatttgtttatttttattatttttccatctccctctcctagtactggttggctatttagagggcatactatgatggggatttaagaactgctcagacggccagattagattacccaatcaaacactgacaggctttgattctagcttgttctccagtctgcaaatgtcggtacccataatgttctactctttaaatagaccatgcttttccttctcagggtctttccctatgctgtgtgccatgtgtatgtgtttttaaattttcctggaacatcaatacttcccacccctgtacatggctagtgtagacctttttttttaattgttcaaatgttaatttaaatgttttctgcttagagaggccatttctaatccgtctgtctatatagatacattatgttattctctatctctgaatctaatttttcccc

SEQ ID NO: 202321 - DNA, 195 bp, Homo sapiens
ccttcagcgtgagccttttccttgctggaacgtggtcgttggacactacgagcttgttttaaaagcacaggtctttggtgctaagaaggaaaagggagaaaatttgacttgtatatgtacgttattaaggagaaatgtcaggacaaggggctggtatactgggtagtgtgtgaaataaaaaagcctgcgactctt

SEQ ID NO: 202322 - DNA, 518 bp, Homo sapiens
cagctcttggaaggatgggctatctcattagtaccttacaacttccaatgcattgtcacatattggagttgggaccagggtgaggcaaaagaggcctttaagagtcatgcaagtacactggcctctgtcctgccacatgccttatctcacgtaatacccatctgacccttgtctggctatttagttggtttcggggtggagagagcaggggaggtaaggagcagagatgggagagaggacaagctggcagagactctttctctatgaaaagccttgcctgagtcactccttccctcacacttgcatgttactccatccaaacgaaaccagccccttttgtgacttcacaaaatctatactcacactccctgtcactgaactccaggtccagaaaactatgccccctgtgtttggctttaggccaatgtcgtgagatattccacacagacatgtgctgtatcttcttttaaatgttgtgacttttgaccccacaaatctagaatttgtcatctttcaaa

SEQ ID NO: 202323 - DNA, 146 bp, Homo sapiens
ccagctgactgagccccctctgaccaggccctcactgaccaggctccaagccactaaggccccacactgaccaggcccgtgatatattgtgtatgccccaccaaccagtttttcattgtttatgttccaacagatcaggccccact

SEQ ID NO: 202324 - DNA, 194 bp, Homo sapiens
ggtctggagttgggtgtgcctccctagccctatttaggccccatctccatgatcgatgctaggtaaatgtcttcttaagaaatagagccagcccctcaaatccagatctgggaaccaaaggcatgcacgctagaaggggcactccctgcttctctttctacatagcgttggagaggtattttcccactgtgtga

SEQ ID NO: 202325 - DNA, 600 bp, Homo sapiens
tcaattagccctgttgtttgtccatgattcatcaccctctttcatcctccttacccagcttagattccatggttcatcactataatcacacctataactcttttgtccatttcctattgtacttacctagcaaagttccatctgtaattaaacttgactctgaattactccaaaatccaactgaagcagcctaacatcacgggagaaagctgcacaactgtgcagactgatttcactttaagtctatgaccacagatttcaaatgggcacgtgatattgtctaatggattccaaggctacctgctttttccccaagacaactatcacaacccttccttttcttcctaaacctttcatactcctctgcttagtcatgctcagatggggaccttgtcttatgcatcactgaaaattgaagcaattaagcaagaactaatcaccttcccaccatcaacctaccttcacctgtaccgtttcttattacagcagaataaacacatctgttcaaacccctcaatcacgcgttagattctgcttcctctctcctaatctcagacattgcttctgcaattattcactgtttctcttttttcttttctt

SEQ ID NO: 202326 - DNA, 569 bp, Homo sapiens
ccagtccttcttcctgctaaagtcagggtttctgattttaatcaaaaccctagggccatcttaagcatgaccaaaaaagcaccttgcaagttgaaccttatctaattatgcaatgtgtataaacttgagacacataaatctcagtcattggagcaacttgtttttctaagatgctccggtccagtgaaagacgaaagcaaataagggagagattgatctcccagcacttttattgtcagtgctccacacgtcataaagttttggcttgttaaaggaaattccataaacaacttcagttagtaagagtgaagtaactgtgtgccttcctgagcccctgctaaattccctttccgcttgccattacaagagtatgattaagaaaatgccaacaggatatgcgagtgggtggaacagacttcagctggaagccatacagatgcttgatggatgagtagtgacagtgagatgatggccctatctccagagagaatcaagcagtttcatggatctctttctagtactcatttcagtaagatctgctgcgttgctgcatggttgttccgttttgg

SEQ ID NO: 202327 - DNA, 385 bp, Homo sapiens
gtgtatctcattgtctttcattttctaaaatgtaaagatgggaaacaaaatgtggccgatttattgtggcctgagcagtatctagggaaaaactgaagggaaggatagactatgagcttttttatgttttacgttacattattagagattatgtagagaatagaagggtgttttgatcaattttgataaaagtttgtacgaattaaaaagttctctttggtgtgatacttctcaaggtattaatatgctaatgtgcttgtgaatatcttagagaaggataaagtatagtaaactcttgacttatcaattatccctatggactacattttcattaacaaatattaatgaatgtgcctccatgagaagcattggactctgtttttta

SEQ ID NO: 202328 - DNA, 204 bp, Homo sapiens
aaggaatttccaagtatttgctggtggaaaaagagcagaggctacgacaagaatgatttagggttgtactttcagaagaattatctacgacagtaatataagtaatacatttatataagctttcaatcttaaaattctctagttaatatctgaagtctcccattcaatatataaatgagattttcaaaaaaacctagtaaacac

SEQ ID NO: 202329 - DNA, 103 bp, Homo sapiens
atgcttacttcaagaagaagaagctgcggaagcccagacaccaggaaggtgagatcttcgacacagaaaaagagaaatatgagattacggagcagcgcaagat

SEQ ID NO: 202330 - DNA, 245 bp, Homo sapiens
tgaggggctgagtcggtagcagagccaggattggaggcccgctactaggttttcggtccgtgctgccaacatggcactgggagggctgagggcctacagccggctgctgacatgtaagcaagctgtcagtgttgggaatgggaccctacacactggcctagctgcttgtgagtagacacccacgccatccccacccacaccatccccatgacaggatttggggccatcccccacccccagagcca

SEQ ID NO: 202331 - DNA, 685 bp, Homo sapiens
tgcgggaggaggtaaatagagacataggccaaaagaaacagtacagagagaggagacaaaagatagcacgcctaatctgcaaacatatctgaaaactaacatttcaagacctatggcaaagtgcctagcaactctattaagcatgtttatgcccactgtacagttgagaaaggtccacaaataatttgcccaaggacacacacaacaagtaaatgataaaccaatacgtgaagaaaagccatccatttgcaaagccttgacctcatctattcaccactcactccaggcacaaaccagcctggtggaagagcaggtgctctgctgactgggcttctggtcccaggattgtggccagagaagagtaaccatctgggcctattcctgaagcaaggacaaagtgctgagtgctatggccaacttctggtggtctgccatgctggacatatctcattcacttttacccaggagtgtgcaagtagaagcaggcagaacgcagcagaagagaaggtattacaaatacctgctggcttgactatgtgctctggaactggctctactgacctactgacactcaaccattcttggacaaataaaagccgggtttgtttttaatgtagcctatggtggggggagtataaagaatgattaaaattattattcaccttgcacattaacttctggctta

SEQ ID NO: 202332 - DNA, 522 bp, Homo sapiens
aaaatgctttgccatgaacatgtattaaaagctattgaagaatataatttgaaaaggaaggagattcttctgctgcattgtctggtgaatctgtctagaaatattcctatgtatatataaatttatgtatataatttaacccacaaataggatcacaaatctcagtggcttataaccactgagatttctttcttttttacacatgggccatgaggagtgctgatcatatgcagccatatcaccaactctactggctccacttggctcccaactgtctttccaggactagtagtgagcgggcagccactctctgtatcatgcatggcagagggcagaggctcagggaaggggagaaagctagaacacaaagacacatttaaaacttctgcatggccaggcgtggtgactcacacctgtaatctcagcatttttggaggctgaggcaggaggattgcttgagcccaggagttggagaccagcctaggcaatgtagtgagaccctgtctctataaaaaataaaat

SEQ ID NO: 202333 - DNA, 418 bp, Homo sapiens
aagtaagtatataaggaaaacagcaagttttggatgagcagagtctttgtaaagaaaggtagtgtaatatgacatttgaaaggaatgttagctgtagaccatggaattacccaaggctagtgtgagaaattggggcttttatataaaagaagtatagattcagtgaaagtttttgagcaaactagtggcatgataagaatcactaggattaactcatcagctaactctaacattaattaagattaggagattctgtaagaataaaatgattgactcacccaacatgtatttaataccaactatgtacaatgtactgctaagaattacagacttaagtaatagaataaaaattcttgtttcaaaacttgcaaaccattaagaagaaaaattagacatttcaaattaaaccatagaggaa

SEQ ID NO: 202334 - DNA, 609 bp, Homo sapiens
  misc_feature (415)..(415): n is a, c, g, or t
  misc_feature (436)..(436): n is a, c, g, or t
  misc_feature (469)..(469): n is a, c, g, or t
  misc_feature (473)..(473): n is a, c, g, or t
  misc_feature (508)..(508): n is a, c, g, or t
  misc_feature (523)..(523): n is a, c, g, or t
  misc_feature (525)..(525): n is a, c, g, or t
tgtgatggagctggctgtgtagtcatataactagagaaacaagagaattttgctgtttgtacacgtgctcccgtctactacttctctataatccactgccatggaatgagtgatttttcttagaagcagaggtggagccactgaggaagcacaggcgagccctccccagcacgtgctcactggtccccaacagaacaaccgctgccgcatccatgaggctcccattgtggtgggttgtgtcaccccacaatgtcactgttgctgagcccccatcgcctctgtgttgtggagcagttagagacacactgtggtgtctgagtggctctgtgtgaaggaccgttttctaggtgagaggcacatctcaacacagctgactgatcagactcagccgttttgcacaccctggtcagaatgnaacattccttgggaactcggnccgtgagaagcatccttcctgatcacctgactntagnaacatccttatcgcaccctcccgggcaaaggcccnacagcctgactgcangnacatccttgccatatcctgccgggcagcaagctctaccgcccacacccctccttctcgcagtctctaatcactagtgaattcgc

SEQ ID NO: 202335 - DNA, 652 bp, Homo sapiens
cagtttggaggtgaggttagcaattaaacgataactgaagatgatgggtgatttctggatctactagtacatagtgagctcttactgtgtcccgggcaccatgctaaactctgccttgctttgttgcagcaacactcgtgggtaggtattttcgttaccctgatgaggagacaggggcacagagggtttaagtaacatacttggtgacccggcacaggacagatgtggcagtcccaccctagggcctgcgctccaaaccttgatgccttctgggcgaagccagacgtcggcacgtttcccccgtctgccccagtgctcctagcgtgctttataattagaacagactgcagcgccagctaatgacttcctcatgagattaatattcagaaactcgggagaaaattgaagaacaagaaaggaaataggtagagaatgaggttgtttccactaaggcccaaagcactatttaaaaagtatgtttgagagccgacttcggctgcgttttggcaatcagaaggcttgcactgtacctctcctctgcttgtgcttcgggcattcagtaccggcccctgtcacgacctgtttgtggagggcagctgatcacatccctcctgtcaaagcataagcctgaaccagttcctcgacttctcag

SEQ ID NO: 202336 - DNA, 505 bp, Homo sapiens
tttaaatatgcaaacaatggtgccagtttctgtatctatgtgacaaaaatatatagagtttgtggtatcacttttacctgtttagagcactctttggaaaggcagggaaattactgtgaaggtattggtattccagaagtaagttcctggagtgtttgccttctaaggtgtgaggacgtggtttgtcacacccagttaactaacagatagacggtgtagtgagctgtccggaagacttagcaggttagcctagggaggaaggagaaaggggttctgggcacatggagggagggggagggaaaagagtttgtttgaatctgtcctagattggggtagctttttcggagggaggccttgtcgtgtggacctgctgcatataaagacaggagaattggacctgaggtgtggtgctagctaaagcgccacacagatctgggaatttaagaggagttcatttcctcaatcattaggaagaacttgaaagggtagcaaactgtggtcattt

SEQ ID NO: 202337 - DNA, 289 bp, Homo sapiens
aattagctagtcatggtggtgtgcacctgtagtcacagctgtttggtggggctgagtttggaggatcacttgagcctaggagttcaaggccgcagtgagctgtgatcatgccacttcactccaacctaggcaacagaaagagaccccgtctctttttctctctctcgctctctgtcaactctcattcacacatgcacacatacacacaaaatagaagtactgtcttcgctcaagatttattcttaccctgcaggagataatcagtgatggtcaaatcaacaacagtgat

SEQ ID NO: 202338 - DNA, 127 bp, Homo sapiens
aacctgtccttccccttctccctaaaaatcatgactcttaatgaggccagctaacaagctaaggattggttctaaggctcggcactgcatttacccacctccctgcttcgctgtgaaatgtaaccac

SEQ ID NO: 202339 - DNA, 430 bp, Homo sapiens
ctgaataatccataattataaaatgtaaaaatatacacttaacattatccaatgagaaatgtcttctaagcttcaaaaatttgaatatgaaattattttacaatgtagtatgcaaaatattaagactggaaagaatcttaaaagacacctaggaaaaattcctttccagagatacctttggtatatatgcaagttatacgggttctacacaagtaaaactctgctaacgagactgtattcatattcatctattaaaatatcaagttcactttgttcattctgaaaaaaacaaaaacaacactcttcaatagataatgcggaattttatcctttgtaatcgttgtagaggtcattccaatatcaattttaattcccactgaaagtaattgctctgacttttgaatttcctgatacttgtgtgtaaagtatc

SEQ ID NO: 202340 - DNA, 530 bp, Homo sapiens
gaggtggtggcaggaaagagggagacagcatgaggcctggagttgaagaaagtctcagccttggggtctaatcttttgacctatggagaaagacctgtgggcagatttataactgtcagttcagtctgtcctcataggtgcgcctgggagaggaactggaggaggtagcagggtcagagactgcaaggcagattcctccccacagcctgaatctgtcagaatcttctaagcagcagaatgcattttgggcaccatggcttcattggttacaacctctacctagtaagcagagtctggatttaaatcttgcttgtgtcaaatcttactagaaaaacctagttctctcttatgccctggggactctgatgttcctgctgcccttgcccatagggtatgccaaatcatggttagaaatcccttccatggcccctcgttggtctctaatccaatttttatgttggaaaacttgggttcttaagggcttggcatggtaggccttactctacctttgtgctagatgcccactccac

SEQ ID NO: 202341 - DNA, 278 bp, Homo sapiens
agctaataaagtttgcaagctcatttcggaggaggggattggagaggagaaatacctagttttgatttatattatcatttcttttatgcttcttttggaccattttaacttttccattttgaaaagtaaaagtatcaaagtttactatattttcttatatgatttttattgtcgtgtaattatttcaaaaattggaagtccataaatagctacgctatggttttgcccttttccccaaagcgtataaaaaaataaaatatatgtcagtcaaatgatta

SEQ ID NO: 202342 - DNA, 403 bp, Homo sapiens
ggaggttctttgttagctaatgaaataaaatcttccttcctcagtttagcaaagacaaaggcctggtggtgagaaatacttcaccgcccttcaaaaagttcatctcctccccactccaagcatatactttattctaatgagtgcaactaataattacctagcaagaaggagcatgtctaggattcttgaaagtcaggaagggtagttttaaagctcaccacaaaataatggaaaacattcagataaattacaaggcatcaactcataagagaatactaaccaaatgaagaaaagtactttttttttttttttttactatagattaaaattaaatataacttaattcacattataaagacaactctgaagaccatctggatatgataatggcctgtggtaaaga

SEQ ID NO: 202343 - DNA, 241 bp, Homo sapiens
gtagaaaaattatccattaataccagaacttggtggggcatatgtgggtaataaaggctaatagttttaaaatgaaggttataattaaggctgaaagtatcagaagtcctttgtcaataatgtaagacatgtaatcaacatcagtgatgtcaaacatgaagttgcaatgtacagggaaggtgttgacctaggactttgttagatatacttcatcaaatttgattaaattaagctattttaa

SEQ ID NO: 202344 - DNA, 807 bp, Homo sapiens
ctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggcgctgcacccaagcagcagaagtctcggcccaccgcctcgagggatgagcgcttccggtcagatgtccacactgaagccgtgcaagcagcttttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacat

SEQ ID NO: 202345 - DNA, 548 bp, Homo sapiens
ctgggtcctgagtctcgcaatacgtcacattgtcattgctgtaacaagtgtaaacagaaaagaacagagctcttacacattaatctccatttaacatagagtgtccatggggtatacagttatggacttggaactgtatccagcagagagcccagagaaatcaaacaatatgatcttggcttttaaggatttatacctttgctggaaaagacccaatttacccaccaaagttcaatgcctttcatttcttcagatcgtacatgtctgtaactaaaagctcccccttccttgagcagtcattacgtaccaggcactatactaagggctttctaggcagaggctctcacttctacaaccaccttgtacagtgcaaaccactactatcccattgcacagatgggcacatggaggcctaggggacaagcaacatgaccaggtcctacagctgccaagtgacagcgtgcagaccttgattcagggtgcatgtcattcccttgtgtctcttgcagcacttaccaccttctttctacccggcaatcaagctcgta

SEQ ID NO: 202346 - DNA, 798 bp, Homo sapiens
tcttttatacaggctagtcccctataggcatgtcatggtgattatttgcaatcctcctgactttcctaagaagagatcagacttagcagggttagtcctcatagcccgaggctggacaggaagagaactccatatcctatgtccaagaatatcatcaaatccttatgaagcaccagttgttgtgacgcaattttaaaagactggttcaaagtgcctgtctgagactaagcagatctgtgggtcgagccaatgccacacccattgtggtctttaagcttcttttccaaattaaaaaacaaaacaaaacaaaaaaaaacacctcttacacattaatctccatttaacatagagtgtccatggggtatacagttatggacttggaactgtatccagcagagagcccagagaaatcaaacaatatgatcttggcttttaaggatttatacctttgctggaaaagacccaatttacccaccaaagttcaatgcctttcatttcttcagatcgtacatgtctgtaactaaaagctcccccttccttgagcagtcattacgtaccaggcactatactaagggctttctaggcagaggctctcacttctacaaccaccttgtacagtgcaaaccactactatcccattgcacagatgggcacatggaggcctaggggacaagcaacatgaccaggtcctacagctgccaagtgacagcgtgcagaccttgattcagggtgcatgtcattcccttgtgtctcttgcagcacttaccaccttctttctacccggcaatcaagctcgta

SEQ ID NO: 202347 - DNA, 467 bp, Homo sapiens
cctctacagtttacatgcatgtaaagtaatgaataattggaagagaccgaattggtattccttttcagtgtcaaaggcctttgagggatgggggaacatcagtatttgttgtaaaagttgagtttatttgctggtttggtcaattactgctagacattttcccctaaaaggtccacccaccagtttagctgactgtcatatgtgtgtcacatggctcttgcaaaatgcttacaagttttgtaatagtgtggcttgaagctgaaatcttttgcactaaacagaaaccgtagtattttattagaatttcatgctttagaagttgagggtagtgttcttgtagtgacatttgctgtgttgacagtttaaaaaaaattttttttcaagggctccaaggacaaagttggttttgcacagttgaacggaggtgaacttgaggttcttaatttagtagttttcttggtaacaat

SEQ ID NO: 202348 - DNA, 366 bp, Homo sapiens
aaatttaaatatagacctaccatgtgatctggctattctactcctaagtacctaagagaaattaaagaggatatccacataatgacttgtacacaaatgtgcatagcacttttatttgtagtggttaaaaatgaaaacaattgaaatgtccatcaactaagtcaatggaaaagcaatctgtgattatcaatcacaatggaatatgcgttaacaataaaaagaaactatatatacagcaatatgagtgaattaaaaaaaaaatctttgctaagtaaaagaagcaagactgtccccctgaaaaaatagtacttactgtatgattccatttatataaaattctagaaaatacaaactaagccgggcata

SEQ ID NO: 202349 - DNA, 189 bp, Homo sapiens
gctggaaaactgctctgacttcactgaaggacctagcaatggtgaaacgagagcggagagattcacgggcggtgaaagacaaggagctccttcctggaggcgcactggcacctgcaggtgttagcaaggagttggggatcaggcaagaagatgaaggggcacggggcagaggaacaggcagtcacaggg

SEQ ID NO: 202350 - DNA, 413 bp, Homo sapiens
caccgagccgtgctggaaatgaaggtgaaccacaagggctataattatactttttcccatctgtgtgtgttgagaaatcaggataagaaatgcgtgctggatgatattatttcagtgctagaggatctcaggcaggctgccgtctccaataagacaacagccagggtgcaagtgaggtatcccaacactaaattaaaggtatgctccttctgcatgcttctgccaattaaagaggcagcacttcatttcttgccctaaacaagcaaagaaaatgcagaggtctcatccttaagactcagaagctaatgcttctttcatttctggggggaaaagatgggcaactgagtgaagaaaacaggcaatgaatggtatgactagatattaagaaattcaaggccaaacaaaacaaatac

SEQ ID NO: 202351 - DNA, 205 bp, Homo sapiens
aggaaggggaagcagtacattttcagggagagtcttgcctggctcatcatggagcccaggtgttggtacttacatggtaaagagggagcaagaaggaggcagggcaggcggccgaggtagggcaggcggccgaggtggagctggcagcctctggagataagccctgcatgtctttgctcttgatctaatacggaccctcaatcct

SEQ ID NO: 202352 - DNA, 599 bp, Homo sapiens
ctttatgtattatgaaacctagctctttgagatataaatgctgatttttttcccccagcaacaatgaccttggtggattctatcataatacttgttttgaagcatttctgtagtcagatgtagctgtcatttgtttatggcttctgagtttgtatcatagttagaaagtctttgttcgttctgcattatgaaaagaaaaatcagccacaggtttttcaaatgctttaatggttgccttcccagctttcttctttctctcctttcccttccttcctctcttcctcccgtttaaatactttatccatctggagtttattttcacgcaaggtatgaggtatgggtctgatcttatgaagtcgtgtgtggttcttgagtgccttctccgggcgccgtgtgcctcatccctctgttactcatcaccttctttgctgatgcagagtaggtgcttgatgtggaggaggaggtggaccctgctgccagaagcagtagcagctcatgtgctttgtattgttaggtgctttccatccattatttctaatcaacacagcctctcttcaagataagtagtatatagctcccattttacagatgacaaactt

SEQ ID NO: 202353 - DNA, 584 bp, Homo sapiens
agtatataccctcccttgtctcaatatctctgtgcagctacccccacattttgtttcttcccatttgaagcaaaactcctcaaaaattgtatatattcactatcttcattttctttccttctatgccaaacaggttttcctccttcaaagctactctcatcagggtcaccaaatacctctgcattgccaaatccagaggtcagttcacagacctcgccttacctgattgctcagaagcatttgacactgttctctttgctggttcttcctcatgttctcgacatctgagtgttggagacccccaaaatcagtcctaggactctttcttttccttctatatattccttttacgtgctttccttattctctttgtatataatttaatacctctactgggtaatttacaaagaaaacaaacttatttctcacagttctagaagctggaaagtccaagatcaaggcagcagcatgttcagacgtgtggtgagggctgccctctgcttcctagatggtgccttgatgctgttgtcctccagaggagaggaaatctgtaaattcacatagtggaagatacggaattatga

SEQ ID NO: 202354 - DNA, 405 bp, Homo sapiens
aaactaaccccagtgcgacccaacatagtgggatttgagatgttacagacatgaaatatgaacagaatgctaaaagaacataaaagaataagagctccttaaagattataaataaatggtgatgttaaagtaatagcaccattggacgaagctagggaatcaacacttgacagaaagatacatattttttttatacaaactacatatatttgagcaatcaagtagtagacatagagaattttctttttatggaagtactctaataagtaaagggctgatagaattatatcagcattttctagctcctggtgaattatgcattgggcatccatggctgccttagatcacaaaaataccaccagatatatgcctgtggatgaaagatcacaccaccacctgtgaaat

SEQ ID NO: 202355 - DNA, 383 bp, Homo sapiens
agggactaaaggcacatgccaccatgtctcacagcagcctctacccgctggattcaaggtatcctcctgcctcggcctcccaagtagctgggatcacaggcacgtaccaccaagcctggctaatttttttttggtagagacacggtctcactttattgcccaggctagtctagaacttctgggctcaagtgatcctccggctttggcctcccaaagtatttggattacaggtgtgagccactgagcacagcccctaatcatactttttaaatttatttttattattttttttgagacagagtctcgccctgtcacccaggctagagtgcagtggcacgatctcggctcactgcaagtcctgcctcccgggttcacgccattct

SEQ ID NO: 202356 - DNA, 474 bp, Homo sapiens
atttagccttaaaatagaagtaaatcctgccatatgtgacaacatgaatgaacctgaaggacattatgctaagtgaaagaagccaatcacataaaaacaaatggctgtatgatttcacttataagagatatctaaaatagccaaatacataaaataagagagtaggactgtagttgccagggataaagagaagagggcaatgagggattcgtcttcaatgggtatgaagtttcagttatgcaagacaaacatgttctagagatctactgtacaatattgtgcctacaattaatattgtgcacttaaaaacttaaaagggtagatatgttgacatgttaagtgtccttacaacagtgaaaaaaataatatatctgttataaacatttaaaaaacaaaaagtaaagtcataaaaagtttatatgaaaattcaaagcaattattttagtatttgaaaacagaataagactggaggaa

SEQ ID NO: 202357 - DNA, 203 bp, Homo sapiens
ggtagatagtgttggaattgaattgggggatacccagctgtgtccaccgcaaaattgcttgcttggttgttggtggagagaaagccccacaaacacttcttggtgaccacaggttacagaagtattttgtgttgtgagagtatagtaggaaagaagatttgtttttttgccgggcgcggtggctcacgcctgtaatcccagcc

SEQ ID NO: 202358 - DNA, 242 bp, Homo sapiens
atttccaggactgtggactcccacaaccagacctgatggctcacaaatctcaccctggagagattgctttcctcatactggggcagttcagaagtgccaggactgtggattcccacaagcagacctgacggctcacaaatcttaccctggggagatggtttccctcatactggggcagttcagaattgccaggactgtggattctcccaaagagacttgatggctcatgaatctcaccctgg

SEQ ID NO: 202359 - DNA, 429 bp, Homo sapiens
agcttgattatatggtagttgcatgtttagatatttatgatattgtcagactattttccggaatggctattcgattttatattcctaccagaaatgtagaagtaatcagtaatttttgttttttaagaattgttggttgggcgcagtggctcacagctataatcctagcacttttggaggctgaggcgggtggatcacttgaggtcaggagtttgagaccagcctaggcaacatggcaaggcaccattgctaccaaaaaaaatacaaaaattagccgggcatggtggcaggtgcttgtaatcccagctactcaggaggctgaggcatgagaattgcttgaacctgggaggcagaggttgcagtgagctgagatcacacagctgcactccgcctgtgtgagagagcgggactgtgtctcaaaaaaaaaaa

SEQ ID NO: 202360 - DNA, 173 bp, Homo sapiens
agggatttacactgagaaacctaggccaagtttcaaagactctggaaacctggatctcatgggacttagggttgcatttgcttccacttcttccccccacccccgcaccccagttagtgttctgtaagaaaaaagtgcaaaagaaaaaggaaggaaggaagaaaagaaagaaa

SEQ ID NO: 202361 - DNA, 500 bp, Homo sapiens
gaaaaacatctataaatgaggtaaagttgagtgattttcatttgtagttggataacaatacttcagtggcagcttctctttgttctcaattgcctggactagaaccaaaatctggcatccacatcttattactaactttataacgtggcaatgcctccctttcctgggtctcagcttcatcactgtaagcggagggaactacagagtaccttctaaccctaacatttcgtgacaataaccaagtacaccctaagcaaactgtaaatttgttgccaagtttgtggccttgatccccaatctattctttctgcatctgggtgaggaccctttcttcctcttaaaatttctcaagtcctttactcttctagtaataattcgagtgagctacctatcctttatgctttgttttcctcaaagcacatgaattatctcagttaatctttaaaataatatctggccctctagtgtgggacctgaggtacaaagagggtaatttactt

SEQ ID NO: 202362 - DNA, 133 bp, Homo sapiens
gttcctattcaatttctactccctcttaactaaaacagaaggagtcagaacactctgtagagaggacactatcttaatcctctggacaaaggacactgttgattaaatgcaaggtcttgactgaaggagatcc

SEQ ID NO: 202363 - DNA, 458 bp, Homo sapiens
ttatgaacacttctgatctcattaaggatctggccaaggactgtaattccaacttatctgatctccccaagggtcaacttcacgaattcatgccagtgtagtacaatctgaatggtgatcgaaaggcttccttctcagcctccaaaagcaatttccccatctgtcagctacctcaaattctgacataagagatgtatatacttagatatgtgactttggtattcaaaaaatccttattaatatgcttatactccgggtgcagagacttttacagatgaggaaactaaagctaattggttaagtaaattgtcctacatcacacagctcaagggcagagcagggacttaaacctaagatgcatgactccagaagcctttgctctttcttactatctcatattgaagaaatgagaaaggtacggaaaggtgaggctggaatgcattctaggtaaaacagga

SEQ ID NO: 202364 - DNA, 382 bp, Homo sapiens
aacaaacaaaaaaacccgaaaacttcccaaggaccccttttcttctctatataccttaaataatttcttaataactcctacagcaccagttcccgtgggaggcaggagcctaacgttggtgagaatgttgctccaaattgccaaactacctcctctcacaaaggtatgagaagttggcctggcgcaatgactcacagctataatcccagcattttgggaggccaaagcaggaggatcactttcattcaggagttcaagactagcctgggcaacatagcaagacctcgtctgtacaaaaatgaaaaatacaaaattagctgggcatggtgatgcgcccctgtagtcctagctacttgggatgctgagatggaaggattacctg

SEQ ID NO: 202365 - DNA, 302 bp, Homo sapiens
aacaaacaaaaaaacccgaaaacttcccaaggaccccttttcttctctatataccttaaataatttcttaataactcctacagcaccagttcccgtgggaggcaggagcctaacgttggtgagaatgttgctccaaattgccaaactacctcctctcacaaaggtatgagaagttggcctggcgcaatgactcacagctataatcccagcattttgggaggccaaagcaggaggatcactttcattcaggagttcaagcgatctgttcatcttgcccccgccccaaagtgctgagatcgcat

SEQ ID NO: 202366 - DNA, 196 bp, Homo sapiens
gctgggtggtctagaaagtgccccacacagaaatctgggttatcataggatctgccttgttcgtttctcttctttcatagataaaaatactgtgcttcctactgtccagtgtttgagcacagtagtttcatgtaatctgctgagttgtctagtgtttaaggcatcaggataaatgtttattatggccaaagcagaa

SEQ ID NO: 202367 - DNA, 462 bp, Homo sapiens
actttttaacaagtagagttgttctaccacagattcagctgcattgtaaggtagcgagttctctgtcactagaggtatgcattaagaactgaccatcacttgggaggtgttgcaaaggggacttaagctgtggcatccacagacccattccactctgaaagattcaatgattggttaatttttccgtacatctcccctcccaccaaccttccaggataggacatctacgtggtaaaatgtgattaattccctaaaatcaaaagaataaatagcctttctgcattttgtgatgtgacattatgttattttcccaattctcatgctctcagacctgttgggtttggtcagactcagttcatcttgcacaacaagcagcaaaagtatccacatacttgtaatggccttttgagtcccattggagggtgaggagggttggtaaagtagtaagtgagaggtgagatc

SEQ ID NO: 202368 - DNA, 294 bp, Homo sapiens
cactcagtagttttcttattacataaattatgattacagtttttactttttctttgatctaagaataatggaatcttttaataagttcagtttctaattgtaatacagtttaccagagaatatacactgtaaatggtttcatttttggaatgaattgagagtttccttgggatctaatactgattagtccttgtaaatactccattgatgcttgaaaagaacggtgtcttactttcatttttagaagacataagatagagtacaaataaatatgtagtttataatttatataaa

SEQ ID NO: 202369 - DNA, 325 bp, Homo sapiens
aattatattatatatatatataatataatatatatataatggtgtgctatgtgcatctgttcccagccacatgtgttggtggctggaaattggccatggtggaagtatttacacatggaagttggcaaagactacaaatcaaggcttgatttattgctttgttgattgtgtagagcagagatcagcaaagttttcctgtaaagtaagtgttttcagctttgtggaccaggcagtctcagttgtaactgctcaactctgcctgaaagcagcggtagacaatctgtaaatgactaggtgtgcctgtgttgcaataaaactttatcta

SEQ ID NO: 202370 - DNA, 205 bp, Homo sapiens
acagcataaactattgacatcctgaactttattatcattcctttatagggtttccacatttgtatgtatttgtaaacaaaatatagtcattttatgtttttgaaattcataagcatgaaataagcaatcaatacaatttgcaaagaagtttatatatgtgtacacatagagataattaacaacataattaatatatataattctc

SEQ ID NO: 202371 - DNA, 484 bp, Homo sapiens
aagacccaggagtatccaagactgcctatttcatcatctgttacgcatgcggcagagagtggagacccaggcagctggaggaacggccctgtgagaagagattgtatagtcctagaaaaagaccaactggaagaccacggcgtagcagaagccattccggcaatgagagattcaaacaccaaagtggatctttttcaagatctaaatccaaatcaagatcacggtccaagtcccagcccaagaaagaaatgaaggctaaatcacgttgcaggcctgcatctcataccaaaactagaggcatctctaaaaacagattccaaagcacattacaagtctggctcaagatatgaaaaggaatcaaggaaaaaaggaccacctagatccaaatctcagtcaagatcatagtctaggtctaggtcaaaatctagatcaaggtcttggactagtcctaagtccagtggcccctggtagtataaaccatgat

SEQ ID NO: 202372 - DNA, 402 bp, Homo sapiens
accgcaaggaaccttcccgacttaggggcggagcaggaagcgtcgccggggggcccacaagggtagcggcgaagatccgggtgacgctgcgaacggacgtgaagaatgtgcgagacccagggtcggcgccgctgcgtttcccggaaccacgcccagagcagccgcgtccctgcgcaaacccagggctgccttggaaaaggcgcaaccccaaccccgtggaattcgaggctgccctaccaggatcaatgcaaatgccacctccttttggaaaatcctggtttcctagctcccttcatggaattctgcttcttaaggcttacttagtaatagagacctctcagaagttggaagaggcccaggtccactctggcccccaccttttttaaaataaaaaatgcaatg

SEQ ID NO: 202373 - DNA, 597 bp, Homo sapiens
cagcgttttaaaatcggaaggttagtgagattataataacacatgctggaaatccacatggtttcatgagttcagtaaccttgagtaactttttccctggggaaatggtggaagccgtattgcctcgccaagtcttatagataggtcccaaagaatctgagcacacaaacatcagctgctcagatttccacaaaccttttcccagtggacccacagtaaagcaaaaaactatatctatgcaaaacacctaaaggaatgctatgttcgtggtctgaattttcttttacttataataatcctcaaaaaggccaggcactgtggctcacgcctgtaatcccagcactttgggaggctgaggcgggtggatcacttgaagccaggagttggagaccagcctggccaacatggtgaaaccccgcctctgctaataatacaaaaattagcaggtatggtggcgtgcacctgtaatcccagctactcaggaggctgaggcaggagaattgcttgaacctgggaggtggaggttgcagtaagctgagatcacaccattacattccagcccgggcaacagagcaagactccatctcaaaaaaaaaa

SEQ ID NO: 202374 - DNA, 481 bp, Homo sapiens
ggaactgaggcccattgttttcagctaggtggaggctgctaagtggtggttgctatgcgaagggtacttgctgtaaaacctgcatgctttttataaaagggaatggtttttcctgtccagccttcccctcctggactccctggacataagttccctgaataaagcttatgtcacgccgctgtctttgggtcttttcttcagtcctctagaggcagtgctctcctagcttgcaagcttgggaatccagcacaacaggtggccacagcaggggaaatgttaggacttcccttttccttctctttctttttccttggctagtttttgttgaagaaactgggattttgtttccttttcactgtttggattttgctgattgtatccccatggtattttaccatgccccttgagttttcatcttggtagttcagatttttttttttttttttttgagacagagtctgtcgcccaggcaggagcagtg

SEQ ID NO: 202375 - DNA, 515 bp, Homo sapiens
ccactatgtgctgtggatgggctgtggcttcactgggcacccccatctgctgcctctattgttccccatccccagccaagtgggtcttgttttccttcactgcaggcagaactcgagcctgtgctgtgccctgatgagtggctccccttcttcctgggccgttccatgggtgtgcctttgccacgctcaaccttcccaccccgacgcaacattgatccccaagtcagggtgggctcgggacccctcaactttcccctgtgcccctgtgcatttcatgggcaaatcaaaccttttcaaactctcgcctccacaggtccccaggggtggacactccaaggtccccgttgctcctgtcctctgccagccgcctcaccgcctaaatcagtggcccagcccaggccattaccacaaggctagctggcctcgatgtcagcacctacctttctgagggcgactttctgaggctccaggccccagcaggtgggatttctctttccatccgcaccccgacggca

SEQ ID NO: 202376 - DNA, 490 bp, Homo sapiens
gtttgagtgttttttgttttatttttgtcccccctgggaaaacatatttcagcatgtataagagggagaaaaaaagtttcattccttccagagaataacttatttagtccagtagggtagaattttaaaatgtcagttaaagtcttcaaagtgcttggggggatatcagattccagaggccaattgtagcaattgaaatttgcagaatcaattatgtaaatctgagacaaattagtattaaaattacacggagtatattttttaaatcacccaactttgtagattatacctattttgggcaggtatggaaaaattttgcagttaaatgattgcctaaagaaagtggtaaacaggtgaggaaagatggcctctgatctaggatagatccagaaccacaaagcatctgcaccacaaaaggtgttagactaccaagcagctcctggttttctgcatagtattagtagcacagcttaggatgagaatcctttct

SEQ ID NO: 202377 - DNA, 309 bp, Homo sapiens
tttcgttctttctggtgcagcttaactgatttgaagaagccgaagaagaaaatccagtagcacggttaagactttagccatggcatctgtatcataccaaaagccaacatctactactgtgggaaaacaaatgatttttacagggatttccagactctttcaaagttccatttacaagctaagtagctatcaccatcctcttttcataaaacggaaacagagcaaagtaggcatgctcatcatgtgggctgaataaagaagttaaaaaaataaaatgatctatgattccagatcataccaaggaactga

SEQ ID NO: 202378 - DNA, 538 bp, Homo sapiens
cttttcatgttatatccaaaaaactcattgccaaatccaaggtcacctggattttctcccttttcatattataggaattttatagtttcgcattttgcatttaggcctttgatccattttgacttaatttttgtgaaagatttaaagtcattctttttgtttgtagatgtccatttctagtctcatttgttgaaaagactatcttttatactctgttttgaattgcctttgctcctttgtcgaagatcaattgactgtgtatatgtgggtctatttctgagctctctattgtattcagttgatatgtcggttcttttgccaataccacacatgccattttgatgactgtagctttgtatagtaagtcttgaagttgagtagtgttaggccttcgactttcttcttcttcaatattgtttcggatattttgggtcttttgcctgttctaataaagaatttagaatcaccttgccgatatcctcaaaataacttgctgaaattttgattgggattgtcttaaaatgttaccacaaacata

SEQ ID NO: 202379 - DNA, 1709 bp, Homo sapiens
tttagtataatattgatgcaagaatggatgtatatatggaacaaaatagtcagaataggcctaaatataaatgtaaaagttggtaaattgtcatggaatttttagttaggagattgaaaaagaattagaatctagctggacacggtggcacgtgcctgtaactctcaactacttgggaggctgaggtaggaggatcactcaagcccaggagtcaagttcaacctgcgcaacacagcaagaccttgtcttcaaaagaactactaggtcctttgccaaagaaaattctaggcacattcaaatatatatatttttttaattcaaacttgggcctggcatggtgactctcacctgcaatttccagctctttgggatgccaaggcagaaggatcacttgaggccaggaatttgagaccagcctgggcagcagagagagacccacatctctacaaaaaataaaaattagccaggcatgatggtgggttgcctgtagccttaaggaggctgaagtaggaggatgacttgagcccaagaatttgaggctgcagtgagctgtgataatgccactgcgttccagcctgaatgacagcaagacatctgtctctaaaaataataaaataaataattcaaactgtattaaccatgtttttgtgtctatactgcctctgtattaatagaggattagtacattggggaaaggatttgcagtaaaactgccggggagtaatatccctgctagcaatctgataaaatttatcatgtgcattaaaaatattcataatccttaacctagtagtcgttcatttgttctgcttggtatctttcctacagaaatagacaaagaaaccaaaatttatatataaggttggtgcaaaagtaattgcgtttttggaccattaattttaaatcactgtaactagactcagacacatctttattaatcaaaataggaaccactgcaatcaacacatttttgccactgagaaataagtttgtttattcctgtagcctaaaaatctatgcttcaggattcgacaaactcttggaaaatattttctgcatcctgctggttgtggaagcaccttccctgtaaaaagttgtcagatgcttgaagtggtacctggttggcgagaggtcaggtgaacatggcgggtgagacgaaactctgtagtcaaatttgttcagcagcttcagaagttgaatgaattgtttattagaataattaattcttagttattaacaattgcaaaaactataggttaaaaataatctgaattccaaccccaggaatggtagaatttgtaattttatctgcttgtgcacatacttgtaatggagtatcatatactatttattgaaaatcttatttttgattcattttatcaaattaactccctctacccccaaaaacagcgtagtaccacttttgaattagatttgtgatcttacctagcaccttgaatttgtaagaatattaaaagaatagccaggtgtggtggctcacgcctgtaatcccagcactttgggaggccgaggcaggcggatcacgaggtcaggagatccagaccatcctggctaacacggcgaaaccccgtctctactaaaaatacaacaacaacaacaaaaaaaaaaaccgggcatagtggcaggcgcctgtaatcccagctactcgccactgcactccagcctgggcgacagcgagactccatcaa

SEQ ID NO: 202380 - DNA, 323 bp, Homo sapiens
ttggtctcccaaagtgctgggattacaggcgtgagccaccacacccggcccaggatcctcatttttaagaaggggataataagaatgactacctcagtcatattggggaagactgaactgatattttgtatgtatttctagagaaggactatatatgtatatatagactatatataggagactctacatagtcttatatatgtatatatagactatatataggagactctacatagtcttatatatgtatatatagactatatataggagactctacatagtcttatatatgtatatatatagtattcagcatggtctgcctg

SEQ ID NO: 202381 - DNA, 411 bp, Homo sapiens
taaaaaattaaaaatttaaaaaaagagaagaaagaaatggttactgaaattctactaaacaggtgcagaccatcccctctgtggatgaagagccaaccaagatttagtctctgtatatgggaagaaggaaataggaagcagttgtcaaaataatactgacactaagtaactgaatcaaatgagatgattctgctctaagaatcaaacctgacccagtaggttctaagaaagcaaatggctggccaggcatggtggctcatgcctgtaatcccagcactttgggaggctgaggcgggcaagtcacaaggtcaggagttcaagaccagcctgaccaacatggtgaaaccccatctctactaaaaatacaaaaaattagctgggcatgacggcaggcgtctgtaatcctagcta

SEQ ID NO: 202382 - DNA, 429 bp, Homo sapiens
gagaaattctctgcatctcttgtgcccttgggaaaaaagacctgtgtccgaatgctgtgattttgtgagttgtggtgttgccactgtcagagtaagagataaattaatggtcaaattacttctttcagaaagcacaaatataataaattttttacagagtgaagaatcactttgcaatagttctgagcagtttctattctggaagaaattagtacagaatttccaacagttgtatacattgactggggcttcattatttatttatttatttatttttgagacagagttgcaccttgtcgcccaggctggagagcagtggctctatctcggcttactgcagcctctgcctcctgggttcaagcagttctctgcctcagccttctgaataactgggattacaggcgcccgccaccacgcccagctaatttt

SEQ ID NO: 202383 - DNA, 472 bp, Homo sapiens
taatgatgctgagtatttattttctgccatcttctctctccagatctatggacataatttacacaggacccccgagggtaattaagccagcaattcttttgccagtaaaatgagaaaaaccagctctcagtaaattctgaattccactatggatgttgcagaaacagaactaaaaacagctgcagtttatctgtgctgccgaattgactgtaatttgctgctaccctcacccttaccacatagcaatcagtgtacagaagtgcagaattttaagatgatgaatgttttatttcttaaaataaacagtagcaatttagcaacatagttatgtattttacattttttatatagtaaaagtatattggaaacttcctcagtgtcaaaaatccttacatgcacttgtcaaaaatatcaagatgacaagctaatatggaattcagatttaaataatagacttctcagatacatccca

SEQ ID NO: 202384 - DNA, 407 bp, Homo sapiens
ctgtgagcaccctgcagccactgctgggcaaaacctgcccagtgggtagtgctcgtttttgctgcatgcaaagaggcaggcccaggaatggaatttgcttttagagactgctcagagtgacaacaggaaaaatgctctacctacagacctggcacctgcatggcgtggtctccctgcacatcatggcagattgttctgaaagctgaaaatctcccctactgtctaaaccctgggacttcatttatctcatgtgtcccaggacactacggggctgcctatgcaagtttacagcctaaagtgacacggtgggggacgacagagggtcacttgtgtcctagaaagtgtagtccaagggtatgattcagggataaacaggaaccccacaaaggcattcgtttgttcaagcc

SEQ ID NO: 202385 - DNA, 559 bp, Homo sapiens
atagaagataacctgatggccagaactccctgcatgcactgcagtgaggaataaggacaggagtgcacttcccctgatgtgctggggaccggggataaaggctgggctctatttcccgggatgcctcaggactgtcagaaaaagagacagaactaccatttcaatggcactctaggagcacaatattgaaaaattcatgttcttctcatcatttgctaaggcaacccatggagacaaaaattacattccccatcaaatcttgtggctaatgaagaaaaaataagatatcttcggctggctgtggtggttcacgcctgtaatcccagcactttgggaggccgaggtgggcagatcacttgaggcaggagtttgagaccagcctggccaatttggcaaaaccccgtctctactaaaattacaaaaattaaccgggtaaggtggtgggtgcctgtaactccagctactcggaaggctgaggcaggagaatcgcttgaacccaggaggaggaggttgtagtgagccaagatcacaccactgcatgacacagtgagactatccc

SEQ ID NO: 202386 - DNA, 1340 bp, Homo sapiens
  misc_feature (194)..(194): n is a, c, g, or t
  misc_feature (1087)..(1087): n is a, c, g, or t
  misc_feature (1108)..(1108): n is a, c, g, or t
  misc_feature (1119)..(1119): n is a, c, g, or t
  misc_feature (1134)..(1134): n is a, c, g, or t
  misc_feature (1149)..(1149): n is a, c, g, or t
aacagggaatatactgctgaaataatgtttgagtccttcaatgttccaggcttgtacattgctgtgcaggctgttcttgccttagctgcatcttggacctcaagacaagtaggagaacggacgttgaccggtacggtaatagacagtggagatggtgtcactcatgtcattcctgtggctgaagggtatgtgantggcagctgtattaaacacattccaatcgcaggacgagatataacatattttattcagcaactgctgagagaccgagaagtaggaatccctccagaacaatccttggaaactgctaaggcagtaaaggagcgctatagttatgtctgcccagatttagtaaaagaatttaacaagtatgatacagatgggtcaaaatggattaaacagtatactggaatcaatgctatctcaaagaaagagttttctatcgatgttggttatgagagattttgggacctgaaatcttttttcatccagagttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgcccggctgaaattaagtgaggaattgagtggtggtagattgaagccaaaacctattgatgtacaagtcattacacaccacatgcagcgatatgcagttggttggaggatcaatgctggcttccacgcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttcnttagattgaatatttgaatcntatgtgtaaanaaaagaagtgggttntagttctttctgtgncctgatatttcgtcatatttatggaattatccaagattcgatgggattcaccagtgtgtagatagctctataatgctttgaattgtacacttctaagtgtgcagtgcaagagcttgttaatattgcatactttttatacttggaggaaaaacgtcccggaaaaatggcttggcgggaaaaaccatgaccag

SEQ ID NO: 202387 - DNA, 474 bp, Homo sapiens
cccattatcccattagctccatgaagacaggaaccgaattcgttttgttcattgatatctccccacacccagcacagtgctgtcaacccattaaggaaccagttccatgactgaataaatgatggagaaattaggcaggatgacccaatgaaaagccacctgaaacagtgggtgctaagtcctttcaaccaaagatctaagagtagttgctgggctcatcttgaaagcaagagttagaagcaggggacaattgttggttttcaggagtcccccttatccacggtttcactttccatggtttcagtaacccacggtcaacctgggtccaaaaacataattaaatggaaaattccagaaataatttataagttttaaattacttttcaatagtagccaatgccacatcaccacacctgtcattcacctcactccaacccatcatgtaggcatcttattatctttttttttttgagg

SEQ ID NO: 202388 - DNA, 168 bp, Homo sapiens
gcagtgcctggcccaggagctcgtggtctaccctgcattaccaggacaggtctttccaaaatttaggcctgaaatctttgggtgtgtgaagctctgacccccagattccctgctcggggacacctcctgcatctcccccttgagattgaccctggaaagtcaaagctg

SEQ ID NO: 202389 - DNA, 258 bp, Homo sapiens
aacaccccatgacaagcctgctctcgctagccaaaggactgaggagaggcggtctaccagaataaaaaaccttttaataatacctgccctattccagctaaacactgaacgaagaactgccccccgaccttagagtgtccgtggagcccagcagggcactgagtcatggtagtgggaaaaggtgttcaacaggctggcaccagattaaaaacgctcaagaaaaagaaaagtcaaataaattatggtacacacatacaa

SEQ ID NO: 202390 - DNA, 140 bp, Homo sapiens
atgaatacttggcatgaacttcattcactcaactttgtcgctgacacgcccgttgtactgacagaatcctggcttgaatggcgcttgctcagctgtgctttagacagacccttctggctgacctggtttaaacctggctt

SEQ ID NO: 202391 - DNA, 365 bp, Homo sapiens
tagtcctggcatagaacaaagggtagatgcctgtaaggactagggtggttgggaggacagaggagtgctggctcctgcagaatattgacagaccctgcatagagccccagacactggcgatgtaaactattggcctaagcacttggattcctttgctcctacaaaccagcccaccaggctagaaaccctttcatctatacttggccaattacagaagtattgattgagttcctgttgggtgcacagcattgaggacaatgagccctgcaaagcttacccttcaggagacacaggatacctaccttcagggagcttataatctgactatgtacaagctgtctataatggtagtttttagaagatat

SEQ ID NO: 202392 - DNA, 332 bp, Homo sapiens
aaaagtcaggggctctatggagaggtttgggttcaggagaggttctgtttcaaaacagaaatatgggctgggtgcagtggctcacgcctgtaatcccagcactttgaggtgggtggatcacctgaggtcaggagctcaagagcaacctgggcaacatggtggaacctcgtctttactaaaaatacaaaaattagctgggtgtggtggcatgtgcctgtaattccagctactcgggaggctgaggcaggagaatcgcttgcacccaggaggtagtagttgcagtgagctgagattgcaccactgcaccacagcctcggtgaacagagcaagat

SEQ ID NO: 202393 - DNA, 436 bp, Homo sapiens
tcccactgaggccagcaaagggattgctcctgcatattctcacagtaaacagtccccagttgaaggataaagagatcctttaacttcaaggtgagcctcactgtgttatatttcaggtgcctacgctgtctcacaggagcacctacactgtaatggccggcggcgtcttcctttctcaaacagtcaaattataatgagagcactttaatatattgggggaatatttagatattattttaatataattaaaagcaaattttcaaatgaaattcaatattcaactgctaaatagcaaaactatgtgctgtaatccagactttacagctgcataaagttgtcatcctattatcttttgctttgtttttccattaacgtgtaatttaatacaattttaatcttccttcatattaaaaagagagtccattactgccccact

SEQ ID NO: 202394 - DNA, 262 bp, Homo sapiens
agttgtcttgccaaggaaacaaaaatctctaaaggacatgcaagacacataggggatacattttcattgtacttatctttttgtgaaacagtagctttcggtctttcaagtgctcacaagcccactgttttcctggtttccggattagtgggctgtcttctggtggtactgccttgacctgagtataatgtgcacatggctttactccagcaagtttaactgataagcgtgtgttcaccagcagctcaaatggccttgtcca

SEQ ID NO: 202395 - DNA, 338 bp, Homo sapiens
gaagtttaagactagcctggacaacataccaagatgctgtctctgcaaaggaaaaatagccaggcatagtggcttgagccagtagttccatctactcgggaggctgaagtgggaggattgctcaaacccaggagtttaaggttgcagtgagctgtgatcaggccacactgcactccagcctgggtgacagagctagaccctatcccaagaaacaacaacaacaacaaaaagtttttataataaagagcttaatctccaaccccacccctcccctcttccgagattttggtgggtgagtctgaaagctccagccctcttggtcgtggtctttctggtaa

SEQ ID NO: 202396 - DNA, 670 bp, Homo sapiens
agttccttctctaaatttcaaaacaggtcaaacatacaagaaatcagaccaggctgggtgcggtgctcaaagagaatcctgcaggaagactgaatcccactcaattgcccatctgctgatggttactgactgctctgcagatggtaacaatgaggcgtaatgataaatatgcattgctctggagtcctatacaatcaaagcacttcacgtgagagtaaaaactaattaaacattgcagcaccacccactgaaggtagagttaaatctgtcaaattatatattctgagcagcactggtttataagaaagattcaccaagtttcctttatttttttgtccttaattataaaacctgttttcacctgacacttttccagcagtgtaacttttgccctggggcaaactgaggtggcgatgtctgtagtaactgccaagagagctgtttgtttctccccaggggtaggtcattagaaactgaaagtccagaaccaattttctccagctgctgcaggtgttttacttttagcattgtggggtggggatagcagatgcctgagaaactatagtgttttacataagtctgaaatcattggatctataacctcagttcttcaacaaaccttatgtcaatcaagagatcagaacacatctttctagaaagagaaaacaca

SEQ ID NO: 202397 - DNA, 639 bp, Homo sapiens
gtgagtaggaggggcagggtagaatgaagagagaagatttgacaaagggttatattgcatacatatataagacatccattcaaaacctatgaaataaatcaagaattacaaactcagaagcctatgggggtcagaaaaatgacagacacaagtgaagttgagcaggttcaggggaccatgaatgtttttcactttcctcttaacagttagcaaacacaccctgaaacaagagggcgaggtggggcagtccttattcagatccaacaattgctgccctgtgaaaatgagctcaggatcaccacatcttccaatttctaaagacaagtcagaaatcagaatttgcatatgaaaatgatgtcaactcatttagaaaattgtaaaacaccatgtggcaagttgtcataggcaaaaaataaaaacaaagaacaaacacaaaacgcataacccaacaactcacatttgcatctttggaggttgctagggcaacaaacgcattattgtgaaaatttataatcaagcatttacctcgcctttcctatatgaagcatattttaaagtaattaaatagttaatgagtgacaagtactctcttagaagagaatcacagttcataaacataggtgaaatgatggaaattga

SEQ ID NO: 202398 - DNA, 418 bp, Homo sapiens
gctgccaagcacgtgtatttttgtcttttactttcacaatagcacaggagtactggagaatgtggcgtggaccatagtttacattttcagtggaaaccaggaccagaggctgtgtgctcggggcccagatggggtgaggacaccaggtggtaggaagtcgggggacaaaggctgtgggcaagagcctcatcgatcctgcaccaggaggagccaggggaggctgccctgtcccacagagaggagaccgaggctcccggaggaggacaagtggcaggaaagaaaaccgcggtcttttctctcccagtcaggggggtggtgtgtttcccctccaccatctgggaggttgtctatactacgtgggatttgattacaaatatttcaaaatatttatgcctgaataaaaccctcctcttaacca

SEQ ID NO: 202399 - DNA, 642 bp, Homo sapiens
gacgctaagagatttcatcaagctactcgtaacagcacaccgtttaagacctgtgaattgtttattcagactgtggttgaccgtgggtaactgaaactgcagaaagcaagactgcagagctgtgtatctgccacactaacctctttttagaatgttacgacttgcttttgcccaaggcacccatttttcattcatttcaaaaacattttttcccataatccttctgtgtgccaaagaacaaacacaactcagtttgggactttaaatctatttatttgaccataatcttaaacacttttttgcttatattttcaaattaagcaggcaatttttttcttcctctataggttttttccaactcagttttagttaggtaagaacaaaagtgttccatcgccatccagtaaatggagcctgatctcttgaaaggagcaatatgctccttttctcttgccttacagacaagaaatgtgctattcttccaacactgaatatatttcctgacgttaaataagttcaataactagaccatgtaaaatgttttcctaataacttttgcctttcaaaagatacttaaaaaatgaaaaggcaaaaataggttgggtgaaaatattcatactatgtagatctttacaaaggatt

SEQ ID NO: 202400 - DNA, 484 bp, Homo sapiens
ccagttctcattctttaataagctggtcacattgtagatggcacttagaatgacagagggaattggagctgggtcagctccaatccacaaattgcaaataatttgccaagggaaatccctttcccttcggttctgccccaaatctacattttcttctatttagaaccaggagactcaggcagaatttattttaatgaagaaggccatgggctcctgggcctttcctcagcaagaactactgctgtttctctctggaagtcataagaaaagccgggagccgggtattgcatctccacaatgaagcaacagaaagacggggcctggggagctcagtccacactgtgctcgagcattagcatgcactagagaaccagaactaggctccagcgctcccatgcgaccttgggcaagtcctttgacctctcctgctttaaagtgggtacaagaatgcctgattcatttatctcacaaaatggttaaaaac

SEQ ID NO: 202401 - DNA, 399 bp, Homo sapiens
gaagggactccaggatcattgcaccagggatagtaccctatggcttagatgttacccttaatctaatcaactgatatcctgtaactactgttaaattttcttttgcatctatttcttccctcctcagtttgatcttctactagctggacttctttttttgagacatggtctcactttgtcacccaggctggagtgcagtgcatgataacagctcattgcagcctcaacctccctgggctcaggtgatccaccttagcctccccagtagctgggactacaggcgggagccactgtatccggcctttattttttaatattagtactttttaaacatttttttttaagtcaagatctccctatgttgcccatgctggcctcaaacactttcagactcggggt

SEQ ID NO: 202402 - DNA, 187 bp, Homo sapiens
attacaaatagtcatctaaaataaaaacgattcctttaacattttttttttgcttaataagagaatccattgtaaattcttattccaattattatttactgaattccaaactgcattttccgttagcatttaaatggataaagggagctgcctggaagatctagtttcgttgtgctcatttctatct

SEQ ID NO: 202403 - DNA, 775 bp, Homo sapiens
acacacctggccaacatggtgaaaccccatctctactaaaaaatacaaaaattagccgtgtgtagtggcacgcacctgtaatcccagctacttgggaggctgaagcagaagaattgcttgaacctgggaggtggaggttgcaatgagccaagatcatgccactgcaatccagcctgagcgacagagcaagactctgtcttgcggggggaaaaggtgggcatcagaagggttgcagcttgaggactactatggaatggtagaaggagagtcatccacaatcagagggaacattacactcgttgaggatgggtatggctcacaacacacgctgtaaactgaggtcattggcagataggtgtttgagatgtgtgtgttttatgtatcctgtgtagctgggtgaggctttccgtattcacctagtgtttctcatggatggagtcacatataagcaaacatgaacttctcattataatcaaattgttccctaatatttcagttgcactgaaataaattgatattttcaaaacaagtattctagcagaactactggcttttgacccaagttctcatggtataactcatgctagtaccaaatctgtagctctttgtctcacattgtaataacatagttggtttccagtaacctggtgaggaaagacatttcttttgggggtgcgggtgttgattgcatctggcatgtggcattctcagaataaagaggatcagttcagccatccaaaagcagcagaagtgaggtagcagttaggaccctgga

SEQ ID NO: 202404 - DNA, 941 bp, Homo sapiens
ccgacgctttttttttttaatatagggactaaaaattggtagcatagttttgtgcacattaaatggtaagaaatagataaatataggccgggcgtggtggctaacgcctgtaatcccagcactttgggaggccaaggtgggcggatcacgaggtcaggagatcaagaccatcctggctgacacagtgaaaccccatctctactaaaaaatacaaaaattagccgtgtgtagtggcacgcacctgtaatcccagctacttgggaggctgaagcagaagaattgcttgaacctgggaggtggaggttgcaatgagccaagatcatgccactgcaatccagcctgagcgacagagcaagactctgtcttgcggggggaaaaggtgggcatcagaagggttgcagcttgaggactactatggaatggtagaaggagagtcatccacaatcagagggaacattacactcgttgaggatgggtatggctcacaacacacgctgtaaactgaggtcattggcagataggtgtttgagatgtgtgtgttttatgtatcctgtgtagctgggtgaggctttccgtattcacctagtgtttctcatggatggagtcacatataagcaaacatgaacttctcattataatcaaattgttccctaatatttcagttgcactgaaataaattgatattttcaaaacaagtattctagcagaactactggcttttgacccaagttctcatggtataactcatgctagtaccaaatctgtagctctttgtctcacattgtaataacatagttggtttccagtaacctggtgaggaaagacatttcttttgggggtgcgggtgttgattgcatctggcatgtggcattctcagaataaagaggatcagttcagccatccaaaagcagcagaagtgaggtagcagttaggaccctgga

SEQ ID NO: 202405 - DNA, 574 bp, Homo sapiens
gaagaactgtttttccacccgtattgccactggtacctctcatgaacttgttatggacatgggagagacccggggagggactggacaggtttcttccatgaagtaggaagtagttcctaagtcccctgtgtacttctttccaggtagagagaggaatgtgggctctaaattacccttgtgcatggcacatatctagcagcttttgtctgctagcatacctctggaggtaaaataggtaggctcccagccagactgtaaggaagattttcatgttctcttttcaccacccacccactctttctttcaaggcacatttttaagaaagtggctgaagcttgcaatacttagtctttagttctaagtgactcaggaaagagtcttcaagaaaacagttggacagagtgccccaaagcctaagcagcgtgaggcaaagataggcaggtgcatgtggcgtcttagagaggggccagcacatcgtctcttctctggggtcttttcatcctacacttgtctttttgaagacagaggtgtggtgaatgaatgtcattacttacatctgggggagtgaccagag

SEQ ID NO: 202406 - DNA, 414 bp, Homo sapiens
atcagtggttaggtttaaatctgttacttttctattagtcccagctcttctttgtttccttctttggcactgaatttgtgtgtgtgtgtgtgtgtgtcagagagagagatactattaagatctacccatacgccgggtgcagtggctcacacctgtaatcccagcactttgggaggccagggcaggtggatcacgaggtgaagagatagagaccatcctggccaacatggtgaaactgcatctctactaaaaaaaaaaatcaaaagttacttgggtgtggtggcagatgcctgtagtcccagctacttgggaggctgaggcaggagaatcgcttgaacctggaggtggaggttgcagtgagctgagattgtaccactgtactccagcctggcgacagagcaagactgtgtctca

SEQ ID NO: 202407 - DNA, 234 bp, Homo sapiens
aaataaattaatggctgcccgagattggggtggtgaaatttgaaaggacaagatttccttctgggttaatggaaatattttgtaattatgtagtggtgatggttacacaatattgtctattcatatcctttgctttttttttttttttttggagacagggtctcactctgtcacccaggctgaagtgcatagacaagattatggctcactgcagcctcgacctctcctgatctc

SEQ ID NO: 202408 - DNA, 806 bp, Homo sapiens
tgaaataaacagcattgttgctcacacatagcctgttggtggtctcttcacacggatgggcatgaaatttggtgccgtgactcggatccgaagacctcccttgggagataaaatcccctgtcctcctgctctttgctccatgaaaaagatccacctacgacctcaagtcctcagacccaccagcccaaggaacatctcaccaattttaaatcagcaaaatgacatgaatgactgaaaaagcatgtggagcacaagactcaagaactaagtgaaaggactcacacttcctgatttcaagtaaagctacagcaatcaagacgtggcattgatgtaagaatagacacatcaatgaatgaaacagaatacatcttccagaaataaattcacacaaatatagtcaagaggttttttgtgtgctaaagtgtatataatatttaccattttaaccatttttaagtgcacagttcagaagcattaagaataaacaatgttgtataaccatcaccattatccagttccagaatttttcatcacctcacacagaaactctgtacctattatcaacaataaattttcattccccccttgccctcagtctctggtaaccactattgaactttctgtttctatgaatttgccccttctcagtgcctaatatgagtggaataatacaatatgggtcctttgtgcctagtttatttcacttactgtaatgttttcaaggttcatccatgttataatatggatcagaattttatttcttttcaagcatgaataatagtccatggtatgtctataccacattg

SEQ ID NO: 202409 - DNA, 471 bp, Homo sapiens
ggcagagaagttccaggtgaatctagggtgtggccatgtgagcaagctgctgaattatgtcgaaggcattggaattgaagtcaggaactgaggtcaaggcagagttcagaaccacctatgcgaaatgcacactcttgggccccagccaaacctactaagtttgaatctctgggggacggaccagaattccgtatttttacaagctccctgagtggttcctaggctccctaacacttgaaaactgctgtgctatgatgttgaatgagccatgcttgttggaattacctgatggcaggaatcaggcaggaagactaaaaacaggtgttgaaatccttagagagtctgggctgatcagtgtatgggactgatgaggaggggtggaaagaagtttgtacatgagtcaggaagagcaatggccttggcctggactattgctagtgcattcctttccaacctggagacaatgtagga

SEQ ID NO: 202410 - DNA, 704 bp, Homo sapiens
ctataatgcatgggtctgggttcaagctctccattctgtttccttgttccattgtctgcctttgtgtcagtaccaaactgtcctaattattgtggctttatagcaagcctaaatatcttatagagtatttgcttcaatcctgtgattattttaaaagatcttgaccattgatttccacataaatatttgaattaactggtcaaattccacacatacaccctactaaaagtttggtttatgattacattaaattagtctacaaattaggaggagattcagatctctgcagtactgatttttccaatccatgtaatactatgtatctggatttatttaattctttaaaattcatcaataatttttttttaatcttgcacatcatttatgtattcattactgagaacttgataatattttattaataacatgcaaaatgattttcattgatttattattggtacgtgtgctacagcattgctaaattcttgctaattcaaataatttaactattccttactgggtattttattgaaatatagtcttattatttttcttaaaatttgtataaatttttattttctcctcttgccttactacactgatggcagattccagcacagtgttcattgaaatccatattttctggttcccaatcttgtcaccaatctcaaaaggaaaactttcaaaattaaatatatttttgt

SEQ ID NO: 202411 - DNA, 424 bp, Homo sapiens
ccaccagcacttcctgcttcaccttgctcttagcaaatctttaccattaggttgatgcctcctttttgtctctgtggttccttaagcccaggttctcctctgctctactaaattattagagtgctgcctgtcttgaatgggggaattcccaaaaggattattctggcagtgtgggaaggcaggtagtggtttgtgcccaagggacctgtggaacataacagcatggtgctgctgaacagccactctgatgtggcatctcctttggctgagttacagagcagagtttccagggctggggatggtagtcctacctccctagtttgtctctgcttgtcctcacagatatttataccttcaggcagtcatgatgcttcctgtgtgttaaggcaggtacaggtctcttgcaagggaatccaagatgatg

SEQ ID NO: 202412 - DNA, 633 bp, Homo sapiens
gccttcggggcctccaagccctgggcagatgagtaaatacattaaaaaacaagtaaaggaagtccactttctctctatccctttcctgtggaggtcgcagtaatgattgtcccacagtgatgattgaaagtgcatgaaactggacaactgtccagtctaactgcctgtcagaagaggcatttacatcattaaatgggctgcccaccatgacactcgccaggccaggaatggagcatctccctgggtgtcacactgtgctggaggccctaagaggagaacctgcaggaataaaatgggtcttcccttgtaggcccaccagctgcctgaggaaacagaatccagtttccctttatggacttcagtgtacagtaaatcctgaatgttccagaaactcaaaggtttctggaaacctgtgactttaagcaaaatgatgtataagaaaccagttttaccctatgccaattgatgtaaaccagagttcagttcctaccatgtatttctgatcatgagaacatcaccaaacttttgaataaaggcccagaacacttctaatattaaacattgaaatatgagcgatgcatacatttaagaaagattctggctactaagtgggataaagaaagatcataaaaa

SEQ ID NO: 202413 - DNA, 497 bp, Homo sapiens
ttcaggttcatagatggcaccttctaattgtgtcctcacatggtgaagggaactagttagctctctggggtctcttttataagggcataaatcccaatcactagggctccaccctcctaatctagtgacctcccaaaggccctgtcttcaatgccaacactttgggggttaggatttccacctgttttcgggggacacaaacatttataccatagcagtcagtaacaaactctttttgttttgcagccaaaggtcagtcagttttatcttcttagcttagtataatctaagccctaaaaccatgaaatgcatgggaaaggtttttttttctctttttcaacttttattttagatttgaggggtgcatgtgcaggtttgttacctgggtatattgcgtgatgctgaggtttggggtatgaatgacctgttacccaggtactgagcatccgtacagaattcttttacttttgaagttagttttatcattgctcctctag

SEQ ID NO: 202414 - DNA, 398 bp, Homo sapiens
agaagtttgagcttaaatatacaaatttaagattcttatttactggggctataagttgcattcatcttaacacaaaaatcaatgtcagagaaaatacagtgatcttatgtccagtttatattttattatggggaagagggataaaacagtctcaatgttttgttaacatattcttcctttataatttagaaatgccatttttccttgagcacaaaacataggaatttcaaacatctaatatggactcctgtttatcagttagtaattttttttttttttttgggagagctgaggcagaattgcttgaacctgggaggcagaggttgcagtgagccgagatcacgccacagcactccagcctgggtgacagagcgagactccgtcccccccaccgtaga

SEQ ID NO: 202415 - DNA, 374 bp, Homo sapiens
attatgatgtttacagtctagccaggagagaagctgtacatagaaactttaaatccaagatagagattgaaaataaacaaaaatggctgagcacagtggctcacacctataatcccaacactttgggaagcagaggtgagaggactgcttgagaccaggagtttgggaccagcctgaccaacatagcgagaccccatctctgcaaaaagtttttaaaaaattagctggatgtggtggcgtacacatgtagtcctagctacttgggaggctgaggtgggaagatggcttgagcccaggaatttgaggctgtagggaactatgatcgtgtcactgcactccagcttgggagtgacagagcaaaaccctgtctctta

SEQ ID NO: 202416 - DNA, 387 bp, Homo sapiens
gagaatattttttatttccatgaagatggctttctcttatttttcttaaagtatgtctttctttttgtctttcattttgttactttgaataaaaaagaacagcttagaaatacatttctctgctataacaaagacagcagcaaaaacatgatgaatggcatctaacactggacatcattctaaggatacagaaggaaatgctgggactatggcaactagagcatttgcccaacctggaaagggattccctgtgcaacctcaatgagttttgccctaagaatgtgggcccaaggaagtcacatttttgacttttcaaaagaagtcagaaaccagatttttaagtctgaaatcttcagatggctggttttggaaatggaaaaatattgt

SEQ ID NO: 202417 - DNA, 471 bp, Homo sapiens
gaaaaccaatcagactagtgctctgtaagagcgattgcacactcagccacttcaaaaatcaatttactcttttccagtcatttccaagtgacccaggtgatgacttcctgtatcacaatcatagtgcaatgctgtccaagaccgtcagtgcgacagagggttgcaaaggtaaactgcctggaaaatcacttcaaaatagtaataagccttctgagggagttgtggacaaagtatatcaacttaatactaaaaagtataatgctctgatatttgttttacgaaactcaaaaaataaataaaataaaaagtgggatagtaatgttccaaataatgagctcttttcctctgaagagccttcccaccattttgcaaaatgttgcaacatccaagttctgccacaggtaagcaatggcttgtcaatgataagcagcttagacgacatgggcgtcaatctgaggtaggagaggaatg

SEQ ID NO: 202418 - DNA, 348 bp, Homo sapiens
tcgagtatttgtccattagcaactccaaggttttcagtagtatcggtacgaacgcagggctgagccccagctgtccttgacagggtgtgtctgccagcccctgcagggaagcaggactgaccaaaatcaaccccgggacccccctcctgctgccctgcagtcccggtgtctctgccaagtgctccggggaaaggactgtcaggcacagtgtcactgacagagtccgtggagttctgggggctgtcaaaagtcctgggcgtaactgacgggggcatgtcacccataaattctgcatcctctgcactgacactgttctgctgagttggcatgccattgaccagggcttct

SEQ ID NO: 202419 - DNA, 528 bp, Homo sapiens
gacgagttaactgtattttctttttgtactttaagttaaacctttctttctccctgtcttaaactacaagatttgaatacagctatatatgacctctgacagaacttatttcaactcccagcactaggcagctacagacacacagaaggaacagacaatcagaggaaaactacagacatgtaaaaagattttataaagtttataaagggatcaacttaagaatcaaagtaaatgaaagctatggcacattccttaactacaatgcaaaggttaagaaaagaaaaagggttgggtgtggcggctcacgcctgtaatcccagcactttgggaggctgaggcgggcggatcacaaggtcaggagatcgagaccatcctgactaaccatcctgactaacacggtgaaaccccatctctactaaaaatacaaaaaattcgctgggtgtggtggtgggtgcctgtagtcccagctactcgggaggctgaggcaggagaatggtgtgaacgcgggggggcggagcttgcagtgag

SEQ ID NO: 202420 - DNA, 354 bp, Homo sapiens
tcgatcagaggatccccgtcaatttctacacacaacagagaaattagggaaaaacctagagaaaacaaagaaacaaaggaaagaaggtgcttcaaggaaagagtggtcaatagtgatgaacacttctagaaagtcaagtcactgaaaagtgaacattatcaaacatgcagcttgtgagtcatgtaagtggaatgctgggtgcatcaaccaggctgcagtgggtacagggtttatttaggatggaggaggatgaaaatgttctaaaattgattttagtgatagttgcacaactctgaatatgttaaaaatcatttaattgtacactttaaataggcaaattgtgtagaaattgaa

SEQ ID NO: 202421 - DNA, 310 bp, Homo sapiens
cagaatcttagcttcatttggtcttttctgaacataaaaaaaaatcagctttcttattaaaaaatctctaaaatggtgataatcatggttaacctgtaacgtattgtaaaaattgaaggagaggatgttcattaatgcagcatgttgttaattggaaaacagtttaaaagtgtgatgtagccgcattgtttgagtctcagaaacaataattcccttctccagtctatgtgaaattatctcattttcttcactaatttgacaaaatatatttcattagtttatcacttggtgactgaaagtagatgcctta

SEQ ID NO: 202422 - DNA, 354 bp, Homo sapiens
cgaagatcacttcagggaatgcataagaaagttctgtaactattgaatattatccccatgagaggcagggggaggtctgtagggggaggtctgcagcagctccctgcagcaaaagtgagcagcttcgtcatctttgcaggctgccaagcaccgggcttgctgaccttctgaatctggccactggccacctgtagagcttcattcattccttcccactgctcctgctcagctgttttcccaaactctgtgagcccctgttccaggcacagtggacttgcctgaacacattgtgtttatctccttgcactagaaaatatttgctcttggtgaatcctaggccttggtgagtgtggg

SEQ ID NO: 202423 - DNA, 462 bp, Homo sapiens
atttatttggaagcatatgataaagtttaaagtacatcagtacccaaatccttaaaaatgcatccttttgataaaacatagggagagtctcctacagtcctctgttcctaatctcactattccaatttagaatcactgtgtttgttattgtaactattaatttttttctttttcttaaaacccaccttgaagggaataattattaatttatttaaaagcttagtcaagtcaatcttaaaaatatacgctaaattcaatgtgtgctctgagtgtcctggaggtgtttaaatcactatagtgatatgggctggctcgtataattatatacctagtttgggttctactattatgaagggtgtaaatcaataagttcagcactgttttaactcagatattcattctctatagcacttgaacccattttcagtaaaaaaataaaggaatttgtgtctttgccatgtt

SEQ ID NO: 202424 - DNA, 568 bp, Homo sapiens
tccctctcagtatatgttcatctgacttcatctctactataatctcattaccggaacttcatcggcctctttgctgcttcacaaacaataccgggatacttcctcttaaggcgttgtattggctctatacttctctgatggaccattatcgtcccaggtatcaccatggctaactcatggcaacttctcaaagaggagaccatcctgtttaaaaccaaaaacccaaactagggccacctgtaatcccaactactcgggaggctgaggcagaagaatcgcttcaacctgggaggcggaggttacggtgagccaagattgcaccattgcactccagcctgggtgacagaaactctgtctcaaaaaaaaaaaaaaaggtgcaggtaatttgtgttctttgacacccaacaaaaacaaatgcaaattctccatggatgaaactgtctaaacctaggtccctcagatttccacagattaaatcaggctccctgtcctcaaaatgttagcaatcacacaagtaaaccaccaaaagtttgagtcaccagaaccaaagtgtgagatttagacccat

SEQ ID NO: 202425 - DNA, 385 bp, Homo sapiens
gttgctacctgggtactggccttaaaaatgagttggaaaatgatctcttctttaattttatgaaaggggctgtgtaaaattattgttaaaagccttattcaaatgttgtgtagaattcaaaagcaaaaccatttaagcctaaagactttactgggggaaagattttaaattatgacttcaatctatttaatgattatagaataatttagattaattatcctttttgattgagtttttacagtttgtagttttctgtcgaacttctgaacataaagttgtttatagtgttccacaattacctttttaatggtttcaggatttgtattaatacagcctcttttattcctaatattggtcattcgtgtcttctaatttttttgtcatt

SEQ ID NO: 202426 - DNA, 388 bp, Homo sapiens
tattttatttcttcatttatttgaagatattaaaagagcataataaaaatatttatatgatatacattatagacagggagcactgcctctgatagagttgagaaccattgtactaagctactcatttcaaaagatgttaggtttgccaccaacaaatatatgcaagtcccaacagggcacataaatataggtaacagtctagtccctgtcctcaaagaggtcagagtctcataaaacaaagtaatctaccaggtactctccatagatgtttccaacgaatacttttagcaggagaatataagctttataggccacaccatttaaacctggccctgaaggatgaaaagctgaggaaaaaaagctttccagtcaaaagcagaatacaggc

SEQ ID NO: 202427 - DNA, 753 bp, Homo sapiens
actggctgctccgcaccattgccttgctttagtcctgctacagcagtagacaaagcgagtctgctttgagctttatggttttttgccaaagtccatactagatggcgcatgctctccaaacttggctttgtccatcaaggttcaagaaaacaatggtcagacatgttcctcttaacaaacagtatgtccccaaacagcaaaaatgcatacctagtcctttctgggtgaatttttaaatcttacataaatccatcaaccccatcctttttcctttgcctcttgggagaaattaatctagctttacattaattatgcatgttatcagatttcaagctccttgagagcaggtattttaattctataaagcctctacgtggccttggacatgggtaggtgcttaattacccaagatgctccttgaatacagatggtacacgacctacacagacttagatctttaccacttcccccctctccccaccctgacttgctcaatcctgaaggaactggagacgtctaagtgtctgaggttcacgcttccacacagaagcttgggtctgtgtgggagggaaaaaggaagccatctgtccgcaggccagaccaggccacaccctgctagcacccagaaccctttgtcccaggcccagccctgccattttactttccttgcatctggaaagcacagggaatatagtagtgacaaaagaaggaagggttgtttgagtttaagaatagtttactctaaaaaaaaaa

SEQ ID NO: 202428 - DNA, 571 bp, Homo sapiens
actggctgctccgcaccattgccttgctttagtcctgctacagcagtagacaaagcgagtctgctttgagctttatggttttttgccaaagtccatactagatggcgcatgctctccaaacttggctttgtccatcaaggttcaagaaaacaatggtcagacatgttcctcttaacaaacagtatgtccccaaacagcaaaaatgcatacctagtcctttctgggtgaatttttaaatcttacataaatccatcaaccccatcctttttcctttgcctcttgggagaaattaatctagctttacattaattatgcatgttatcagatttcaagctccttgagagcaggtattttaattctataaagcctctacgtggccttggacatgggtaggtgcttaattacccaagatgctccttgaatacagatggtacacgacctacacagacttagatctttaccacttcccccctctccccaccctgacttgctcaatctattttgtagtctcccttacccttaagaagtttcctttaatctctcccacgcttaagaagttccagtatgccgg

SEQ ID NO: 202429 - DNA, 681 bp, Homo sapiens
aattcttctaccactctctcctaaacctctccaatcaggatttcccttacagatccagccacagggcctcagagagtcacatgacctcccctgagctaaatcccagcactatttctcagtcttccttgggctggactcttaacagcatttgacacagttgatcacctgtccctgaagcttctcattcccttggcttcagaaactgcacgctcctggttctccctctagcctgaccagtagcaccttcccagttcctccttctctaccagactgcacatgggagagtaccagattcgtctcccaaactccacaaacacacacacacacacacacaccagattcgtctcccaaactccacacacacacacacacacgtgcgcacgcatatataccctttacacagctagagaaaactaaggcccagaaagaggaggtgacatgcctgatagagctggtatccaaacccagggccctgaactcgcggttgtcattgcatggtcctttacagctagtcaggcccatgtctggctttctgctcagaaccatcagctttctatagctgacttacatgtccctccagggggacagggaccagcccggtgactcaagattacacatataaagcctgtagcctggaggattcactaggccaggagagctcccctgcccgtatgactctgg

SEQ ID NO: 202430 - DNA, 385 bp, Homo sapiens
aattcttctaccactctctcctaaacctctccaatcaggatttcccttacagatccagccacagggcctcagagagtcacatgacctcccctgagctaaatcccagcactatttctcagtcttccttgggctggactcttaacagcatttgacacagttgatcacctgtccctgaagcttctcattcccttggcttcagaaactgcacgctcctggttctccctctagcctgaccagtagcaccttcccagttcctccttctctaccagactgcacatgggagagtaccagattcgtctcccaaactccacaaacacacacacacacacacacacacacacacacactcaaataccacatacttctctcaagccaagacctctaa

SEQ ID NO: 202431 - DNA, 252 bp, Homo sapiens
acacacacactgcctctctgactggtggccacctgtgtggcttgggagctaagaagccctgcttcagtctggctcctctttgcccttcctgtctgctcctggtgccaagtggctttttggagacatggatggacacctgatacctggcagtctgcatcgagacattgattttgttttttgagatgtgtgtgtatttatgtttcttctgcagctcagtgtatgtgtgtattccttcagactcaggatgtgtgt

SEQ ID NO: 202432 - DNA, 230 bp, Homo sapiens
ctatgttcatttaaaaaatatttttaattttttaaatttctgactcacaatgttcccattctatgttaattctgttttaaaatttttgaggactcttctatagcagctgcatcattttttaatttaactttattattaatttttttttttagtagttttactgggttgagttttttttttttctttagggttatttggttttgagatgtaggagttttttagtatatgtg

SEQ ID NO: 202433 - DNA, 487 bp, Homo sapiens
acctacacctgtctcttcttctgtgccccacaggtttggcggtcaactgcagtgaggtctctataccacagagtggtgagtccccaagtcccggtgaacttaggaaatgggcattatcctctggaagacgtttatagaggtgacttttttggtaagtccctgggactcctgttgacatgggaattactttcttccctcagttgttggcgtctcacatggccattcatcagctcaatacaaacaagtcttcacggaggtggagtttcctcctcacctgttgctaaaccaggcagcgtggattggcatattcactgacttcatggcacgaaggcctacaaaagcggaacaacttttcaccagtgcaaaaatgttccaaaagatactctctctgtccaatacacttgtaagtgcattctagaatataaaaaatagagagagataaatgttctgttgaaagataatctcccaaaatataagtttttatgta

SEQ ID NO: 202434 - DNA, 339 bp, Homo sapiens
  misc_feature (34)..(35): n is a, c, g, or t
tctatttcgtcactctcgacttttcccctacctnnccccaccacctggaccgtgagggtttggcggtcaactgcagtgaggtctctataccacagagtggtgagtccccaagtcccggtgaacttaggaaatgggcattatcctctggaagacgtttatagaggtgacttttttggtctactgtgtctgccattgaagttgaagacatacaaggagcacttgacaacttgagaactgcgttcaaggaaagtctttaacaattctcctcctcacctccacccctagtcctcaccttctccatctcggaaataggaggagtctgtttcactcattcacagg

SEQ ID NO: 202435 - DNA, 741 bp, Homo sapiens
  misc_feature (674)..(674): n is a, c, g, or t
  misc_feature (691)..(691): n is a, c, g, or t
ggcgcccggctccgctgggggcgggacggcgggcggcgggcggggccgtgtgcgcctgcgtggtgtctgtcccggccgcagccccacgccggctgcagctccgcgagccgagccggatctcgagcggggtacacgggctgaggcggcggcggcggccccgccccggggctccattgttaaggcggctgcggctctgtcggctgttcagctgcgctccagtcggcccaggcgccgcggcgaggagcgagcgctgcgaggtggcggcctgagcaatggaagagttaatagttgaacttcgtctctttcttgaactcctggaccatgaatatctaacctcaactgtcagggagaaaaaggcagtgataaccaacattctgctaagaatacagtcatccaaaggttttgatgtgaaggaccatgctcagaagcaggagaccgctaacagcctgccagcccctcctcagatgcccctgccggagatccctcagccctggctgcctcctgacagtgggcctccaccattgccaacattcctccctcccagaaggttattatgaggaagctgtgccgctgagccccggaaaagctccggaatacatcacatcaaattatgattctgatgcgatgagcagctcttatgagtcgtatgatgaagaggaggaggatgggaaggngaagaaaacccggcacnagtggccctccgaggaggcctccatggacctgtcaaggacgccaaatctg

SEQ ID NO: 202436 - DNA, 889 bp, Homo sapiens
atccttaattaaattaattttccccccccgctgtcccggccgcagccccacgccggctgcagctccgcgagccgagccggatctcgagcggggtacacgggctgaggcggcggcggcggccccgccccggggctccattgttaaggcggctgcggctctgtcggctgttcagctgcgctccagtcggcccaggcgccgcggcgaggagcgagcgctgcgaggtggcggcctgaggtgagacggcgcgactggcggcagggtctccggacccggcgggggtctctgccccgggcgtggaagctccgagcggggctccgcagggtccggggtccgtgcgcctgggctttgtctcggcctcgggtggtaccgggggctccgcgcctgctgcgacgccgcgtgggcccgcgcgggggtcccggtcgtcctgcgggtgggggccggtccccactgctccccagctccccgcgtctgcccggaggggactgcgtggacccgggcgctggctcctgcccggtgcccccgcggcgtggctggtccccgtgtgcgtcagagggggccctgcgaagacccactcgtggggcggggtccgggtcaccaagagtgggaggctccgccgccctcccccgtagcgagactgcttcgtccgacttaccgaggggactgcgcggaccctcggacgagggggtccgtgactctggatgggggctctttcttggccccgcatgacggcttcctgagtgttttgtcacctataggttgttgcgtggacccacgcgcgtgggtcccggccgccctgcgagtggggctctgcgccgccccgtggctcgtctgggtcgaccccgcctgggacgcgagtgtaatgggggtccgtgcgcggggggcgcggttg

SEQ ID NO: 202437 - DNA, 705 bp, Homo sapiens
  misc_feature (638)..(638): n is a, c, g, or t
  misc_feature (655)..(655): n is a, c, g, or t
atccttaattaaattaattttccccccccgctgtcccggccgcagccccacgccggctgcagctccgcgagccgagccggatctcgagcggggtacacgggctgaggcggcggcggcggccccgccccggggctccattgttaaggcggctgcggctctgtcggctgttcagctgcgctccagtcggcccaggcgccgcggcgaggagcgagcgctgcgaggtggcggcctgagcaatggaagagttaatagttgaacttcgtctctttcttgaactcctggaccatgaatatctaacctcaactgtcagggagaaaaaggcagtgataaccaacattctgctaagaatacagtcatccaaaggttttgatgtgaaggaccatgctcagaagcaggagaccgctaacagcctgccagcccctcctcagatgcccctgccggagatccctcagccctggctgcctcctgacagtgggcctccaccattgccaacattcctccctcccagaaggttattatgaggaagctgtgccgctgagccccggaaaagctccggaatacatcacatcaaattatgattctgatgcgatgagcagctcttatgagtcgtatgatgaagaggaggaggatgggaaggngaagaaaacccggcacnagtggccctccgaggaggcctccatggacctgtcaaggacgccaaatctg

SEQ ID NO: 202438 - DNA, 574 bp, Homo sapiens
atttgaggactcatttcagatagcaaaatacttcatgtccctctactctcccttactcgatggtgtacttttagtgtccacttggtggtagaggttgtgctagaacaaaaacaatgataattaacactgacagttgctgtggctgagggccatagctaagttacagatacagaagagatggctcagcgaagctgagaaattttactgctttcggagggtggaacttggattataatccaaagtctttgcagttagactccaaagtttgatgataaaaagctgttctgttcaggctgggcgcggtggctcatgcctgtaatcccagcactttgggaggccgaggcgggcggatcatgaggtcaggagatcgagaccatcttggctaacacggtgaaaccctgtctctactaaaaataaaaaaattagccaggcgtggtggcgggcacctgtagtcccagctactcggaaggctgaggcaggagaatggtgtggacctgggaggtggagcttgcagtgagccgagatcatgccactgcaccccagcctgggggacagagcaagactccatctcagg

SEQ ID NO: 202439 - DNA, 906 bp, Homo sapiens
tctcaaaaatgccatgcttttccctgatgggagcctcggcccacgtgtgccttctgcttgtggtcatggtcctctggctctttgcagtcatggtcctctggctctttgcatgtctgtgccttccctgacatccccattcccgttacttcctagcccaccaccctttatttcctttagctttatattgatctgaccttaaattgtttttatatttattggagtgtttattcttcatcagtaccatatgcaccccattaaggcatttacacttctgctttgttctcttctgtattcccagcacctaaattaatgcccagtatatagtaggcactcagcataaattcgttgaacaaaataaataagatatagagccactggagcacagaggacaggttctttctggtcgaaggcactaaggacagtttcaccgagaagattttgaggagagtcgagctaaaaatgaggaggattttgatagaaggatggaggggaatatgttccaggcaaagtgtgtatcttaaaagaaaagtgtgagaacaagaaaggaaacgaattaaggatatgatatgtgttagcaactttgcgtgttatcttatttatacccattttatgtgaattgaggctcagaaaaatgttagtcatcccaggtgctctgtaaataagtacttgaactaggatgcaaatccagattttcctgggaccgatgtctatgattttacctttagctatgccttcttctagtgaataatcaggtaaaatttgacaaaggctaaatatatgtaaatcaagtattggagaacaggtagggaaaacctcaaaaccaaaagccaaaagacatcctttagaaggaagaaagctgtttctgtttctccaatatttttaggagttagaatttttaatctctaa

SEQ ID NO: 202440 - DNA, 979 bp, Homo sapiens
  misc_feature (943)..(943): n is a, c, g, or t
  misc_feature (962)..(962): n is a, c, g, or t
  misc_feature (965)..(965): n is a, c, g, or t
aaacttaggctaggtacgaggcggggtgaatcggaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaagagacgggtccacttctaatggggtctccgataattcgccttcattccttccgaancggtggtggaagtgtcccngtngtgagtcccttatc

SEQ ID NO: 202441 - DNA, 1024 bp, Homo sapiens
  misc_feature (867)..(867): n is a, c, g, or t
actctctaataaccaccgctacaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaagtgtnacccttggtatgggatgggcctcatctaaattccgtcaactccgagagaaccgggtaaaggcgcatggggccacaaagggggacatgtttgtaagggcctctctggacaaagggagatacagcgggtgggaacaaaagggggccgccgcacctagcg

SEQ ID NO: 202442 - DNA, 875 bp, Homo sapiens
tgggttttactagtgggcgttttccttcgaatgttgtcgggatagggctcgcaactgtgaaaggaagggagtttgaaagttgttgtatactgttaacgattgtctgcccatgtcctgcctgaaataccatgattgtttatggaaagtatctttaataaagctggatacagtttggcttggaatgctgcctctgatcttttcccacaagtggggtaacctggtttatccaagtctcttggaacagggtacgttctgctttgaggtactccatgtacagtctaatgatgatctttcactgatttatagtcagcttccaaaacacacagtgctaggtgcagttaggaaggattccaggagtagacttagctgatggtgaaaggctgggagtatggagtgatttctgtacttggttatgcagcattccctgcagtgtttgttttttgcatgactccgaatacatgaagtgtattaaatgcagatttttggtagatctgcggttttggctgggtagctgacaggagcctctctacttccatctgcatttgcaacttctataaaattagcaaattaatagactcatgtcagagagtgtctctgtgaatgtgtacacagttgtccatttgtaaggtagatgacactttgctcctaagtagacctgcaaacaaagacaatggggtctttcctgattcctttagtttggagatgcagagaaccccacgtttctctaagtgaaatggcaagaagttatttgttagaatatggaactggtaacaaattcatgtttgcaccttgaatttgctttcacagacctggctgtattgttggacaggaataaagtaaattggagactaattgctttgtccattcccttagtc

SEQ ID NO: 202443 - DNA, 1173 bp, Homo sapiens
  misc_feature (113)..(113): n is a, c, g, or t
  misc_feature (128)..(128): n is a, c, g, or t
  misc_feature (160)..(160): n is a, c, g, or t
  misc_feature (177)..(177): n is a, c, g, or t
  misc_feature (180)..(181): n is a, c, g, or t
  misc_feature (185)..(185): n is a, c, g, or t
  misc_feature (196)..(197): n is a, c, g, or t
  misc_feature (210)..(210): n is a, c, g, or t
  misc_feature (236)..(236): n is a, c, g, or t
  misc_feature (256)..(256): n is a, c, g, or t
ggaggacggggagaaatcgagcctctcgtgtaccgactcaagagtcaccgtcggcgcgtggctgtgatgccgcggtccagcgacctatgatcccgtgttccgtcgccggcgcnaatgcccaagagaanggctgaaggggatgctaagggagataaagcanaggtgaaggacgaaccnacnngagnaagatccgcgnnggttgtctgctanacctgctcctccaaagccagagcccngagcctaaaaaggcccctgncaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattagtgatgacttgtagagatgattgtagaaaggcatagtggtagttaggacagaggagaaacaattacatgggtggtaatggggggaaggggggcatagtgtacacataatacgacgtgtcgtccaaagcatggataggcatgtggaagaaaacccatgtcccattctagactcgggagagactcccccatgggatacccaggagagaggcaatcccgtgagtttgaaagatattgggacaccatgggggaaaaagggctaggggattagagaagaccaatagggaaaaaggtgaatgtcatacgtataacgaattaagagattgaattaattccataagcgaaagaataagtggaacttgacccaagacatgggatcccagtggccagggcaagcgggaactccaagcaactgcacacggaaaagggaccggtaaaaagacgcgggggccagtcacgaaggggatcccgcaatatgtcgccgtaaagactcgcccacacaggcgtgaggtgacagaggtgaacagctcgtggtaagtgcacacctagagtcgcggagagcagacaacacgcgtcggaggatgggccacagaggaagaggagcaacatcgcagtccagtggactcaagaggcacaatcagagtcgccgtacaatcacagacaggaagcatagaacacacgagcgtgcacaga

SEQ ID NO: 202444 - DNA, 496 bp, Homo sapiens
ccacacaccccccttctcactccctccagaggaggtgagtttaaaccccgcccacgtgaccccagctgggccaatgaacggcggcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaagaaggtacgtggcgcgagggccccaggcgccgggccaccactgccgccaccgccgccgccgcctccctggtgcagggagcgagaatcggcgccgagcaggagccagcgcagcctccccgcgcgggggctggagacggtgtcgggcagctcggggctaaccctgagcggctcggctgcccgcgggcgccagaggccatattggaggagcggcggccgc

SEQ ID NO: 202445 - DNA, 1997 bp, Homo sapiens
tggtactggtccggaatctctaggatcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaatgctgcctctgatcttttcccacaagtggggtaacctggtttatccaagtctcttggaacagggtacgttctgctttgaggtactccatgtacagtctaatgatgatctttcactgatttatagtcagcttccaaaacacacagtgctaggtgcagttaggaaggattccaggagtagacttagctgatggtgaaaggctgggagtatggagtgatttctgtacttggttatgcagcattccctgcagtgtttgttttttgcatgactccgaatacatgaagtgtattaaatgcagatttttggtagatctgcggttttggctgggtagctgacaggagcctctctacttccatctgcatttgcaacttctataaaattagcaaattaatagactcatgtcagagagtgtctctgtgaatgtgtacacagttgtccatttgtaaggtagatgacactttgctcctaagtagacctgcaaacaaagacaatggggtctttcctgattcctttagtttggagatgcagagaaccccacgtttctctaagtgaaatggcaagaagttatttgttagaatatggaactggtaacaaattcatgtttgcaccttgaatttgctttcacagacctggctgtattgttggacaggaataaagtaaattggagactaattgctttgtccattcccttagtc

SEQ ID NO: 202446 - DNA, 1222 bp, Homo sapiens
  misc_feature (1065)..(1065): n is a, c, g, or t
tggtactggtccggaatctctaggatcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaagtgtnacccttggtatgggatgggcctcatctaaattccgtcaactccgagagaaccgggtaaaggcgcatggggccacaaagggggacatgtttgtaagggcctctctggacaaagggagatacagcgggtgggaacaaaagggggccgccgcacctagcg

SEQ ID NO: 202447 - DNA, 1211 bp, Homo sapiens
aaacttaggctaggtacgaggcggggtgaatcggaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202448 - DNA, 1207 bp, Homo sapiens
cggacgcgtgggtcgacccacgcgtccgagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202449 - DNA, 1946 bp, Homo sapiens
tggtactggtccggaatctctaggatcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaatgctgcctctgatcttttcccacaagtggggtaacctggtttatccaagtctcttggaacagggtacgttctgctttgaggtactccatgtacagtctaatgatgatctttcactgatttatagtcagcttccaaaacacacagtgctaggtgcagttaggaaggattccaggagtagacttagctgatggtgaaaggctgggagtatggagtgatttctgtacttggttatgcagcattccctgcagtgtttgttttttgcatgactccgaatacatgaagtgtattaaatgcagatttttggtagatctgcggttttggctgggtagctgacaggagcctctctacttccatctgcatttgcaacttctataaaattagcaaattaatagactcatgtcagagagtgtctctgtgaatgtgtacacagttgtccatttgtaaggtagatgacactttgctcctaagtagacctgcaaacaaagacaatggggtctttcctgattcctttagtttggagatgcagagaaccccacgtttctctaagtgaaatggcaagaagttatttgttagaatatggaactggtaacaaattcatgtttgcaccttgaatttgctttcacagacctggctgtattgttggacaggaataaagtaaattggagactaattgctttgtccattcccttagtc

SEQ ID NO: 202450 - DNA, 1681 bp, Homo sapiens
  misc_feature (178)..(178): n is a, c, g, or t
tcccgctctcctcgggctcgccgcccccgccccgtgccccctcccccatcgcgagggccccttccctcccctccctgcgggcgggcaattcaaacccgaaagggcgggaaggcggcgctcggggttggcgggcgggggaaagcgctgccgccaaaaaaccgccgccgtgagggggtgncttgtgcggtatggccccgcccctcgcccacgttccccgcgcacgagacgcgcgctgtcgccgcccacgagttccccgggctgcgcgcgcctccctctcccgccctcgacggctgccatagcaacggcgctgggctccgcctccggagggggtttgtttgcgccatctgcagctgttgctcctgcctgtcgcggtggtgcgggctccgctgccctccccggctgcgctccggtccagccctcgcttctcggggtcggcgagccggagctcctgcgcgcgcttcgttcttatacgaacgtcgggctcactcatttatgtcctagaaaagttgtgtggacgactgctttaattttcatttttagcactctaaagtttgggaagtaattaagaaccacctcaaaatctgcagttttttgttcttgtttcttataggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202451 - DNA, 1296 bp, Homo sapiens
tggtactggtccggaatctctaggatcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaagaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202452 - DNA, 1145 bp, Homo sapiens
aaacttaggctaggtacgaggcggggtgaatcggaggcgagaacgacccccggaccgaccaaagcccgcgcaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202453 - DNA, 1095 bp, Homo sapiens
actctctaataaccaccgctacaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202454 - DNA, 1821 bp, Homo sapiens
tcccgctctcctcgggctcgccgcccccgccccgtgccccctcccccatcgcgagggccccttccctcccctccctgcgggcgggcaattcaaacccgaaagggcgggaaggcggcgctcggggttggcgggcgggggaaagcgctgccgccaaaaaaccgccccctcgcccacgttccccgcgcacgagacgcgcgctgtcgccgcccacgagttccccgggctgcgcgcgcctccctctcccgccctcgacggctgccatagcaacggcgctgggctccgcctccggagggggtttgtttgcgccatctgcagctgttgctcctgcctgtcgcggtggtgcgggctccgctgccctccccggctgcgctccggtccagccctcgcttctcggggtcggcgagccggagctcctgcgcgcgcttcgttcttatacgaacgtcgggctcactcatttatgtcctagaaaagttgtgtggacgactgctttaattttcatttttagcactctaaagtttgggaagtaattaagaaccacctcaaaatctgcagttttttgttcttgtttcttataggctgaaggggatgctaagggagataaagcaaaggtgaaggacgaagtaagtcattctctcttcaagggtcaaagccttggactagcagaggccactggactcggtgattaaccgtaacctgtgtcctgaatttacactcctataatctagagcaaattgataccaaactttcaaagcgacttacctgtcctatttctaactttctcgttgtctttaatagccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202455 - DNA, 1386 bp, Homo sapiens
aaacttaggctaggtacgaggcggggtgaatcggaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaagtaagtcattctctcttcaagggtcaaagccttggactagcagaggccactggactcggtgattaaccgtaacctgtgtcctgaatttacactcctataatctagagcaaattgataccaaactttcaaagcgacttacctgtcctatttctaactttctcgttgtctttaatagccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202456 - DNA, 1272 bp, Homo sapiens
aaacttaggctaggtacgaggcggggtgaatcggaggcgagaacgacccccggaccgaccaaagcccgcgcgccgctgcatcccgcgtccagcacctacgtcccgctgccgtcgccgccgccaccatgcccaagagaaagaaggctgaaggggatgctaagggagataaagcaaaggtgaaggacgaagtaagtcattctctcttcaagggtcaaagccttggactagcagaggccactggactcgccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202457 - DNA, 1169 bp, Homo sapiens
aaacttaggctaggtacgaggcggggtgaatcggaggcgagaacgacccccggaccgaccaaagcccgcgcgccgctgcatcccgcgtccagcacctacgtcccgctgccgtcgccgccgccaccatgcccaagagaaagaagccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202458 - DNA, 1738 bp, Homo sapiens
aaacttaggctaggtacgaggcggggtgaatcggaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaagtaagtcattctctcttcaagggtcaaagccttggactagcagaggccactggactcggtgattaaccgtaacctgtgtcctgaatttacactcctataatctagagcaaattgataccaaactttcaaagcgacttacctgtcctatttctaactttctcgttgtctttaatagccacagagaagatccgcgaggttgtctgctgtaagtgtatgcttttgaattttcgtgcttgtccctgaaactaaaaaacatcaaaaaacaattccctttgcttccatgaattatggttagtgcctggttttgaatcattgcctctacttgggactcttgcccctttgggttttgctggttctgaaattctgatgcctgtagccaaagtgggacatttgagtgggcttctggaaatccaacattctagaagaaagccaaccacaaaaacttttgaggaggaggagaaacttctctacccttggtacttttggttggttgtgggtggttttcttcagtccattgtactgatgttcactttttcctctcttcctgccaaaaaaagaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202459 - DNA, 1299 bp, Homo sapiens
aaacttaggctaggtacgaggcggggtgaatcggaggcgagaacgacccccggaccgaccaaagcccgcgcgccgctgcatcccgcgtccagcacctacgtcccgctgccgtcgccgccgccaccatgcccaagagaaagaaggctgaaggggatgctaagggagataaagcaaaggtgaaggacgaaccacagagaagatccgcgaggttgtctgctgtaagtgtatgcttttgaattttcgtgcttgtccctgaaactaaaaaacatcaaaaaacaattccctttgcttccatgaattatgaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202460 - DNA, 1186 bp, Homo sapiens
cggacgcgtgggtcgacccacgcgtccgaggctgaaggggatgctaagggagataaagcaaaggtgaaggacgaaccacagagaagatccgcgaggttgtctgctgtaagtgtatgcttttgaattttcgtgcttgtccctgaaactaaaaaacatcaaaaaacaattccctttgcttccatgaattatgaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202461 - DNA, 1170 bp, Homo sapiens
tggtactggtccggaatctctaggatcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaagaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202462 - DNA, 1190 bp, Homo sapiens
aaacttaggctaggtacgaggcggggtgaatcggaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202463 - DNA, 1253 bp, Homo sapiens
agagagagagagagagagagagagagagcaagaattctgttgttagtttataggaaaatctgcatttaaatattaaataccccagggtttaaactaatttattcttctgttacttaggaaattctaagtactaaagattatagcaaattacagataatttagcctagttttgatcagttgttcttgtcaaatgggtgagggtttgtgttttatcttgagtaaacaatcctaccttgtgcagaactttgcagaccataccttggtaatacgaaatggggagaaacagttctattttttcccctttttcaaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202464 - DNA, 661 bp, Homo sapiens
tggtactggtccggaatctctaggatcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacggtggtgtcgggggggggggccgggggctcgggggggggga

SEQ ID NO: 202465 - DNA, 1264 bp, Homo sapiens
tggtactggtccggaatctctaggatcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccagcaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202466 - DNA, 960 bp, Homo sapiens
aaacttaggctaggtacgaggcggggtgaatcggaggcgagaacgacccccggaccgaccaaagcccgcgcgccgctgcatcccgcgtccagcacctacgtcccgctgccgtcgccgccgccaccatgcccaagagaaagcaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202467 - DNA, 774 bp, Homo sapiens
tggtactggtccggaatctctaggatcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaagaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttctttggtctctgggtcccacagaggtaccttacttgtccatgtcccttggcgcctgtctccccttgc

SEQ ID NO: 202468 - DNA, 1262 bp, Homo sapiens
  misc_feature (143)..(143): n is a, c, g, or t
  misc_feature (158)..(158): n is a, c, g, or t
  misc_feature (190)..(190): n is a, c, g, or t
  misc_feature (207)..(207): n is a, c, g, or t
  misc_feature (210)..(211): n is a, c, g, or t
  misc_feature (215)..(215): n is a, c, g, or t
  misc_feature (226)..(227): n is a, c, g, or t
  misc_feature (240)..(240): n is a, c, g, or t
  misc_feature (266)..(266): n is a, c, g, or t
  misc_feature (286)..(286): n is a, c, g, or t
  misc_feature (419)..(419): n is a, c, g, or t
  misc_feature (932)..(932): n is a, c, g, or t
aaacttaggctaggtacgaggcggggtgaatcggaggcgagaacgacccccggaccgaccaaagcccgcgcgccgctgcatcccgcgtccagcacctacgtcccgctgccgtcgccgccgccaccatgcccaagagaaaggcnaatgcccaagagaanggctgaaggggatgctaagggagataaagcanaggtgaaggacgaaccnacnngagnaagatccgcgnnggttgtctgctanacctgctcctccaaagccagagcccngagcctaaaaaggcccctgncaaagacctgggagaataaggtacccaacacgggatatgatcgtggaacaatgctgaattgctgtgtcaaggacggtggaactaaacgccgtgtcacgaaagaatgcgagactgctctaaaatcatgacccangtgcatcatgacacatgcctgaatgcgtcgtcctgcttaggagtgaccaagtgtggaagtctgtggtgtcacttctctcaggactgaagcttgtgctcaacttcctgtggtgatcctcgttacagatttctcgaaaaatcatgctacttcttgttatattccaccggtgtctttaatcccaacacatgtcccaggaaactatctatgtcttgtaacgttctcttgtctaaggtctctctctctctttccatataaagtcatcttcgagtctcgagtttaaagacaatctcctagaaatattcacttttttccaatggagccatggcataaggttcgcgttgagcgcgtaataagcgtggcgcacattcccgatgtggtccatccataacccatttaagaacgccgcgtccttctccccactataggttttggaacccatttgggggatcccgccttctgcgccagaattaaaaggttaacccccttttgctgccctccggcattgtcaacttnggtaccttaacggggccggtccccaatggggcgtagttgcgccacttgcttttggggggggggcgttcccccacccccgttgtgtcccgtggtcccgttgtgggaccctccctcacgctgtgtgcaaaagtttgttctgaaaagggcctcccacactttttttgctttccaaacccctccttatgggcgcacacagcggatatatagggaacctcttccttagtgtccgtgtggctcctttctccagattgggatttcctccccactggagtcttgtggcgcgttttgggtgcattgttgttttgggcccccccctgtttaaattacccc

SEQ ID NO: 202469 - DNA, 438 bp, Homo sapiens
tggtactggtccggaatctctaggatcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaagaaggtacgtggcgcgagggccccaggcgccgggccaccactgccgccaccgccgccgccgcctccctggtgcagggagcgagaatcggcgccgagcaggagccagcgcagcctccccgcgcgggggctggagacggtgtcgggcagctcggggctaaccctgagcggctcggctgcccgcgggcgccagaggccatattggaggagcggcggccgc

SEQ ID NO: 202470 - DNA, 434 bp, Homo sapiens
ttgtatcactccaaatgtaccatttggtccagtgtgcttgtggctttcctgttaacttaaatcctggattcttgaaatctctactgtcagctgaagggcattgtgttttatactacatgaagttttcaagctaggagtaacctcaggtctcttattctggtgttcttcctacctcaattttacagtgaggcccagaggagaggtgacttagcaaagttacctagtaagtcattctcagaagaaatactgagtctcagtacctgaaacctgaactttggcctgggagcaaagtgatgctgtaggtggaatgtgaacacagatagttttgaaatctacgcattgcattaatttgtctgttttcttttaggcacagaaagctgaaggtgctggagatgccaagtgaagtgtgtgcatttttgataactgtgtacttc

SEQ ID NO: 202471 - DNA, 434 bp, Homo sapiens
gactgtccttagtgccttaacttaattagcataatggtgcctccattaatggaggttataaactgtgtggatagcttacctcgtccgtgtcattcataacgttggtttcctgatcaagaattctgttgttagtttataggaaaatctgcatttaaatattaaataccccagggtttaaactaatttattcttctgttacttaggaaattctaagtactaaagattatagcaaattacagataatttagcctagttttgatcagttgttcttgtcaaatgggtgagggtttgtgttttatcttgagtaaacaatcctaccttgtgcagaactttgcagaccataccttggtaatacgaaatggggagaaacagttctattttttcccctttttcaaagggagagaaggtacccaaagggaaaaagggaaaagctg

SEQ ID NO: 202472 - DNA, 570 bp, Homo sapiens
acccacgcgtcgcggacgcgtggggaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacggtggtgtcgggggggggggccgggggctcgggggggggga

SEQ ID NO: 202473 - DNA, 1293 bp, Homo sapiens
tggtactggtccggaatctctaggatcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202474 - DNA, 1327 bp, Homo sapiens
tggtactggtccggaatctctaggatcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtgtgccgtctgcgaacacacaacacacaaaacaac

SEQ ID NO: 202475 - DNA, 1061 bp, Homo sapiens
  misc_feature (1025)..(1025): n is a, c, g, or t
  misc_feature (1044)..(1044): n is a, c, g, or t
  misc_feature (1047)..(1047): n is a, c, g, or t
tggtactggtccggaatctctaggatcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaagagacgggtccacttctaatggggtctccgataattcgccttcattccttccgaancggtggtggaagtgtcccngtngtgagtcccttatc

SEQ ID NO: 202476 - DNA, 1227 bp, Homo sapiens
  misc_feature (19)..(19): n is a, c, g, or t
  misc_feature (22)..(22): n is a, c, g, or t
ttttttgaccgttcttctnctnctcctatgctgcgagaagacgacagaaaaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202477 - DNA, 933 bp, Homo sapiens
tggtactggtccggaatctctaggatcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttatccttagccaaatctgtgggacctgccctaattctggtacagtggtcggatggctccgtgtgctgatgcctgt

SEQ ID NO: 202478 - DNA, 1881 bp, Homo sapiens
aacctacgtaggtatgacctggggtgttaacttggcagaggggtgacaagaaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaatgctgcctctgatcttttcccacaagtggggtaacctggtttatccaagtctcttggaacagggtacgttctgctttgaggtactccatgtacagtctaatgatgatctttcactgatttatagtcagcttccaaaacacacagtgctaggtgcagttaggaaggattccaggagtagacttagctgatggtgaaaggctgggagtatggagtgatttctgtacttggttatgcagcattccctgcagtgtttgttttttgcatgactccgaatacatgaagtgtattaaatgcagatttttggtagatctgcggttttggctgggtagctgacaggagcctctctacttccatctgcatttgcaacttctataaaattagcaaattaatagactcatgtcagagagtgtctctgtgaatgtgtacacagttgtccatttgtaaggtagatgacactttgctcctaagtagacctgcaaacaaagacaatggggtctttcctgattcctttagtttggagatgcagagaaccccacgtttctctaagtgaaatggcaagaagttatttgttagaatatggaactggtaacaaattcatgtttgcaccttgaatttgctttcacagacctggctgtattgttggacaggaataaagtaaattggagactaattgctttgtccattcccttagtc

SEQ ID NO: 202479 - DNA, 1646 bp, Homo sapiens
tcccgctctcctcgggctcgccgcccccgccccgtgccccctcccccatcgcgagggccccttccctcccctccctgcgggcgggcaattcaaacccgaaagggcgggaaggcggcgctcggggttggcgggcgggggaaagcgctgccgccaaaaaaccgccccctcgcccacgttccccgcgcacgagacgcgcgctgtcgccgcccacgagttccccgggctgcgcgcgcctccctctcccgccctcgacggctgccatagcaacggcgctgggctccgcctccggagggggtttgtttgcgccatctgcagctgttgctcctgcctgtcgcggtggtgcgggctccgctgccctccccggctgcgctccggtccagccctcgcttctcggggtcggcgagccggagctcctgcgcgcgcttcgttcttatacgaacgtcgggctcactcatttatgtcctagaaaagttgtgtggacgactgctttaattttcatttttagcactctaaagtttgggaagtaattaagaaccacctcaaaatctgcagttttttgttcttgtttcttataggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202480 - DNA, 2173 bp, Homo sapiens
tcccgctctcctcgggctcgccgcccccgccccgtgccccctcccccatcgcgagggccccttccctcccctccctgcgggcgggcaattcaaacccgaaagggcgggaaggcggcgctcggggttggcgggcgggggaaagcgctgccgccaaaaaaccgccccctcgcccacgttccccgcgcacgagacgcgcgctgtcgccgcccacgagttccccgggctgcgcgcgcctccctctcccgccctcgacggctgccatagcaacggcgctgggctccgcctccggagggggtttgtttgcgccatctgcagctgttgctcctgcctgtcgcggtggtgcgggctccgctgccctccccggctgcgctccggtccagccctcgcttctcggggtcggcgagccggagctcctgcgcgcgcttcgttcttatacgaacgtcgggctcactcatttatgtcctagaaaagttgtgtggacgactgctttaattttcatttttagcactctaaagtttgggaagtaattaagaaccacctcaaaatctgcagttttttgttcttgtttcttataggctgaaggggatgctaagggagataaagcaaaggtgaaggacgaagtaagtcattctctcttcaagggtcaaagccttggactagcagaggccactggactcggtgattaaccgtaacctgtgtcctgaatttacactcctataatctagagcaaattgataccaaactttcaaagcgacttacctgtcctatttctaactttctcgttgtctttaatagccacagagaagatccgcgaggttgtctgctgtaagtgtatgcttttgaattttcgtgcttgtccctgaaactaaaaaacatcaaaaaacaattccctttgcttccatgaattatggttagtgcctggttttgaatcattgcctctacttgggactcttgcccctttgggttttgctggttctgaaattctgatgcctgtagccaaagtgggacatttgagtgggcttctggaaatccaacattctagaagaaagccaaccacaaaaacttttgaggaggaggagaaacttctctacccttggtacttttggttggttgtgggtggttttcttcagtccattgtactgatgttcactttttcctctcttcctgccaaaaaaagaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacacttcatggtggttttggggggaaggggcatatgtcactaatagaatgtctccaaagctggattgatgtggagaaaacacctttcccttctagtttggagagacttcctctgggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagt

SEQ ID NO: 202481 - DNA, 1652 bp, Homo sapiens
tggtactggtccggaatctctaggatcgggaggtgaaatccggttctaaccggtccggggctcccagcgctataaaaactttataaaccccccggagcccgagcagtgtgaagaagaggcgagaacgacccccggaccgaccaaagcccgcgcgccgctgcatcccgcgtccagcacctacgtcccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcgaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcatgggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaatgctgcctctgatcttttcccacaagtggggtaacctggtttatccaagtctcttggaacagggtacgttctgctttgaggtactccatgtacagtctaatgatgatctttcactgatttatagtcagcttccaaaacacacagtgctaggtgcagttaggaaggattccaggagtagacttagctgatggtgaaaggctgggagtatggagtgatttctgtacttggttatgcagcattccctgcagtgtttgttttttgcatgactccgaatacatgaagtgtattaaatgcagatttttggtagatctgcggttttggctgggtagctgacaggagcctctctacttccatctgcatttgcaacttctataaaattagcaaattaatagactcatgtcagagagtgtctctgtgaatgtgtacacagttgtccatttgtaaggtagatgacactttgctcctaagtagacctgcaaacaaagacaatggggtctttcctgattcctttagtttggagatgcagagaaccccacgtttctctaagtgaaatggcaagaagttatttgttagaatatggaactggtaacaaattcatgtttgcaccttgaatttgctttcacagacctggctgtattgttggacaggaataaagtaaattggagactaattgctttgtccattcccttagtc

SEQ ID NO: 202482 - DNA, 782 bp, Homo sapiens
aaacttaggctaggtacgaggcggggtgaatcggaggcgagaacgacccccggaccgaccaaagcccgcgcgccgctgcatcccgcgtccagcacctacgtcccgctgccgtcgccgccgccaccatgcccaagagaaagaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttttaaaagctatgttgttagcacacagaacaaaaaaaaaaaaaaaaaaaaaaaaaaaaaaaaaaaaaaaaaaaaaaaaacggggggattttagggggggggggaaaaaggggtataaaagggccagtggcaaaggtttccgccccaattttggaaaaggggacaaaggcaagaacccccagaggggacgcaaaatcggaaaaacgcgttacgctcaaaagtacgcaaaaaacaccgtacgaaacaagagggcaaaagcagaaaggtaacaa

SEQ ID NO: 202483 - DNA, 371 bp, Homo sapiens
  misc_feature (2)..(2): n is a, c, g, or t
  misc_feature (4)..(4): n is a, c, g, or t
cncngccgccgacgctgcgagagacgacgaagggcctgagatctgcagtgaagtggatcaatgatgaaactagccaaatctgagcatcagaagtctccgtctacctgatgcatgatctctacagttctgagaagcaaaactataaaacaatgtaaaacaataagggcatatgtctggtgtgtgtgtgtgtgtgtgtgtgtgtgtgtgtacgcacatgtgtttataaagataacagctgtaggaatgaatgagattgagggtgggggggtgcgtatgtatgtctatgaaagcctaatcatttctgggcaatgatgaaaaggttttactactgatctttgtaactatgatggtttctacacttgacctgagct

SEQ ID NO: 202484 - DNA, 429 bp, Homo sapiens
gctctctctgttgctccctgtcaaacaaagaggctgtgggatgaccatgaaaataacaacagcagcaacagtaggaatagctgctgtttcccaagcacgtgctgatatgcgctcactcaatccttacagctctgcaaggtaggcggactgaggcatctcacacagggcacacaaccaacaaaggccagattgacaccccggctgttggtgccagaatccactctcagctgctctagctggtgtgggagggtggaaggattaaaacaaaacaaaacaaaacaaaaaaaacaactgtagaagtgctcctgacagctgccaacactagtacgtgtctaggggatggaagaaaaaagctctcttctgtctgccaatgacctcctggatattttcctctttccttgtgaggttattccatgtactaaaaaaaaa

SEQ ID NO: 202485 - DNA, 502 bp, Homo sapiens
gatggaaagggcactggtttgggagttggagaacctgggttaaattcccactctgcctttggtgtccatgtgaaccttgggcagtcattgaacttgtcttggttttgtcatctgcaaaatgagaataatgcctattttacagagtggctgtggggattaaataaaagcatgcgtatagaggcgtccagcttgttcctagaccaggataggagcttggcaagaaatcggtcagacatgagtccctaaaaaattaaaatcaggtccccaaggaagagcatcctccaggctgaaagccggggatacaggagagtggtgtgggaagggggtggtcagggaaggggagttggtgtatcgaggtggatgagctgctgcctgcaggagctcagagaacaagcttccccatgcctcagtttgctctgggttagctcagcagcagcactcaatattccacagaagcaagggggaagccagattaaataaatgtcattttggactcaaagat

SEQ ID NO: 202486 - DNA, 241 bp, Homo sapiens
tagaggcaggtgaatccatttaaccgggaaggtggaggttgcggtgagctgagaacgtgccattgcactccagtctgtgcaacagagcagggatcttgtctcaaaaaacaagggaaaaaaaaggcacagacaaaagtctgcctctcacctctgacctccagctatgcagttcccttctggggaggtaatttctttcttggttcactttgtttgttttttttttttctctaattgtctcggt

SEQ ID NO: 202487 - DNA, 338 bp, Homo sapiens
caggttcaggggattctcccgcctcagcctccggagtagctgggactacaggcacgcgccaccacacccagctaattttttgtatttttagtagagacggggtttcacccatgttggccagtctagtctcaaactcctgacctcaggcgatccgcccgcctcggcctcccaaagtgctgggattacaggtgtgagccactgcatctggcccatttcaattacttttgcaccaacctaacgtatggtttaggtttctgtgaacctctgatgacaaaagtttcttcaactggtcaatacgtaaccttgttaataagatgctttatttaatacgtttcttc

SEQ ID NO: 202488 - DNA, 408 bp, Homo sapiens
cccgaagctcatgtgctcttctccattctcatctctgagagccctggctgtgccctgctcagttggcaattgaatatgtccaccctattctctggttgttcttgtgtacaaactgagcttctccaaagacagtatgacctcctggagggcagagccccttttttcttctcttgtctccatcaaaattcctagcagagggtcagttttacaccaactctttggtaaatgcttctggcctaattaactaatgaactggcagcatcttccatactgaactacctccctccacctaagaggaagcagagaattttaaactaaggagctgaagcaaacagaaaaacttgaacattccagctcatcaagatcatctctgaattcccagcattttggatgagtaagttggtaggt

SEQ ID NO: 202489 - DNA, 417 bp, Homo sapiens
tataggaaactgctagaaaatatgcattactctcgacatgaataccacccaaaaatccgagatggcaagtatacaaggcatagcaaatatggtgatataatgcgcctgttttgtgaaaagtaatcttgaatccatcttgacactaaatattgcatgtgacaaaatcaagtgaactactgcgcagatagctttgattagtagattcaaacagttcctactttagaacaaattatttgaaaacccaatcaattttaatattccagatatgttattatttatctgagacccagcttgttgcccaggctggagtgtggtgggacaatcatagctcactgtggccttgaactcctgggctcaagcgatcctcccacctcagcctcctcagtagctgggacaacaggtgtgcaccaccatgcc

SEQ ID NO: 202490 - DNA, 308 bp, Homo sapiens
tgggcagcctaccagtaagcccatgcagggcattctttatttcgcttaaagtgtttttaatctctagcatttcttttgcttctttcttagaatagccatctctctgtttaaatcacccatctattcctgaaaggtgtctcctttttccatcataatccttaaccagagttgttttaaattttcagtctgataatttcaacatccctaccacatctgtgtctggttctgatccttgctctgtttttcaaactgcattatttttttttttttttttgccatagtctgtcttgtatttttttgaaaaccac

SEQ ID NO: 202491 - DNA, 958 bp, Homo sapiens
cttgaactcctgagctcaggcagtccacctgccttggcctcccagagtggtgggattacagcagtgagccactgagcccagcagatgacaattctttatgaagaagaaattgagtatcctgtttaaggcactcaagaaaagaaaatgtgagtaaagcattttttgttccagcaaaaccgacttttcagatgaaaaacacacaaacttctcagtgagctgtaacttaggaagtattgttctcatgagcccttccttaggaatggagtggagaaagatctttagacaactggatgactgtagatcaacctgcaactgatgatgggcatgaaacagttattttttaaacctagactgcatgagtgttaagggagagagcatggcatagccatgtgcttagacattgtagattatggttgtaactgttatgcagttctgttaatctcatccatccattttgtattttcatttctagagattccatttgagtcctttttatatcttctgtttcactccttataacattcatgctttccttctattagtatagggagcatttctgtaagagagcttttaatgtccttgtctgtgaattctgtaatctctgatcacttctagatccatctctgttgattgattctgtcatttctattgattgattgccctagttatgggggcatggttgtatgcctgctaatttttgattgaatgctaggcattaattttatcttctgtgcaggattttatttttttaaagagccttagttttcttctgccatacatgtaagttacatggggtcagtttgatcttttcaaagcttgattctgaggtttgttaggctgatccacacaggctttactcttgggctcatttatccatacaacgaaggcaatactgttctcaggactccacctgatgcttggtgtatgagaagatctttctgtccttgtttgtggaaac

SEQ ID NO: 202492 - DNA, 404 bp, Homo sapiens
cagcaggcagggaaaccctgtcaccaggttaaggcttaagtcagagcattttgccaaattcaacacgtccaagcctcccacttgtcccccaagaaaatttctcagggattcacatctttcccagtcaccccctggccagtgaggaagcaccgtgcatcgagaagagcatagctttgagtcgtctatgtggagctggttccatctgagctctgcctcttcctggctgtgtctttttgagtcagttgcttaaaatctctgagcctgattcatccataaaatgagggtgatgagaggattcagtgagagactgtacataaaccacctcctgtaatgtgtcgggggcgtgggtccttgtacatagtaacttctactgttaaattgctactgtggtgttattttcccta

SEQ ID NO: 202493 - DNA, 648 bp, Homo sapiens
gaaggtcaatctctcgtttttcaggtgagaaaactgcctgggaatctaagtggcttgtacaggtgacaagcgcaccatctcttcttatgatcatcccgcccggctccacacacattctaaactgtcagaggtttatgagttgcagacatttgggaggaaagtacatgatatccttagtagccacagcaggtactccaaaatcattggaaggaatgaataaataatgaaactttggcacagttcgctgggtaatcacaagatctcacacaagccatcaacacagaaagatctaatcatgcacatcacagccctggttcccagaggacaactttagtttccatccatacgtttaaacacgtcgaaagcaaaaacaaacaaaacgctatttaagctaatgtctcccagaacaacaccatgaccttaaaccgaaacacaaacgtaggaaagaacaaccaagcagccaaaggacacgttgtcaacagagactgcaatccccctagttccccaaaccactctgtcccggaattcaaagcacctccatgcaaaccgctccctaagcgagagctgccttgtgaagtgagcttggagcattcaactcaagcgttattagtgatgctgagattgcacagcatggatcttcaaatccat

SEQ ID NO: 202494 - DNA, 288 bp, Homo sapiens
ctcctggcaaatggcttcctgaagacatcaaagatgagtaccaaggtactaactacttaggaataaactggtaatcccatttttccttcggcattttcttcctttagtttttctctttttattctttttttttttttgagggaggggcattcttcaaaaggaggaaaatgaactatgtataatgtattactgagcatctcacaaggatttcaaagctactttctaagagattgtttatttttattttttattttttttgagacagagtctctctctgtcacctaggct

SEQ ID NO: 202495 - DNA, 519 bp, Homo sapiens
acaataaaaaacacactaaaaaggcacattccctttttttcttttttaatggggatacaacccaattaatatggataggtgcagattatgtttctccaccaagcaaaacctagcgagcagctttcagtggccgttagaattttcacttatttccaaagggaattcaacaatagaggtattgcattactgagtaatgaatacatcaaagctggtgaacaataaattgcagcttttactctgagtgagaacaaaatataaagcaccaatttaaaaaataatcaaatgactacaatttacttttttgctttgtttacagatttgaaaaactttaattcagctctattaagcacctttatgataacatgtatcaaaagtgccattcttaaaatgtacatcaatgcagggagtgtttccagttccctaaagagtaaacaccgtattttcttctgtacacttatcctgaatgtgatcagagtatacctgcttcctatataatattgttcctagggatacccgcct

SEQ ID NO: 202496 - DNA, 363 bp, Homo sapiens
aaggccagtttctccaaaagatgtggaaacttctgatctcacccagggacttcaacagaataccaaaaaggggtgtctttgtttcctccaaatggagtatttactttgagctggtaaaatgaattaatgaaaagaaaggacaccttcagcttctggggaaggagtgataagtaaaatcagaggaggggattccttcttaccctgactccccaaaatcaaggggaggatggaggatggtgagagagggaggatcccacagggtattcaaaaatagaccctgctagaaaacaggctgctcttttctgggattaaaagttgcctcaatactgtaaggcccatgtatatgcaagcagttgggagtta

SEQ ID NO: 202497 - DNA, 438 bp, Homo sapiens
gctctgtgcatgcctactgcacccaccaactttgcaaattacagggtagttgccactttagcttttgagtttcccaaacaagttttttatctgccctctatgggaacacccatggaatctgaagaggcctttataaataaacaaagcaagagacatctgtatccaagatgtggcatggagagcataaaaacagccagagtctgagaatatcagttgagatcatagagtgatgagatggacccttaggaaacatgcccttgccccacatcagctaaacacagcagcacaacaatcaacatgagtttcgtgacatcccttctctccttagaagcctacagtggctcctaatatcacttagttaaaggcaaattcagcacactatataatctgaccccttttatccctctaaccactttttcttgaacatgccaagaacac

SEQ ID NO: 202498 - DNA, 3336 bp, Homo sapiens
  misc_feature (1959)..(1959): n is a, c, g, or t
  misc_feature (2086)..(2086): n is a, c, g, or t
  misc_feature (2705)..(2705): n is a, c, g, or t
  misc_feature (2929)..(2929): n is a, c, g, or t
  misc_feature (2984)..(2984): n is a, c, g, or t
  misc_feature (3099)..(3100): n is a, c, g, or t
gcctgcctgcacccaggtgattaaaaagctttattgctcacacaaagcctgtttggtggtctcttcacagggacacgcatgaaatttggtgccatgactcggatcaggggacctcccttgggagatcaatcccctgtcctcctgctctttgctcagtgagaaagatccacctatgacctcaggtcctcagaccaaccagcccaaggaacatcccaccaattttaaacccgatgccgtcactgccaccaggagccctgtactatcagccatggtcaaccccaccgtgttctttgacatcgcagtcacggcgagcccttgggtcacgtctcctttgagctgtttgcagacaagattccaaaaacagcagaaaactttcatgctctgagcactggagaggaaggatttggttataagggttcctgctttcacataattattccaggatttatgtgtcagggtggtgacttcatatgccataatggcactggtggcaagtccatctatggggagaaatttgatgatgagaacttcatcctaaggcatacacgtcctggcatcttgtccatggcaaatgctggatccaatacaaacggttcccagtttttcatctgcactgacaagactgagtggtggatggcaagcatgtggtctttggcaaggtgaaagaaggcatgaatattgtggaggccacggagcgctttgggtccaggaatggcaagaccaggaagaagatcaccattgctgactgtggacaactctaataagtttgacttgtgttttatcttaaccaccagaccattccttctgtagctcaggacagcaccctccaccccatttgctcgcagtatcctagaatctttgtgctctcgctgcagttcccttccatgcctagctggactgcagagttgagttaaagtttatgattatgaaataaaaactaaataacaacaaaaaattgtttataaccaatgcttgatcccatattcctaggaaaacaattaaagcttcaggtatatttggtcttctggtcagccatttaaacattttataaagggatttcattccattgttattttccatgcatgttttctggttgtagaaaagctttcccatgcaagagggctgatgttataacagtagattattatgctacagtgtattttcaccagattaaaaaaaaaagctttttatggtttgaatctgctggaaacatcagagaaagactgtccttgccatctacactataacaaaacttcaggaccttgaactttgggttcataatctcacaactgagaagggcccctccatgctcttggagctgtgcacccactggaatgcttaaggtaaaactaactagggaaatttctcccaagaagaagatgacatcattgatgtgaacagcttttcccaagttcacagattaagacttctactatcatgaaactcttatttttgaatattttttcttgcttatgccttctacgaacaatagaagtggaaaaggggtctgttatgtgcacttatggggaacatttttatttgtgaaggagtttgcagccagccttatacatggataaaggcccaatgtatgtaagaaactttaatggtagatgtgttagctcataatcaatcaaaaacaaaaaattgattcactccacataacccacatcgtgggttaaagagaacattgccagaagtccttcactcttctgaaagggcatcatttgttaggtcctttttccatggtttaaagtaaaagaagcaatgattagaaatgtatccctcatgataggttccatagcaaattctactctaaaggctacagactctaaattctcttgtgaaagttataatagaattggctaaacagcgaagtatctgtgcagctgctggcacttgtggcctatacagaaatacatcaaatgaagactatagaaattcagtggtaggagactgacnaagaaattgattagtcaagtctctctctgttgcccaggctgaagtgcagtggcgtgatcttggctcactgcaacctccgactcccaggttcaagcaatcctcctgccttggcctcccaagtagctgngattacaggtgcacgtgaccacacccagccaatttttgtattttagtagagatggggtttcaccacgttggccaggctcatcttgaactcctgacctcaagtgagccacctcacccagccgtgagtaaactgtatctagctcattcttagatccatttgattttaggaggtttggtttatggggaccttgggtaaggagtatactcccaaattcttggtattatcctcctaatagccataataatggtctccctgacgagctgtatgctctcaaaggttttaaatgcttgcatgagccatctctagaatgtcatatggtctctcttcaactggaataacaggagctcaaagaaatatgcaaccatgaggacaccataacctataaatgacatgctgagaccagaaacccaaaatgatggtaactgagagtggcactgaggccctaggttttggtcacactctcacctaagtgaaaacctgatcaaaaagggaatttttttcaacaaaattctgggaggccgttgttttggactgatctcatgcactaggccccaacaaaccaaacaaaaccaaaatggggccactcatgccaagactttaaggaaacacatagattctngaaaagactaggttttgttttttcttctgcaaatcactacaacaaacatttctgacagtataggtatccaccccctaaagtttccattaaatcttttaaccaaattcatttcctctcacctagagaccatcaagcttcagatgatcatgtaacaaaggttccagccagttccaagtgaagacaccacccctggacatcaagaagctacccttcctccactaganagagcagggtgagagttccatgatccccaataggtagggactatgccccaagccngcatgaagcagttacagaaaaaagaccatcggtccctctgcctcccataaagatttatggggatcacatctcttgaaggggcagatgaggcaggaaaatagggtctgaagtgtgnngatcgattcacacttcagctataacaggaaatatcctctccatagggtgtatgactatgtaacttgaatacttcatcctctccatttacataaggtgtatctgaagtaaccaatggaatcctctgggggtaaatgccccacaattctgtaacgggacctttgagcccctacgctccgcctgctcccacactgtggtgtgtatgttcattttcaataaatcccttcattccttcctt

SEQ ID NO: 202499 - DNA, 639 bp, Homo sapiens
tgtgtagtgtctagaggatccggaacacaaagcggcaggtttacagagctgctctctgctctgcattaattgtagagagccacaagatgcaattcaaagcataacggagttacatagagctggtttaggtattacagaagaagggtaaacataaatgctgtcatcagttgggtccagtttatcagtgtttatacttatatgaatagaaaagatatagaaggaaatgagtccgcttttgtggcacgtaagggaggaagagcagagcgggaagtgaggccagagcctggaagctgctattctgcctcctgccacctggggccagtgtggctccaccgtgcctcctccaaagtgcagccttcgggaagaagggagggaggctggatcctgtcttctcacgggccgcttttgtgttccttgccatagacctgtctgtctatagtaatactctctataaatgtgagctattgtcgacagtaggatgtttcagttcatgtcctttccatgtacacacaactctatgcttcttgaactgcctatctctgcttcctaaacattcaaaatcagtgcctaggttcaccacccatgggggcttttaaaagcaaggttaacagggattgcgcagaagtcgctgccgcttgt

SEQ ID NO: 202500 - DNA, 782 bp, Homo sapiens
agcggttcccaggctaggggttgaatcggagctgtagctgccagcttacgccagagccacagcaacgtaggatccgagccgcgtctgcgacctacaccacagctcacggcaacgccggaaccttgacccactaagcaagggcagggattgaacccgcaacctcatggttcctagacggattcgttaaccactgcgccacgccgcttttgtgttccggaacacaaaagcgggaaggggaatacttgggcagtggtgttcccatgtactgaacgtgcttgttccatctcactgagtccctggggccgaccaaagcagtgctatcgctatccccattttacagaaagggaaggtgaggcgaggaagtgaagtcactcctctccaaagcacgtaagggaggaagagcagagcgggaagtgaggccagagcctggaagctgctattctgcctcctgccacctggggccagtgtggctccaccgtgcctcctccaaagtgcagccttcgggaagaagggagggaggctggatcctgtcttctcacgggccgcttttgtgttccttgccatagacctgtctgtctatagtaatactctctataaatgtgagctattgtcgacagtaggatgtttcagttcatgtcctttccatgtacacacaactctatgcttcttgaactgcctatctctgcttcctaaacattcaaaatcagtgcctaggttcaccacccatgggggcttttaaaagcaaggttaacagggattgcgcagaagtcgctgccgcttgt

SEQ ID NO: 202501 - DNA, 807 bp, Homo sapiens
agcggttcccaggctaggggttgaatcggagctgtagctgccagcttacgccagagccacagcaacgtaggatccgagccgcgtctgcgacctacaccacagctcacggcaacgccggaaccttgacccactaagcaagggcagggattgaacccgcaacctcatggttcctagacggattcgttaaccactgcgccacgccgcttttgtgttccggaacacaaaagcgggaaggggaatacttgggcagtggtgttcccatgtactgaacgtgcttgttccatctcactgagtccctggggccgaccaaagcagtgctatcgctatccccattttacagaaagggaaggtgaggcgaggaagtgaagtcactcctctccaaagcacgtaagggaggaagagcagagcgggaagtgaggccagagcctggaagctgctattctgcctcctgccacctggggccagtgtggctccaccgtgcctcctccaaagtgcagccttcgggaagaagggagggaggctggatcctgtcttctcacgggccgcttttgtgttcggaacacaaaagcggcaggtggtgctcaacagttgaccctgcacccatggtcagagccagggtcaccttgcaccaggccccacatggacagcatcttggcccccccgtcattgtgttctcatatatttgccacattgccctatctgctgtgacctaaaaccaccacaaaatcttgaccttggctcaccaatgtatgctacataaagaatcgtagcaccagccatttatagatgcgcgcccgcttttgtgat

SEQ ID NO: 202502 - DNA, 1010 bp, Homo sapiens
cactgtggctttctatcctgtatgtaggttgacgtctctgggatctacacgagggacagagtgacctggtgaggggaggatggagtgaacaggcacaggctctttctgattccttcagggactacctgtacagccaattgtgacatggttccctttagaaaatagggacctagactggcgtcatggggtttaggccaaaggccttgagttcatttactccaactcctcctcttgacagatgataaactatcccagggagtatcttgggacctacccgaggtcactctgctagtagcagaatcagaacttgaacttggaacttgaatctcacatccagatcactgagatttctagagactccagattctgtggttctcacttctgaaaattttcttgggcacagaaatttaagttaaaccattagactgtgtttactgggagtggagggggatgacagatcataaaaaagaaaaagaaaaaaagggaactgttgaccttcaggaaagggatttgaaagaatgatcaagtttatatgatttaaaaattcatagatacttagttttactatgtgtcactgaaaaataattttctacccagtggatgggaaattccagctcctagcttcttcattcatggactcatcacacctaggtattacagagtatagaatttacaaaatcagcagccattatgtgacctcagacaccaccaagttaccactttttgcctttttctgactttcctgtcctcctcctgcagggtgaagtagagcaactaatgttatttcagttagatttcagctttccaggcttgctttaaatcacaagagtgggatgccgggtaggttcatgatggtcgcagcattgcatatacagcatcttggtagctttaaatcaatatctctcctaagggttcagaagaaatgtcacatacaaggtacattgcttgcacaagtgtcctttgtgtcggatgccctcgaatgtaatttctgtgcccatttcaggggatct

SEQ ID NO: 202503 - DNA, 993 bp, Homo sapiens
cactgtggctttctatcctgtatgtaggttgacgtctctgggatctacacgagggacagagtgacctggtgaggggaggatggagtgaacaggcacaggctctttctgattccttcagggactacctgtacagccaattgtgacatggttccctttagaaaatagggacctagactggcgtcatggggtttaggccaaaggccttgagttcatttactccaactcctcctcttgacagatgataaactatcccagggagtatcttgggacctacccgaggtcactctgctagtagcagaatcagaacttgaacttggaacttgaatctcacatccagatcactgagatttctagagactccagattctgtggttctcacttctgaaaattttcttgggcacagaaatttaagttaaaccattagactgtgtttactgggagtggagggggatgacagatcataaaaaagaaaaagaaaaaaagggaactgttgaccttcaggaaagggatttgaaagaatgatcaagtttatatgatttaaaaattcatagatacttagttttactatgtgtcactgaaaaataattttctacccagtggatggcttcttcattcatggactcatcacacctaggtattacagagtatagaatttacaaaatcagcagccattatgtgacctcagacaccaccaagttaccactttttgcctttttctgactttcctgtcctcctcctgcagggtgaagtagagcaactaatgttatttcagttagatttcagctttccaggcttgctttaaatcacaagagtgggatgccgggtaggttcatgatggtcgcagcattgcatatacagcatcttggtagctttaaatcaatatctctcctaagggttcagaagaaatgtcacatacaaggtacattgcttgcacaagtgtcctttgtgtcggatgccctcgaatgtaatttctgtgcccatttcaggggatct

SEQ ID NO: 202504 - DNA, 254 bp, Homo sapiens
agaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaacttt

SEQ ID NO: 202505 - DNA, 585 bp, Homo sapiens
ggggcttcctttgggagagaggggtccttcctgtggaagatatattttgcatccttgtatttgctagaagcatctgggtgaacatcaaactgagcagagattaatgtatgtgaaaaaacccgaagaatttctaggtgctcctaccagaagcacacagtggtggtgatcctgccaagaggtccctttcctggagattaaatatgtccagcctaggttcattcaaaaggtacttttagctcagacctgtaatcctagcactttgggatgctgaggtgggaggatcccttgagcccaggagttcaagaccagcctgggaaacatagggagaccctgtctctattgtaaaacaaacaaaaggtacttttggagacctctgtcatggaagtcaccttcaagacagtactgtaacaagccatttgtgaaatatgccaattgcaatgacagagatacagcagcaacctgagccccaaggacggctgccaggctactgattctgagtgtgaaaattacattactaaagaaaacaatataaatatggtgagaaacacttttaaaactgtatctggataactgttgccatggcag

SEQ ID NO: 202506 - DNA, 472 bp, Homo sapiens
gagatagggtcttgctctgttgcccaggctggagtgcagtggcatgatctctgctcactgcaacctccaccttctgggctccagtggtcctcctacctcagcctcccaagtagctgggaccacaggcacacgccaccatgcctggataattttttgtagagacggggccttgctatgttacccaggctggttttgaactgggaaacatagggagaccctgtctctattgtaaaacaaacaaaaggtacttttggagacctctgtcatggaagtcaccttcaagacagtactgtaacaagccatttgtgaaatatgccaattgcaatgacagagatacagcagcaacctgagccccaaggacggctgccaggctactgattctgagtgtgaaaattacattactaaagaaaacaatataaatatggtgagaaacacttttaaaactgtatctggataactgttgccatggcag

SEQ ID NO: 202507 - DNA, 1336 bp, Homo sapiens
taccacatccacaaagaaacgaactccccacatacccacaatgtctcactgcttcattaaagcattgtcatgcctgttatcactcagatctgaatgggcaggtatagcctctgattgattttttagaagaaacaaaaataacagcaaaatatgttaattgtaaccttcagcgagagctgaaggagttttttgggcagttataacctttcaaagcatgacatcttttgggggaagacaaaggggctgtgatggaaaggttggcttgagtgagtactttggtatccctacccgcccccagcctcaaatgctgatcttgtacttggggaggctatgctaaaggagaaacacaccccagaggagacaccaggtggtgtcttcagacaattcccacccagccatagggataggcattttgggtttgagacggccctttctctggcttacttttagagcctggagtcagacttcttcacaacaaatagcccagaaccagctgggaactctctggcccatatgacacatgacactgatacagtaccagaaatgcatggcaccagctaataccactgaggggcaggagggcatactctctctcagaccctcatccatcacccccagaaccaggacaaggtcatgatggctcttggcagcctgctcagcaccagggcaagaacaactcaggctggacattacgagagtaaacacaatagatttctttcccagaccaagagcttgggcaccaggagtgggcattctggttcactgttaggcaaaaaagcctttggggaaattaccagctctcccgtcatccccaccttccttgaaaggcagcatgtggggtgggaagaacaatcagaagacaaattttaatctaaatcctgcccctctgtggccctggaaacttggcccctttgagcttcagtcactttgtgaaatgacaataacattcaatctccttcaacctcattactatggattaaatgagacggtgtctggggacatgcttggagaatgtattgtacaactgcttaggaattttcttctgcccctaaacctggaacttagagtggagcaaacagtaaacagtcactgtgtgtcggttaagggaacagagcctcagagccccgacccctggaaacgtttcttttttgtttactaaatttctagcaacaccgtgttttctacagaggtggggggaaatgtccatttaagtgcaagatgaaggggcctgtgaaaggaccctccaaggcaatcccatgtgctcccgtctcctggaaagaagagaataggaccacgcgtagtgaccagggaggaatcgtaccatacgcgtctcagc

SEQ ID NO: 202508 - DNA, 310 bp, Homo sapiens
gccagggtgttaacaggatggtctccggagatcgggattctcggagggtcgaccaccaggaagaaacctcaggagcaagaaagctcaggcagattgctggggaggcagtgcgagatcccaaactcaggccaggatttgcggagggtcaatgaggcccctctcccaatcttcacttcaccagccaccgccccagtccccgcagccgccgctctgccgtcatttattttattattatttttttttaatagtcggagtctcattctgtcacccagtctggactgcagtggcgggatctcagctcactgcaaac

SEQ ID NO: 202509 - DNA, 353 bp, Homo sapiens
ctagacattgaaatattttagacactagaaaataaaggatttttaataaatggagtgtaactactcaaaacttttttcttctttccccaaagtgaataaataacaattgtaggctaatgtttcagattagcataggtagataatattagtttttaatcatgaaattattttaagtgcatcatttgagagaatttatggtataaattctctataaattttatatttgataagaaatacgaagatagaagctaatgaagagggagaagaactaagtattcttgagttgtttgtgaaagtagtaatttaatcgaagttgtattcacttagcccctccaagattaagtttccatgtg

SEQ ID NO: 202510 - DNA, 401 bp, Homo sapiens
attatatctaggaagtaactaactcgcttttgattttacaggcccataggtggaagggacttgccttgtctcggatgagactttggactttggactgtggacttttgagttaacactgaaatgaattaatgctgaaatgaattaagactttgggagacggttgagaagccatgactcattttaaaatgtgagacatgcctttcaccttctgccatgattgtgaggcctctccagccatgtggaactgtgaacacacagtgttcatcccctcaggaggacacagcttttgaggtaccatcttggaagcagagaccagccctcactagacacaaacttcctggcacgttgattttggacttcatagcctctagaactgtgagaaataaatttttattatttat

SEQ ID NO: 202511 - DNA, 1177 bp, Homo sapiens
cgcaatcagtattttcatacatatttaaaattttccatccatacaaaggttgctaacatatttatttaaaattttaaaaataattttatatgcctcttgtaaccagtaataggatgcaaagttttttttaaggtaacattgctcctcttcccccattgtctctgtcatctatagtactccctgaggtagttcatgttattgcaagggtgtgtatcatcacaaacatattgcttccacatacatatatcagcatacatatatatatatgtatagcatatatatatatgagcacatattaatatatgcccatgcacatacaagcatgtttttgttaatttttactgaaatggaatcatactgcatacttatgaacaaattgcttctttcaccttatatcacttataattgttattctacaaatcagtacatataaaaaatacatatttacatatgtaatactctatctttctgttataattttctgcatgcacatgtatgcatatacatatattcataaacataaaacttaatctaaacgggatttttttttgggggggtgatatggtttggctgtgtccccacccaaatctcatcttgaattcccatgtgttgtggggggacccggtgggaggtaattgaattatgggggcaggtctttcctgtgctgttcttgggatagtgaaaaagtctcacaagatctgatggttttaaaaaggtgagtttccctgcataatctctcttctcctgtctggttccatgtgagatgtgccttttgccttccgccatgattgtgaggcctccccagccatgcggacccgcccataggtggaagggacttgccttgtctcggatgagactttggactttggactgtggacttttgagttaacactgaaatgaattaatgctgaaatgaattaagactttgggagacggttgagaagccatgactcattttaaaatgtgagacatgcctttcaccttctgccatgattgtgaggcctctccagccatgtggaactgtgaacacacagtgttcatcccctcaggaggacacagcttttgaggtaccatcttggaagcagagaccagccctcactagacacaaacttcctggcacgttgattttggacttcatagcctctagaactgtgagaaataaatttttattatttat

SEQ ID NO: 202512 - DNA, 717 bp, Homo sapiens
gccacttcctgcaatctcccagccatgcccattgtatgactcctatgctgaatgactttaagtttctttaatattacatgctctctttcccactgtgggttctacagatgctgtttgctgtgtctgaaacatcctactgttcctctctccacttaccaactaagctttcatctttcatcctccacctaatctctactctcctttcaggatcatcagaggtattacctcttacaaatatctttccctgccttccaaatcctgtctccaaagcctggattatgtacttattataggttcccacattgcactcagtacattgtctccaccctctactagcttggaaaaatctgcgagagcaagaagtatgtctgttcatgttagagttacctctaatgcctgacttgatacctgacaacatagtgttgctcaatcaataattgtaaatacctgaattattaatgcatgaataaataaatgatttggtaaatatacaaatgtatgtattaaaaacaggagagaaagaaatggaaatatttgtataaccagaacatcaggcaattagcattaggaaagctttttttttcttgtttaagtaggttaaaacaggccttaaaagacaaaaaatcgtggaacattaagatctctctcctttcccccctcctccttctacctgtgtgtgtgtgtgcacgcatatgtgcacttgttaaaggtagagag

SEQ ID NO: 202513 - DNA, 203 bp, Homo sapiens
aaacacaaatgaccacatttctaaacctgttaagagccttttactgaggacactgactaagatagctttgcttccctttcccaaatgtgagataaagcaaattttgatacacaattaccgttagtgccactccctcccttaataaaaggatccatctgaaaacagagcaggaacataactcaaagggactcctaagtgggagg

SEQ ID NO: 202514 - DNA, 581 bp, Homo sapiens
  misc_feature (540)..(540): n is a, c, g, or t
  misc_feature (573)..(573): n is a, c, g, or t
cccatttgaaaaagtaaaaattacaaatttttacattttaaaataatttcattatttgttgccaaaagccaaggcaaattcctccttttcatattaataaatattctttcaagttcttagaatacctgttaatgttttagaattatctttacgaaaaagtaacatatagctctggagtgtttttattaagattcaaattcataaattaaatattgaaaacattaattgagcatttgtacatgcaaagcacaatataagtggaagatactttttagtgtgacagagaataagaaaaggtttgaaacaggcttaccgattccttcttttccagcttcagttttgaatttgtaagtggaggataataatgcctatctcacagagaagttgagaaaattaggaaatgacagatctaacgtgtgccaaagcataggacttgacacacggttggcacttaataaatgccggttctcttcttccactccatttttcagagatgcagtgaaaagaaagaaatcatctgcttagtagttggattaatcngagctgctgagggacattacttaccctggcatnttggcttg

SEQ ID NO: 202515 - DNA, 442 bp, Homo sapiens
aatgtaatctgaggcaccacatatgccaccaccaataaaaggaccggcgtaacacatcgtgtaacgagcggcaccagtcaaaccagaaatccagcacaccgcaggcctggaattagcacgtggaatatgctgcgacaacaagtacggagcattcccttctgcagcaacaacaagttcagcggtcaatatgatgcgttctgtggcagaatcgttcgaaaagatttcgaggcagtcaataaaatctgttccattaaaaggatcacctccaatgccaacgcacaaagactgcctcgaaatctttttgaacgattcagcctatgtgcctgacactggtcttgcagtacaactggaagccaaaacaaggtggaagatgtcctgaattaagacgttttcaccacattgtattacagagacagccaataaatctactatttgatttcaa

SEQ ID NO: 202516 - DNA, 1434 bp, Homo sapiens
  misc_feature (149)..(149): n is a, c, g, or t
gttattatctgcctctccgataggatgcctctttgtcttcacctgccattcccgctgtttcgtgaagaatcggctgtaaagggaaatttgttcaggcgactgctgtggccaccctctgcctcctccggcctctgcccctgggaggtccncgggggcctgggagtgtcattggcgtatgaccgcaacccttgccgctgccgctgacatcgctaccatggtctccggcagcagcggcctcgccgccgcccgtctcctgtcgcgcagcttcctcctgccgcagaatggaattcggcattgttcctacacagcttctcggcaacatctctatgttgataaaaatacaaagattatttgccagggtttcactggcaaacagggcacctttcacagccagcaggcattggaatatggcaccaaactcgttggaggaaccactccagggaaaggaggccagacacatctgggcttacctgtctttaatactgtgaaggaggccaaagaacagacaggagcaacggcttctgtcatttatgttcctccgccttttgctgctgctgccattaatgaagctattgaggcagaaattcccttggttgtgtgtatcactgaaggaattccccagcaggacatggtacgagtcaagcacaaactgctgcgccaggaaaagacaaggctaattgggcccaactgccctggagtcatcaatcctggagaatgtaaaattggcatcatgcctggccatattcacaaaaaaggaaggattggcattgtgtccagatctggcaccctgacttatgaagcagttcaccaaacaacgcaagttggattggggcagtctttgtgcgttggcattggaggtgatccttttaatggaacagattttattgactgcctcgaaatctttttgaacgattctgccacagaaggcatcatattgattggtgaaattggtggtaatgcagaagagaatgctgcagaatttttgaagcaacataattcaggtccaaattccaagcctgtagtgtccttcattgctggtttaactgctcctcctgggagaagaatgggtcatgccggggcaattattgctggaggaaaaggtggagctaaagagaagatctctgcccttcagagtgcaggagttgtggtcagtatgtctcctgcacagctgggaaccacgatctacaaggaatttgaaaagaggaagatgctatgaaagaaaaaaaaaattcctaaaactgtggaatggatcacgtagacatgtaacccagcagcagtttgcttctgttgtccactgattaatcagcctatgtgcctgacactggtcttgcagtacaactggaagccaaaacaaggtggaagatgtcctgaattaagacgttttcaccacattgtattacagagacagccaataaatctactatttgatttcaa

SEQ ID NO: 202517 - DNA, 1277 bp, Homo sapiens
tagtagcccgcgttactcggccgaggcgcacctgccgctgccgctgacatcgctaccatggtctccggcagcagcggcctcgccgccgcccgtctcctgtcgcgcagcttcctcctgccgcagaatggaattcggcattgttcctacacagcttctcggcaacatctctatgttgataaaaatacaaagattatttgccagggtttcactggcaaacagggcacctttcacagccagcaggcattggaatatggcaccaaactcgttggaggaaccactccagggaaaggaggccagacacatctgggcttacctgtctttaatactgtgaaggaggccaaagaacagacaggagcaacggcttctgtcatttatgttcctccgccttttgctgctgctgccattaatgaagctattgaggcagaaattcccttggttgtgtgtatcactgaaggaattccccagcaggacatggtacgagtcaagcacaaactgctgcgccaggaaaagacaaggctaattgggcccaactgccctggagtcatcaatcctggagaatgtaaaattggcatcatgcctggccatattcacaaaaaaggaaggattggcattgtgtccagatctggcaccctgacttatgaagcagttcaccaaacaacgcaagttggattggggcagtctttgtgcgttggcattggaggtgatccttttaatggaacagattttattgactgcctcgaaatctttttgaacgattctgccacagaaggcatcatattgattggtgaaattggtggtaatgcagaagagaatgctgcagaatttttgaagcaacataattcaggtccaaattccaagcctgtagtgtccttcattgctggtttaactgctcctcctgggagaagaatgggtcatgccggggcaattattgctggaggaaaaggtggagctaaagagaagatctctgcccttcagagtgcaggagttgtggtcagtatgtctcctgcacagctgggaaccacgatctacaaggaatttgaaaagaggaagatgctatgaaagaaaaaaaaaattcctaaaactgtggaatggatcacgtagacatgtaacccagcagcagtttgcttctgttgtccactgattaatcagcctatgtgcctgacactggtcttgcagtacaactggaagccaaaacaaggtggaagatgtcctgaattaagacgttttcaccacattgtattacagagacagccaataaatctactatttgatttcaa

SEQ ID NO: 202518 - DNA, 1395 bp, Homo sapiens
  misc_feature (149)..(149): n is a, c, g, or t
gttattatctgcctctccgataggatgcctctttgtcttcacctgccattcccgctgtttcgtgaagaatcggctgtaaagggaaatttgttcaggcgactgctgtggccaccctctgcctcctccggcctctgcccctgggaggtccncgggggcctgggagtgtcattggcgtatgaccgcaacccttgccgctgccgctgacatcgctaccatggtctccggcagcagcggcctcgccgccgcccgtctcctgtcgcgcagcttcctcctgccgcagaatggaattcggcattgttcctacacagcttctcggcaacatctctatgttgataaaaatacaaagattatttgccagggtttcactggcaaacagggcacctttcacagccagcaggcattggaatatggcaccaaactcgttggaggaaccactccagggaaaggaggccagacacatctgggcttacctgtctttaatactgtgaaggaggccaaagaacagacaggagcaacggcttctgtcatttatgttcctccgccttttgctgctgctgccattaatgaagctattgaggcagaaattcccttggttgtgtgtatcactgaaggaattccccagcaggacatggtacgagtcaagcacaaactgctgcgccaggaaaagacaaggctaattgggcccaactgccctggagtcatcaatcctggagaatgtaaaattggcatcatgcctggccatattcacaaaaaaggaaggattgttcaccaaacaacgcaagttggattggggcagtctttgtgcgttggcattggaggtgatccttttaatggaacagattttattgactgcctcgaaatctttttgaacgattctgccacagaaggcatcatattgattggtgaaattggtggtaatgcagaagagaatgctgcagaatttttgaagcaacataattcaggtccaaattccaagcctgtagtgtccttcattgctggtttaactgctcctcctgggagaagaatgggtcatgccggggcaattattgctggaggaaaaggtggagctaaagagaagatctctgcccttcagagtgcaggagttgtggtcagtatgtctcctgcacagctgggaaccacgatctacaaggaatttgaaaagaggaagatgctatgaaagaaaaaaaaaattcctaaaactgtggaatggatcacgtagacatgtaacccagcagcagtttgcttctgttgtccactgattaatcagcctatgtgcctgacactggtcttgcagtacaactggaagccaaaacaaggtggaagatgtcctgaattaagacgttttcaccacattgtattacagagacagccaataaatctactatttgatttcaa

SEQ ID NO: 202519 - DNA, 1772 bp, Homo sapiens
cccatttgaaaaagtaaaaattacaaatttttacattttaaaataatttcattatttgttgccaaaagccaaggcaaattcctccttttcatattaataaatattctttcaagttcttagaatacctgttaatgttttagaattatctttacgaaaaagtaacatatagctctggagtgtttttattaagattcaaattcataaattaaatattgaaaacattaattgagcatttgtacatgcaaagcacaatataagtggaagatactttttagtgtgacagagaataagaaaaggtttgaaacaggcttaccgattccttcttttccagcttcagttttgaatttgtaagtggaggataataatgcctatctcacagagaagttgagaaaattaggaaatgacagatctaacgtgtgccaaagcataggacttgacacacggttggcacttaataaatgccggttctcttcttccactccatttttcagagatgcagtgaaaagaaagaaatcaatcctgccctcagtaagtttgtaatttaaaaataaaaaacggcagcctgtctgtagggaacatttactttaaccctgtccatgaatttgttcttaaatgtggtgtgtagtatggctctgatatgcaggctctgtcatcatccactctggatccagaacacgagcagtcagggtactcactgtcactcactggcacttgtgtcttaaaacttgtgggtgatttatctgcagcatacttcatcaaatagtttctttactcaaagaaatttgttaaatgtttattctttcctctggtgtaacatcagcatgcaacacagatacacattttcttaaaatgttcatttctaaggagttatctgggaataattttgtgggacagaagaggcttgataaaggagctaaaacaaaaagagggttgtcttcgttacagccctagaatattcctagaatatcaggaaccaaccaccatttagcatttatataatattaccaacagaaataaatgtagcattttgtgattttttaaatattaaatgcaagagcaatgatacatttaaaaatataagagagaagggtaagaaaaatgacaaactagttaaaaacatttattgacctaaattccatggttcacccttaaatttccagctattgatatttttcaactttttcaggcattggaggtgatccttttaatggaacagattttattgactgcctcgaaatctttttgaacgattctgccacagaaggcatcatattgattggtgaaattggtggtaatgcagaagagaatgctgcagaatttttgaagcaacataattcaggtccaaattccaagcctgtagtgtccttcattgctggtttaactgctcctcctgggagaagaatgggtcatgccggggcaattattgctggaggaaaaggtggagctaaagagaagatctctgcccttcagagtgcaggagttgtggtcagtatgtctcctgcacagctgggaaccacgatctacaaggaatttgaaaagaggaagatgctatgaaagaaaaaaaaaattcctaaaactgtggaatggatcacgtagacatgtaacccagcagcagtttgcttctgttgtccactgattaatcagcctatgtgcctgacactggtcttgcagtacaactggaagccaaaacaaggtggaagatgtcctgaattaagacgttttcaccacattgtattacagagacagccaataaatctactatttgatttcaa

SEQ ID NO: 202520 - DNA, 1099 bp, Homo sapiens
  misc_feature (149)..(149): n is a, c, g, or t
  misc_feature (870)..(870): n is a, c, g, or t
gttattatctgcctctccgataggatgcctctttgtcttcacctgccattcccgctgtttcgtgaagaatcggctgtaaagggaaatttgttcaggcgactgctgtggccaccctctgcctcctccggcctctgcccctgggaggtccncgggggcctgggagtgtcattggcgtatgaccgcaacccttgccgctgccgctgacatcgctaccatggtctccggcagcagcggcctcgccgccgcccgtctcctgtcgcgcagcttcctcctgccgcagaatggaattcggcattgttcctacacagcttctcggcaacatctctatgttgataaaaatacaaagattatttgccagggtttcactggcaaacagggcacctttcacagccagcaggcattggaatatggcaccaaactcgttggaggaaccactccagggaaaggaggccagacacatctgggcttacctgtctttaatactgtgaaggaggccaaagaacagacaggagcaacggcttctgtcatttatgttcctccgccttttgctgctgctgccattaatgaagctattgaggcagaaattcccttggttgtgtgtatcactgaaggaattccccagcaggacatggtacgagtcaagcacaaactgctgcgccaggaaaagacaaggctaattgggcccaactgccctggagtcatcaatcctggagaatgtaaaattggcatcatgcctggccatattcacaaaaaaggaaggattggcattgtgtccagatctggcaccctgacttatgaagcagttcaccaaacaacgcaagttggattggggcagtctttgtgcgttgggcatggaggtgatcattttanggaccagatttattgatgcctcgagtcttttgacgaatctgcacagaggctctttgattgtgaatggtgtatgccgaaaatgttccatttggacactatcagccaattcagcgtaggcctcagcggtaggccaggaaaagttgcggcatcggggagggaaaaaccccaaggggggtttttgctgacaccgtagattccaacccgggcatcagctcatctgggctcaaca

SEQ ID NO: 202521 - DNA, 586 bp, Homo sapiens
agcagtggtatcaacgcagagtgcccattacggccggggactgcctcgaaatctttttgaacgattctgccacagaaggcatcatattgattggtgaaattggtggtaatgcagaagagaatgctgcagaatttttgaagcaacataattcaggtccaaattccaagcctgtagtgtccttcattgctggtttaactgctcctcctgggagaagaatgggtcatgccggggcaattattgctggaggaaaaggtggagctaaagagaagatctctgcccttcagagtgcaggagttgtggtcagtatgtctcctgcacagctgggaaccacgatctacaaggaatttgaaaagaggaagatgctatgaaagaaaaaaaaaattcctaaaactgtggaatggatcacgtagacatgtaacccagcagcagtttgcttctgttgtccactgattaatcagcctatgtgcctgacactggtcttgcagtacaactggaagccaaaacaaggtggaagatgtcctgaattaagacgttttcaccacattgtattacagagacagccaataaatctactatttgatttcaa

SEQ ID NO: 202522 - DNA, 817 bp, Homo sapiens
  misc_feature (149)..(149): n is a, c, g, or t
gttattatctgcctctccgataggatgcctctttgtcttcacctgccattcccgctgtttcgtgaagaatcggctgtaaagggaaatttgttcaggcgactgctgtggccaccctctgcctcctccggcctctgcccctgggaggtccncgggggcctgggagtgtcattggcgtatgaccgcaacccttgccgctgccgctgacatcgctaccatggtctccggcagcagcggcctcgccgccgcccgtctcctgtcgcgcagcttcctcctgccgcagaatggaattcggcattgttcctacacagcttctcggcaacatctctatgttgataaaaatacaaagattatttgccagggtttcactggcaaacagggcacctttcacagccagcaggcattggaatatggcaccaaactcgttggaggaaccactccagggaaaggaggccagacacatctgggcttacctgtctttaatactgtgaaggaggccaaagaacagacaggagcaacggcttctgtcatttatgttcctccgccttttgctgctgctgccattaatgaagctattgaggcagaaattcccttggttgtgtgtatcactgaaggaattccccagcaggacatggtacgagtcaagcacaaactgctgcgccaggaaaagacaaggctaattgggcccaactgccctggagtcatcaatcctggagaatgtgcacattgggcatcatgcctggggccattattttcccaaaaaaaaagggaagggcttggggctttgttgtccccgattcttggcgaccctcgattttga

SEQ ID NO: 202523 - DNA, 486 bp, Homo sapiens
tcatagatcgagccggtaccctagtttagaagtttcaatagcaacataattcggtccaaattccaagcctgtagtgtccttcattgctggtttaactgctcctcctgggagaagaatgggtcatgccggggcaattattgctggaggaaaaggtggagctaaagagaagatctctgcccttcagagtgcaggagttgtggtcagtatgtctcctgcacagctgggaaccacgatctacaaggaatttgaaaagaggaagatgctatgaaagaaaaaaaaaattcctaaaactgtggaatggatcacgtagacatgtaacccagcagcagtttgcttctgttgtccactgattaatcagcctatgtgcctgacactggtcttgcagtacaactggaagccaaaacaaggtggaagatgtcctgaattaagacgttttcaccacattgtattacagagacagccaataaatctactatttgatttcaa

SEQ ID NO: 202524 - DNA, 671 bp, Homo sapiens
ggtgactagaggaccctccaagcatgagaaactgagcaaacctgtttccattgccttcttagaagggttcatgtatatagcactacagaagcataatgaagtttctcagctcccaaaattattgttattatactgctgtgaaaaaataaatattattcaaaacctccctctctgcttctggatttaggaaatgtaaagttgaagctctgcatctgtttcgtgaaattcaggctgacacagactgattttgaaagctgttattctgtgttcaaacaccctcatcctggtacatttttcttctgtaatttgattgttcaggggatcctaaagataataggtttcaaaatcattttgatcctaaatgtgatttggatcttttatctttattcattccatctctcttctctctctcttctgtttctgaaggaatttgaaaagaggaagatgctatgaaagaaaaaaaaaattcctaaaactgtggaatggatcacgtagacatgtaacccagcagcagtttgcttctgttgtccactgattaatcagcctatgtgcctgacactggtcttgcagtacaactggaagccaaaacaaggtggaagatgtcctgaattaagacgttttcaccacattgtattacagagacagccaataaatctactatttgatttcaa

SEQ ID NO: 202525 - DNA, 1714 bp, Homo sapiens
  misc_feature (149)..(149): n is a, c, g, or t
gttattatctgcctctccgataggatgcctctttgtcttcacctgccattcccgctgtttcgtgaagaatcggctgtaaagggaaatttgttcaggcgactgctgtggccaccctctgcctcctccggcctctgcccctgggaggtccncgggggcctgggagtgtcattggcgtatgaccgcaacccttgccgctgccgctgacatcgctaccatggtctccggcagcagcggcctcgccgccgcccgtctcctgtcgcgcagcttcctcctgccgcagaatggaattcggcattgttcctacacagcttctcggcaacatctctatgttgataaaaatacaaagattatttgccagggtttcactggcaaacagggcacctttcacagccagcaggcattggaatatggcaccaaactcgttggaggaaccactccagggaaaggaggccagacacatctgggcttacctgtctttaatactgtgaaggaggccaaagaacagacaggagcaacggcttctgtcatttatgttcctccgccttttgctgctgctgccattaatgaagctattgaggcagaaattcccttggttgtgtgtatcactgaaggaattccccagcaggacatggtacgagtcaagcacaaactgctgcgccaggaaaagacaaggctaattgggcccaactgccctggagtcatcaatcctggagaatgtaaaattggcatcatgcctggccatattcacaaaaaaggaaggattggcattgtgtccagatctggcaccctgacttatgaagcagttcaccaaacaacgcaagttggattggggcagtctttgtgcgttggcattggaggtgatccttttaatggaacagattttattgactgcctcgaaatctttttgaacgattctgccacagaaggcatcatattgattggtgaaattggtggtaatgcagaagagaatgctgcagaatttttgaagcaacataattcaggtccaaattccaagcctgtagtgtccttcattgctggtttaactgctcctcctgggagaagaatgggtcatgccggggcaattattgctggaggaaaaggtggagctaaagagaagatctctgcccttcagagtgcaggagttgtggtcagtatgtctcctgcacagctgggaaccacgatctacaaggaatttgaaaagaggaagatgctatgaaagaaaaaaaaaattcctaaaactgtggaatggatcacgtagacatgtaacccagcagcagtttgcttctgttgtccactgattaatcagcctatgtgcctgacactggtcttgcagtacaactggaagccaaaacaaggtggaagatgtcctgaattaagacgttttcaccacattgtattacagagacagccaataaatctactatttgatttcaaaaaaaaaaaaaaaaaaaaaaaaaaaaaaaaaataaaaaaaaaaaaaacaaaaaacaaaacaaaaaaaaataaataataaaaaagaggcaacaaattcgaacacatgaaaacacagaaaagagaacaaaacaagaagggatgagcgccgggcgaatcgacaagttaattctgactgagtgggacgagcaatgaaatcaacgccacgtgctatcaaaacgaagcgtctaatctcgcgtcgctattgtattagcatacgacgcgggggattcatccataatgt

SEQ ID NO: 202526 - DNA, 1372 bp, Homo sapiens
  misc_feature (149)..(149): n is a, c, g, or t
gttattatctgcctctccgataggatgcctctttgtcttcacctgccattcccgctgtttcgtgaagaatcggctgtaaagggaaatttgttcaggcgactgctgtggccaccctctgcctcctccggcctctgcccctgggaggtccncgggggcctgggagtgtcattggcgtatgaccgcaacccttgccgctgccgctgacatcgctaccatggtctccggcagcagcggcctcgccgccgcccgtctcctgtcgcgcagcttcctcctgccgcagaatggaattcggcattgttcctacacagcttctcggcaacatctctatgttgataaaaatacaaagattatttgccagggtttcactggcaaacagggcacctttcacagccagcaggcattggaatatggcaccaaactcgttggaggaaccactccagggaaaggaggccagacacatctgggcttacctgtctttaatactgtgaaggaggccaaagaacagacaggagcaacggcttctgtcatttatgttcctccgccttttgctgctgctgccattaatgaagctattgaggcagaaattcccttggttgtgtgtatcactgaaggaattccccagcaggacatggtacgagtcaagcacaaactgctgcgccaggaaaagacaaggctaattgggcccaactgccctggagtcatcaatcctggagaatgtaaaattggcatcatgcctggccatattcacaaaaaaggaaggattggcattgtgtccagatctggcaccctgacttatgaagcagttcaccaaacaacgcaagttggattggggcagtctttgtgcgttggattctgccacagaaggcatcatattgattggtgaaattggtggtaatgcagaagagaatgctgcagaatttttgaagcaacataattcaggtccaaattccaagcctgtagtgtccttcattgctggtttaactgctcctcctgggagaagaatgggtcatgccggggcaattattgctggaggaaaaggtggagctaaagagaagatctctgcccttcagagtgcaggagttgtggtcagtatgtctcctgcacagctgggaaccacgatctacaaggaatttgaaaagaggaagatgctatgaaagaaaaaaaaaattcctaaaactgtggaatggatcacgtagacatgtaacccagcagcagtttgcttctgttgtccactgattaatcagcctatgtgcctgacactggtcttgcagtacaactggaagccaaaacaaggtggaagatgtcctgaattaagacgttttcaccacattgtattacagagacagccaataaatctactatttgatttcaa

SEQ ID NO: 202527 - DNA, 669 bp, Homo sapiens
tctgcgatccttaagcatcctaaccagggggcctctttgtacgttgagatgcagtgaaaagaaagaaatcaatcctagcctcagcattggaggtgatccttttaatggaacagattttattgactgcctcgaaatctttttgaacgattctgccacagaaggcatcatattgattggtgaaattggtggtaatgcagaagagaatgctgcagaatttttgaagcaacataattcaggtccaaattccaagcctgtagtgtccttcattgctggtttaactgctcctcctgggagaagaatgggtcatgccggggcaattattgctggaggaaaaggtggagctaaagagaagatctctgcccttcagagtgcaggagttgtggtcagtatgtctcctgcacagctgggaaccacgatctacaaggaatttgaaaagaggaagatgctatgaaagaaaaaaaaaattcctaaaactgtggaatggatcacgtagacatgtaacccagcagcagtttgcttctgttgtccactgattaatcagcctatgtgcctgacactggtcttgcagtacaactggaagccaaaacaaggtggaagatgtcctgaattaagacgttttcaccacattgtattacagagacagccaataaatctactatttgatttcaa

SEQ ID NO: 202528 - DNA, 992 bp, Homo sapiens
  misc_feature (149)..(149): n is a, c, g, or t
gttattatctgcctctccgataggatgcctctttgtcttcacctgccattcccgctgtttcgtgaagaatcggctgtaaagggaaatttgttcaggcgactgctgtggccaccctctgcctcctccggcctctgcccctgggaggtccncgggggcctgggagtgtcattggcgtatgaccgcaacccttgccgctgccgctgacatcgctaccatggtctccggcagcagcggcctcgccgccgcccgtctcctgtcgcgcagcttcctcctgccgcagaatggaattcggcattgttcctacacagcttctcggcaacatctctatgttgataaaaatacaaagattatttgccagggtttcactggcaaacagggcacctttcacagccagcaggcattggaatatggcaccaaactcgttggaggaaccactccagggaaaggaggccagacacatctgggcttacctgtctttaatactgtgaaggaggccaaagaacagacaggagcaacggcttctgtcatttatgttcctccgccttttgctgctgctgccattaatgaagctattgaggcagaaattcccttggttgtgtgtatcactgaaggaattccccagcaggacatggtacgagtcaagcacaaactgctgcgccaggaaaagacaaggctaattgggcccaactgccctggagtcatcaatcctggagaatgtaaaattggcatcatgcctggccatattcacaaaaaaggaaggattggcattgtgtccagatctggcaccctgacttatgaagcagttcaccaaacaacgcaagttggattggggcagtctttgtgcgttgtgagggacttttgctaaaatcattttattggagtgtggtgtcttcattggatgagtataataataattattgattttattatttgcaaaagattttgatactcttatgaaaaggatgttacgatctcaaatttaatttgcttaa

SEQ ID NO: 202529 - DNA, 752 bp, Homo sapiens
  misc_feature (149)..(149): n is a, c, g, or t
  misc_feature (717)..(717): n is a, c, g, or t
gttattatctgcctctccgataggatgcctctttgtcttcacctgccattcccgctgtttcgtgaagaatcggctgtaaagggaaatttgttcaggcgactgctgtggccaccctctgcctcctccggcctctgcccctgggaggtccncgggggcctgggagtgtcattggcgtatgaccgcaacccttgccgctgccgctgacatcgctaccatggtctccggcagcagcggcctcgccgccgcccgtctcctgtcgcgcagcttcctcctgccgcagaatggaattcggcattgttcctacacagcttctcggcaacatctctatgttgataaaaatacaaagattatttgccagggtttcactggcaaacagggcacctttcacagccagcaggcattggaatatggcaccaaactcgttggaggaaccactccagggaaaggaggccagacacatctgggcttacctgtctttaatactgtgaaggaggccaaagaacagacaggagcaacggcttctgtcatttatgttcctccgccttttgctgctgctgccattaatgaagctattgaggcagaaattcccttggttgtgtgtatcactgaaggaattccccagcaggacatggtacgagtcaagcacaaactgctgcgccaggattgatgactccagggcagttgggcccaattagccttgtcttttcctggcgcagnagtttgtgctttaattgtaccatcgtcctcaagga

SEQ ID NO: 202530 - DNA, 403 bp, Homo sapiens
actgtgcctctgccccctggaacttcttccatcttctcaacattgggaggcgccttcccaacttagaggcttggcctttgctgttccctctgcctgggacatgcttcccaccactctgcctgtgatcttccttcagatttcagcttaaaggtcatctcctgaccaccttctccagagctggcattcccttccagtttccatctcagcttcttgtgggtttccttcctacaccttatctcaatctgtaattgctctatcggtttgcttccttgtttattattattgctggttttcttcctctctatggtgtttattactgtcggatgtctctcatgttttatttatttactttcttactcttacgtctactctgtctcccacgacttgaatggcaaccctgaca

SEQ ID NO: 202531 - DNA, 321 bp, Homo sapiens
ttatactaatagtttgtatcttgtaatattcagtcagtaaatgagcagcttggtagggatcatttacacattttcccaaaagggtagtaggtgtttttcaggatatttatattgaaggtataggaatggaatctggttgcacataaatgcactccttaatgtattgattattcataagagaggaacaagaagataaagattgggctatagcatgaggtctaggcgatagcacaagttctagacaaatattcacaatctttaagtttatcacgtgctattgatctgtctaggtatgctcaaaatggtctacactgaaaaaaa

SEQ ID NO: 202532 - DNA, 618 bp, Homo sapiens
ctttcatagtaatctatgttagtaattcattttaaataaaatagatgtttcttagcatatgcaaaacataaaagcagagaaaatgtaattgtgtaaaggcagagttaaatatttaaaatttaaaagcacagaaacttaatttgattgaatcatcaactcagtcctcctagttattcatagattgtgagggaaaggggttttttctacgttctcaaacatggatgtgagggccatctggctgcaacacctgtcaccccattgatcggcagagttgattccgctgatctggctggctacgcaggtgtccccttcctccttcactgctccatgtgcatccctcctgaaccagcagctgggtcaaagaggacgaccatcccgtagaggagggccgtccctcagtcaagggcatacgagtagctgccctcccctgctagaacctccagacaagctctcaagttctcagacacctttgcaattggaaagactaattctaaaagaaaggaaatgtttccatctctacagaaaagccaaagctgtttaaaaattttttttcaagtgaatataggcacttaatggaaactttctaacttactggtataactgtgtctcaaacaaaca

SEQ ID NO: 202533 - DNA, 250 bp, Homo sapiens
gacataaaaagcaactaccaaggactcttaaaagtgagcaataacagatggattgaaagcaaaatcaaaataccaatagtgatctgtaacaggggtgggtttaatgggcttttttttctaacccatggtgtgcaaaatttctactttttctagctagagaaccaggaatgtggcctctgtaagatggatcatatatagagaaataatccttttgtttttcgttttcccactcagctctacctggaagcca

SEQ ID NO: 202534 - DNA, 558 bp, Homo sapiens
agctttcaccattttaccagaatctgtaggatttagatgatggtcattttattctgttgacagtatggagcactttgcagatggatatcaggttaattgttatattgaaaagtgaaggagtacattctactaacagtctttctgctgagaaaaatctaattattgccattaaggtggcattaagttagtaaattgggtaaataaacagttaaaatccccaaatttcttataacatgccataattgctttgcttgaaaatagttatcggccaggcgcagtggctcacacctgtaatccctgccatttgggaggctgaggcgggaggatcacctgaggtcaggagttcgagacctgcctggccaacatggtgaaaccctgtctctactaaaaacacaaaacttaggtgggtgtggtggcttatgcctgtgatcccagctacttgggaggctgaggcaggagaattgcttgaacctgggaggcggaggttgcagtgagctgagatcatgccactgcactccagcctgggcgacagagtgagacgctgtttcaaaaaaaaaa

SEQ ID NO: 202535 - DNA, 567 bp, Homo sapiens
  misc_feature (1)..(1): n is a, c, g, or t
nggcttgatgccctgcgctctagagaccctgaggcgaagcaatcaggatccccgggtgctgaggtggaggtaagggatgtttcaggcacaggcaagcttccactctacacattatctgtgggatcaagtcatcacacaagcatcattcactttaaccaggctgctgcaaatgcctctttttcattccgcctcaatctcttgcattagactttgacctccttaaagaccagaacccctgtggggtttatctcttaatctctcatttccatcacaggacatggtacagagattatagctgctcaatgtttgtttcaaataaacttggacatttacagagcacttcctggtataccaagcactatttaagccctttccgggcatcatgtctcattatcctcacaataatcctaagagatcagtggtatccccattttacagataaggaaattatccctattttatagataaggaaaatgaggctcagtgattaacaaacccaaacttaaatagctagtgagttcagaagctgggatctacaaagcccattttatggcaaaagacttagta

SEQ ID NO: 202536 - DNA, 533 bp, Homo sapiens
caaccataatgatactccccttcaccaccaggatacatgatacgatccttaacttggggtagaaggcactgccagttcagccctgcctccctccctggctctgcacaccaccacagccactctggccctcttgcagttttgcccccatttttattccttgcctttgggcttcatgttagctgtcccttctccagaactaacttactttgcctcaataattcctatttgtctttcagaaagaaatctctaaatcaggctcctctttgtaataccttttttttttttctttttttgagacagtctcactctgtcacccagggtggagtgcagtggcatgatcttgactcactgcaacctccacctcccgggttcaagcaattctcatggctcagcctcccgagtagctgggattacaggcatacaccaccacacctggctaatttttgtagttttagtagagatggggtttccccatattggtcaggctggtctcaaactcctgacctcaggtgatccacccacctcggcctccc

SEQ ID NO: 202537 - DNA, 502 bp, Homo sapiens
atttatacatgataacccccatatgtaggagtgtgtttcctagatttatgctacgcttaactataaaataatgatttgggggtcacacataaaaattattcgtatctttcccagaaattgcacttcaatagaattaaaatacagaatcaaaggactttaggagggcatccaatacaacttcaatatcatgcttcaacatgctctttgttactgtaataaattgttggcctctagatctatagtttgactccagtttatcctgaaatccctatagacttaaaagtggcaaagaggaaaattttacccaaagaatgaatataagtaatattcataattggtgcggtttctttcaactctattcagtgtttttatccctgtgcataagtccttaaaaatatcgcatcggctttgtccttacatggtgaatactactctctgattagcaactacagtggctgctgtttgttggacttactcttcccttggaaatacaggagtgtga

SEQ ID NO: 202538 - DNA, 389 bp, Homo sapiens
gtaaattaagcaaatggtattagtactactgtgaagatataaaactctaataagcctactaaggctggatctagaaactcaaaggtaccaggaggattttgagggggaaggcatagaaattgagaattagaaatagataaaaattacatcactaaagaaaaaataaggataagaaaaatcttaaatatttaaagtacaaaagtgaaagccaacagatctttttttctcccccagctctgggtatattgtgtcaggggatatagtgctttagtgtcaggataagctttactgtagatctgggaaaggaaactagtatttaccacactgtgctgtgtattttcacatacgttatcccaagtgatcatctcactaagccaagtagaaatgaa

SEQ ID NO: 202539 - DNA, 574 bp, Homo sapiens
ttaaaagaacaataatagagtattataagcaactttttgcaataaatgcaacaagttaaatgaaatgggtaagttccttcgaaaacttatcaggcatgtgaagagacggaacaatacaaccatatgaccaataaccaacagaaaaacaaacaagataaacagaccaatagatgatgccgatattggaaaagacaagcatttaaataactataattagtatgttcaagagaactggagtctattacaagtctataaaacaacatcaaaggaatactctagaactcaaaaccacaatgtaaaattaagaacacaaaagattattttgacaaaaagagaagatagttttggcatactggaaggcaggtcgatagaaaatatccaaacagagaaaaaaatttttttcaacatgtggaacatgataattaagtttaatatatgtgtaattaggatccaaaaagaaaaaaggggcagaatatatgaaaaggtggtaacagaactttccaaaactaaaaggcatccagctagattcaaaaaactctataaacataaagcaacaaagaaaaccacatctgaa

SEQ ID NO: 202540 - DNA, 608 bp, Homo sapiens
agattatcatgcagtgataatctacatgaggtaagtgttggttgaatatatagtggaaaatatgtttgaatgtgtgaggtagtttcagattataaagttttaaagtaagccaaagagtttggagttaatagggagctattttctgttctgaagcaggggaaggcaattggaaagtggtattttaagaacatttatttgatatcaaagagtaaaacagtttagagtgaaagataagaaaggttatcttggggaatatggtgataatcattcggtagcaatgaggtgataaaattctcagctagggcaataagtaatgagaattgagactcattggcaacttgacaaacctactaaagaacctgggaaaatggaaaaacagcaatgccactttctgaaatggtctttaaaaagggctacccagtttatgttggaaaaggagttcaattgggatatactgaattagaagtgtcagtgttgggaaacagagtctgagttagaggtcagggtttaaaaataaggtataatgtttgataatgcagattttataattacctgattccctgaaaatggaggagctcatcaaataagtaattataaagtgaaagaaa

SEQ ID NO: 202541 - DNA, 123 bp, Homo sapiens
aaggatcttaaaggctcacaagatttagacctcaaaccatgcttggagaatcatcaccctagagcagtctcaccatcctgccaggtgaggaagtggccaggtgtggcagaagccccgtccccc

SEQ ID NO: 202542 - DNA, 372 bp, Homo sapiens
ctatttatatagcatatgcattgtattaggtttataaataatctagagatgatttaaagcataagggagtatatgtataggttatatgtaaatactacaccattttatatgagggacttgagcatcctcagatcttggtgtctgtgggaggtcctggaaccaaacactaatagatatgaatgatgactgtaatttcaattagtagagatgaagctttctcaaaagaaaactcttgtattttttttagtatgtttgccccagataaagcacctcacccctgaagaggaaaacagggaggatgggagcagcagaatttaggggaaatgggtttggggaaataggttaggggtactgtgtgaagtacaggacact

SEQ ID NO: 202543 - DNA, 438 bp, Homo sapiens
tatttcctttcctggtgtgttggagaattacagctatgattatagaactcattgtttttgtgttgccagtaaaaataagactagccagggaagcagaaaaggtgtgtagatggtataacagagacacaaccgtgtctgaggaaagaagccctttctctatgtgccccatccctcccttaggaagcatttaaggaaaaggcttgtttttcatttcaggggaggtttaggccaagagagtggttgagtaaacacactgctgtgagagaatgcctggtacttaaatgcccaatagtttgttgtgtgtttcagtttaaagatggagatgatggggaggattgggaggtgacatttggtgtttgattccttaatattatcgttttagtcaaaggtaaattgttggctttgatggaaacctttgtgtatttaaatgcacagttc

SEQ ID NO: 202544 - DNA, 285 bp, Homo sapiens
ctgatttttgaaaaattttatccaagtaggcttcaaagttttatcacacattcatagtataagacacactaatgaggtatgggacatggtatatgatatatgcaagagtaattatttctcctatttaaagctaacttttttttaaccaacctgtgttgaataaaatcaggtagctaacgactggataactttgaaaaatccatctctttctttttcataaattttaaaaacccttaagataaacataatatatttcttctaaataactggcttagctctcaaaaa

SEQ ID NO: 202545 - DNA, 351 bp, Homo sapiens
ggtggtggaggtggtggcagcggtagcccccataatacttctaggtggaagaacagaccacctgagtgagagaaatcactcctgagccctgggggagaactgtgtggaggggcagatgggagcctggagttttgagggaaaaaaaactttccttttggaagccagacgtagggaagaagcatattgatcacaatgactattaaagaaagctccccaacaccccagcaaaacacccacaaaacaagaaactacttctgccaatggttctagccagttttcttcaccacagttcatgactgcttcatccttttaggtgatcacacccaaacttttgggtcttcctgccttttt

SEQ ID NO: 202546 - DNA, 344 bp, Homo sapiens
ttcaacataacttccatggtttcagtcttgccatacttttcaaagtagtctcaaattatattcttctgtatcttctttaataccaccaaggaaatttttcttcactggaagatgggcatcaggctttatcgactcctctctagaaagagttatctttggttccaatagacacccaccaacctgtgtggttgagcacatgttgttgcatccacctcttcaacacaagagtaagtcacaaaaccaaaccccctggaacgttttctttgggggtgtctcattaccatacaatctgtgagtgtgcccatttttccaaatgttctcttaaactatcatctgtcgtttca

SEQ ID NO: 202547 - DNA, 132 bp, Homo sapiens
tgctgggatgacaggggtgagctaccgcacccggcccttgaaggcattttagcacttgacttccaccacagccccaaggaatccatctatcatgactcgcacgcacccagtgagaagaaccaagacatacga

SEQ ID NO: 202548 - DNA, 609 bp, Homo sapiens
gtaagagagtatcacctgtagtgtcaatatgtattaccctgccctgaactgataacatggaacacacattagctccaagtttttggcagagatgctgtcctttaactctttgttattcaatcctcatcaaatccttctttcctttttctaattgcactccttttatactcccgtatcaaatccttcaatgtaaactgttaattctatttctaaaatatattgcaaattcagccacttctttttctcttctgtgaaatcaggcctggccatctccatcatctttgtttaggtctttcttttcagctggttacattactttcaagtctgtctctcctctactccgtaactgaaaaactatattttttttctatggaaattccatcacatagctccaagtttttggcagagatgctgtcctttaactctttgttattcaatcctcatcaaatccttctttcctttttctaattgcactccttttatactcccgtatcaaatccttcaatgtaaactgttaattctatttctaaaatatattgcaaattcagccacttctttttctcttctgtgaaatcaggcctggccaccacctttatgataaacggggga

SEQ ID NO: 202549 - DNA, 611 bp, Homo sapiens
ctcccaaaatgttgggattacagggacaagccactgcacctggccaaggattgttttttaagtgaactgagacccagccttattagtggtcccagagcagacctgggacctgaagggaacccttttcttctggtccagcgtctttcctctgatgggctactttcctggagcctttgattgcctgtcatcagagtaactgagtttgaacagagtaggtagttcctctccagaccaccacactcaccagctttcattctgcttctctcgtttagactgtggttctgaatcctcagttctatttactgagtgtttttaaacataaaaatgccttttaatgagattgaaggccagaggtgggacagttgaggacaaagtagaaataaaaccttcaaggcggggttgttggtgggagtctttttttgtttgtttgttttttgagactgagtctcgctctgtcacccaggctggagtgcagtggcacaatctcagctcactgcaacctccgcctcccgagttcaagctattctcctgcctcagcctccttagtagctgggatttcaggctcccgccaccatgcccagctaatttttgtatttttggtagaaacgggg

SEQ ID NO: 202550 - DNA, 567 bp, Homo sapiens
aaaatggcctttgtcacaggccactaggaagtgagatggagttagcatagcatggatcctctctggaagggagcttccagccctaagggatggctgggatttatgagggtgcttcagaagccggtatccacaaatgaatgaatgaaagttttacttataacttcactgaaacacagcttttgcttattctagtttaggaaccatgagtgatattttgggaaaccttttatggatttacgaaatgatccctggctgggcacggtggctcacgcctgtaatcccagcactttgggaggccgaggcaggcggatcacgaggtcaggagttcgagactagcctaacaaacacggtgaaaccccgtctctactaaaaatacaaaaaattagccaggcgtggtggtgggtacctgtaatcccagctactcgggaggctgaagcaggagaatggcgtgaacccgggaggcggagcttgcagtgagccgagattgcgccactgcactccagcctgggcgacagagcgagactccgtctcaaaaaaaaaataaataaagtaaaataaaataaagga

SEQ ID NO: 202551 - DNA, 107 bp, Homo sapiens
tctccttccctgtccctgcaccctcaactccatttatacgctatgaggtttcctgctaccatccgcgaagacccttgtcaacacagccggtgcaccagggtaccgag

SEQ ID NO: 202552 - DNA, 620 bp, Homo sapiens
atttattgttagtctcaccaatgagtaactccacacagcatctttgatcagtaacataatcctaaaataaatactggtacttcaggggaaaaaaaagacaatgtttttaaacaatctttcactccatctccaagaacatattatcacaaaaagcagactgtttttctccaacttatattaacataagcagccaaaaagactgataatgttaaagcacagctatctcctttaagatacatcctgaataggctttatctcagaggcacattttctaaataattttcacagaatatactgaatttccaaaatataattttataccaattaagttaaaaaacagaacaatgcttcatatagtttatgaagtaaaagtatgcaaagaatatacactagcttcttaatagcgggctatcaatacaggaggcctgggggcagcaaagggaataggatggaaaaaagtattaaatatggctgcaattcggcaaggtgtggtggctcacacctgtaatcccaacactttgggaagccaaggcaggtggattgtctgagtccaggagttcaagaccagcctgggcaacatggtgaaaccctgtctctactaaaaatactatttttaaaac

SEQ ID NO: 202553 - DNA, 612 bp, Homo sapiens
gggctgggagatacaaagggaagatgtaatctgtgaaggtcgtagaggccaattagggattgaaatcccacggatatgggttgtcgtacacccacttcacaccagttgctcttattctacaccatcatttcacataagcctcccacaaatggcaagtggaatggcatgattctccttattgcaagatgaggctatctggaaggatccaatgacttccccagtgagtagggggctgccccgggctttgcacccaggcttttgtctccaagcgaagagttgtcactcactgcacaggaagcagcaggagaataaccaagtcacggtctaaagttgggacacccaactgagtttcagatttctgcctgcaccaatgacacaggaattcagaataagggcgagatccttgtgggttcgtgtgatggtggcatggcgattcatgcttgattgagaagacaaaacgtgaacactttaagggcttcttgcacaagtgaagtggttgtggaaatgttttcaaggaggaaatgcctttttaatagagaaatttacttggctagttagcagaagttttctttcttgggttaaaagtagttgctgctattatatcctgaagca

SEQ ID NO: 202554 - DNA, 351 bp, Homo sapiens
ctgaactatagtttcttcatctgtaatatgaagacagtaatacttctggagtttcttttagaagattcatggagtaatacatgtagagcgtcaagcataatatggtatatgggagacaagatttggctattttatgtcttgtaattatttaaatatgcccaacctgtgtataaaaatgatttagatggcttacagtaagatatacttttataagtagaacaattatgccccctgcagtcctaaatgaaggcgaagtgcttttttttttttttttaatctggtgcacattaataccaactatgtgcaggaacccaggtactggaaattcaagaaaaagacatagtccctgcc

SEQ ID NO: 202555 - DNA, 1033 bp, Homo sapiens
cggcccacaacatggcctcgaccatcaagcaccaggacctgcacctctgccgtcttcgccagccgcttgggaaaggcttttcttctctttaatacaggaatattttaattccttgtaaggaaaatttcctggataattccatgtattttaataatcacagagatagtcttattcttactcattcattaccaaaaataaagacttcagtaacaatttatactccatagagtatacgatctcatctattttgacatccaaaaaaaaaaaggcagaaagacaaaacgcaaattctgaggcagaaattaagaaaatataattcttattttttatttaatttattgtttgttccgctgtttgaatgtttatcttccaggagcctacagaagtgagggaaagtatctgcaggctaattttaaataacacgagacagagattaaacattaaatataaaaaaaaaaccttttagcttacttattaaactaggaagaattttccttaaacacatcactcaaattggtctgcaatgcatcaataaatggagaaaatagatctcacctaggaaatattttatacattgtggacactacaaaaaagctcatcagaatataaaaatttccaagtcacaatcccctaagcagactaaaaacaagttagcgtttaacctgaaatcagaagtgcaaactctgtaaaaataaaaatattgccattgttctcagcaatctatgaataaatcctacaactccttaaagtcttttcaataaaatgaaccatgatctcttgacaaactccttgcttaaatggcaggtaacttttgaagctggacttctcaatctgtcaagagaagcaagctgcattggcagcattgctcgcttttgaaaatcaccttctgaacagaaggtccagcaaagaccttcaatgcaacactccctgtatatgtgcaagtctgcatgagacgtcctcccgcaggtgcaactcccagccaatgaaccagaaacagatgaaagacaaaaggggaagcgagtccatgtttcag

SEQ ID NO: 202556 - DNA, 380 bp, Homo sapiens
tgactctggaggcaactctgaggaggccctaggggacacagtgtgactggacaaaagttaccaggatgcccgtggcattgcctggaggaaagctgctcatccagaacagtagctctggagtctgcaggagaaagccacagaccacaaaatattaaaccactgagttttggtgggcggggtgggagcaaaggggggtgtgtaatgtgttaccgcagcatagcctagccttcctcaactaatatagctgcataaaggaaggtgtaacgggtgccccttcatcatcttagccagaccaaactgttgctccactccattgttctatattacatagagccaatatcaactttataccagatctgtggctcccaaacctggctcat

SEQ ID NO: 202557 - DNA, 248 bp, Homo sapiens
caaaacgaaagaaatccctgctcaaaaaagttgacgttacttcgagattaactcccaggtttgcaaaatctggtaaaaatctttccatctggtgtacttccttcgcctcgccgccacccccaactccagaaaagcagcacaaggctccttgtctccctccgaggcggctgcgacggcggaaacctgatccgagcctgactttcagtaaacaccagcgcagagagcaataaagcatccggaacatttgt

SEQ ID NO: 202558 - DNA, 399 bp, Homo sapiens
aacttagctgggtgtggtggcgcatgcctgtaattccagctattcaggacgctgaagcagaagaatcacttgaacctggcagacagaggttgcagtgagccaagatcgtgccactgcactctagcctgacaacagagcgagactctgtctcaaaaaaaaaaaaaaaaaaattgtgatattactactcttattacatggttgaattcactgataggtacttcttgatttttacccaggagttaggcctttatttttgttcattttttaatctttgtacgtaagaaccaaagtgacaatgttatagtcctccatttagtttatctcagggctagttgtgaaattctaataaagtagctaaagtttcacaaaacaattttttgactcaattcagaagtttca

SEQ ID NO: 202559 - DNA, 465 bp, Homo sapiens
tgtaaagcataggaattcctctttcaaaataatagaataaccacagatttgttagaatctattctctaaagatagctttcatttaaaagagatagatctgccagttacatgctaattttctgtttcttcagactgtcaaaatcattcctttacacaactgcacatgccatgtagctaaataatggccaaggagataacatcacaagtgttttgtgattcccagaattctcagaggaaaatggatatgcctactttttaccctcatttttcctactgtctactagtagatgtgatggctcaattttgaggcaccattttgtaccatgaggtgacatactaagaatggcgaagcagcaagataaggatcctgatgactcagacaacagattagtcctggattacgcatctctaggctactttcacatgaaagagaaataaactctatgttattgtatttgtcttcta

SEQ ID NO: 202560 - DNA, 516 bp, Homo sapiens
aataatgctgccccatctgagatagaaccttcttttgttatgtactgggcacttaaagaaaaaaagtacaactctgtaatggcaaaagaaaggtgcaaaaaaatgcaggatagaagcagggccttgagaatatatctgggagttggaggaagaaggtgggaaaaaggctgagacaatgtacagcatgggctctgcagactgggcagggagaacataacaaccagtaggcaagataaggaatacagttaaatgaatcaatgagtgagtaaatgaatgaatgaaccaacataggaaccaatgaacatacaaataaaatgaatgaataagtgaatgagtgggcatataaatgaatgaagttgctgaatggtaggctggaactaagatgcagacagtcctaaatgtcatgtaatgagtctgaattcatccaaaaaagcagaatgagaaagacatttcttagacttctgcagagcacagtctgcccaactgtatgcacagacctaactaaaagcaatgaga

SEQ ID NO: 202561 - DNA, 319 bp, Homo sapiens
gccgatgagactctgcagtctgcaggaacaaaatggcggcacccattgatttagtttagttcaaatgtgcacatagaggcattacctctctctagagtgtaagctctttggggacagggtggcttttctcccttagaattcccttcgattgtataacgtctgcatgcatagtcagctcaaagactgtggaatgtagctgaatttcgaatttgcttatagccagccaagccatattaaatttccccagtatatagagagctgagaacacacactgagctcggggcctgaacctcttattgcaggcattggtctgaggggc

SEQ ID NO: 202562 - DNA, 442 bp, Homo sapiens
agcagtggtgcccatagcctcagagcagatgcagcaccccaccagagacctcaggctccctgtacaccagagtaattactccctctagaaccacaactgagacagtgcactgctcccagaggacctcacacctcatgcacactgagcagtcacattctttgaccctacagctgaaggagtcccatgctctccacccaaggacatcaggcctccagcacactggagcagttgtacctctcagcacgacagctgatacaatgccccacccttagtgatccgaaggctacattgacctatgtagccactttctgaggctgagcagacaaagcggcttaaatcccattaaatcagaaccttggctgagttgagccaccctgccctccaggccatacatccagagcatttcacccgcctggaattcaagcagcaccccgtggtctga

SEQ ID NO: 202563 - DNA, 116 bp, Homo sapiens
agttgggaattccaacacccagataaatagtaattagagaacatatatgtccctgtgattacatacaatatatgcattgtacatgtggattacatacaatatatgcattgtacatg

SEQ ID NO: 202564 - DNA, 399 bp, Homo sapiens
ggcctcagggagctttcgctcatggcggaaggtgaagcgggagcaggcacgtcacccactgagagcaggagcgagaaagagagggagacggaaggtgccacacacttttaaacaaccagatctcgggcgaactgattcactatcttaaggatgcaccaagaggatgatgctaaactactcatgagaaatccaccctgtgatcccatcgcctcccaccgagccccacccctaatactgggattacatctcaacatgagatttggcaggacgaatatccaaaccacatcactaaccactcacgagcctagatggaaaccgtgagcacgtcaggtttattccaggaatacaagatgggttaacgtttggaaattaaccagtataattcatcacgttaacaag

SEQ ID NO: 202565 - DNA, 553 bp, Homo sapiens
tgcctcggcctcctgataacattaaattcttgtatagactagagggtgtttccaggctgtttattctgtttcattcaaacttagttctataccacactgtttcaaatgctgaagttttcattttgtgttttaaaatctggtagtacaaatcatcttcattattattatttcccaaaatatttttggctactatgtctgacatatcttgtatagcccagaggaaatttagaagcatttcacgctaaaaaaaaaaaaaaaaaaaatggggtttttttttaacttgataggccatttgattccgaggagatccgaagatggatttataacgattgggctttgggactccattatggagtctcctcatacaggatgtgtgctatcccattacctctattccaccttccgctagtgggagaccttatacttactttggaggctcttaccggggtcctcgggtctgtggccctgtgggagttttccctctttcctctgtaacctctgtgctgtggccattaaccccttacaggtgtgttcctgtctgtggttgggccca

SEQ ID NO: 202566 - DNA, 206 bp, Homo sapiens
cactctgtgctaagcactctgccaagtgtattcagagcatcaccccagaaattccacatgcttaccttgtgaggggtcattatccccatctcagaagtgaggaaacaggttcagtgaggtgaagtaacccaaggtcacagtgctggaacctcagggtctctgactccatagcccatgtgcttggcagccacaaggagggtaggatg

SEQ ID NO: 202567 - DNA, 654 bp, Homo sapiens
atattgctgattgtatattacttaacaaattattagttggtattggcagattattaaccatggcctaatttctatcatgtctaaaataaatcccatgtttggtgaagatagaaaatgaatgagattttgtgtgtgtgtttgtgtgtgtgtgcgtgtgtatgtgtatgtttatgtatgtgatgagattatttccttaagtccccagtctaatagttgttcagaatgtataggaattgcacttctaaaatactcaccacaaccacatcatgcctagcacaatactgttggaatttaaggagactcaagtaacgagacctcccccaccatcaccccaacacccaacaccccacacacaatatctggtacgtttggaatatttcttctctattcttcacttttgcatggaaaggtacttccattagaatattgtcctggtcattgtcctacctcctcactgacctccgttaggcatcttagtctgtttctgttataacaaaatacctgagactgggtaatttataaaataaaggtttatttggcacagggttcctgaagctagtaagtccaagatcaggcagatgcatctggtgagggccccatgctgcatcctaacatggtggatggcatcacttggaaggagtgcatgcaaacaga

SEQ ID NO: 202568 - DNA, 258 bp, Homo sapiens
gaaatcccctcttcttcctccttcaacttctccctctttacctcctctcaaatttgaaatcctacttgatggttacattactctgtctatctaaaggttatttactcctgaaataatacattataatgatattttctttcttgtacaactctatcaccagaaattaataataaactttttcatttgcttagtttttttagttatgaaaaattgaaaaatatcggctgggcatggtggctcacacctgtaatcccagca

SEQ ID NO: 202569 - DNA, 495 bp, Homo sapiens
tcctcctacctcagcctcctaagtagctaggactacaggtgcatgccaccatgcctggcttttattttttattttgtagagataaaaaattcaaagtatgtattaattgtataaacattcacagcaagaagcaaatacagcttcttaataaaaaccgtgtatagtttttgaggttttaaaactagctcttggacagtggccagttatgagtaagtgaaggagaaaggagctttgcctggactgatttggagggttacagagaggtggcaggttaataatgtactttcctatcataggcaaggggaattctaatgccacctggttttaaagtcagaccccccccaaaatgtctgtcacaggtgatgagtccaaatggaaattggctcctttaatacctcataagcaaaccatctaggattattataaagtagaacaaggtaaagccagagaatctctaaaactgaatctttttagtcaacctggattccattgcac

SEQ ID NO: 202570 - DNA, 351 bp, Homo sapiens
gtctgaggatccccaaaagtgcactcttctatatctactgtgttgttagattgccttaaggccaccaagtcatagcttactaccataatttgtagagttttcatcaattccagtgaactatatagtgattctttgtaattcttaccagttatcacccacattcttgaaatgctgctttaacatctaacttcaaataatctgttatcttatttctacgttctatcttgttgattattctcaaagagaaatgtagtgcttttgtaccttttctatcaaacttacagagtacataaatctaccaacaagttatgtagatatagaagagtgcacttttcaggatcctctagatca

SEQ ID NO: 202571 - DNA, 636 bp, Homo sapiens
ggaaaaaaaggcaagagggttttattcctgaccaggagaaagagaaggagggggctcttgctctaaagacaccttcaccccgagccatggaaactggggagttgtaaggagataggtgtggggcagggaggtgtgtaagcaggtgcggggtcacggtgtgggggtggagacctctagacgctcaggcccaggtcataaacatgcctgagacatgtcctccagagttgacttacgcgaggacagaggtgtgcagaggcacggcaagctgggccccaggcgagaagcatggagtgagggatgtggaggcagcggaaggcatctgggagtctgggctgccccgtagcagctctgtgttctgcctgctcttcctccaagatgagctcccttggccagtgtgtgaaacgtgtgtgtgagtgtgtcaccggtaagctgagttctttccctacttggtatcagttgcaaagaaagaacactcagttggaaaaaaaggcaagagggttttattcctgaccaggagaaagagaaggagggggctcttgctctaaagacaccttcaccccgagccatggaaactggggagttgtaaggagataggtgtggggcagggaggtgtgtaagcaggtgtggggtcacggt

SEQ ID NO: 202572 - DNA, 461 bp, Homo sapiens
ggccgctggcttccagaactactgatgtaccattatgtacgcgtcagaagagcctggtcacagttcatggagagccactggagctctctgcgtgtggtggaaacagtgaaggtggtattttaggaagtttgggcaaagctgttggcgacgatttggaggagagagtctggagccagaaggtcagatgtgaagggacaaaagcctgtcctaagatgacaatgacaccaataggaatagggagatgagtgcccaccattcctcaaggaaaaacaggagtcaggactagcactgactggggtggaagggggacagtaatgccttcaggctgtaggaccgaagcaaagggagactcaagaacctagggccagggataaaactgtaaaagttaggaaaggagtggacagtatgtttctggtgatagcagcatagtttctcttgcagataaaagctaccaaccttag

SEQ ID NO: 202573 - DNA, 712 bp, Homo sapiens
cagaggttgcagtaagccgagatcgccccactgcactccagcctgggtgacagagagagactctgtctcaggaaaaaaaaaaaaaagaacattgagaacattgctagttggtccctatcaatttggctttctggattattttcatcagtgctctttaatagaactttctatgatgatggaaatgttctgtaatctgtgctaatacaacactagccacatatagctattgtagtacttgaaatgtggcgattgtgactgaggaactgaattttaaattttatttaattaatataaattcagttagccgcacatggctagtggttaccatattagacaacatagacctgcattattttggttaggaacaaaatatatcaagtgtttttaatctaacagttttaatcaacttgaggatctctaaaagctgtttacgtaataatgacaaaatgagatgatggaaaatcattggagggcccatgattgcaggtactgtgagtacagagatgttaacatctagaaatttttatagtctgaatacttacttattttaataggaatgttatagaagtgatataggtcaaaataaaaaataaaacagtgaaataatacattcaactgtaccaatgtttttttacttccccaggccagacactgtgttaagctttaagcagagatggcagtatttggcagctaaatagtgccctttgtaccc

SEQ ID NO: 202574 - DNA, 257 bp, Homo sapiens
gccttcactacatggtggccccaagttgtggtcatggaggggggctggtcactttcctggtggtgaggacacttaaggcaggcagatcccaatggcgaccaggccctgtgtgggcactctgcatatttataccttgcgagcctcaccttgtctgctgccattggatcacttcactttatggatgcacacctgtccctagagatggccacggacttccttgtatcacacagctagtgagtagcagccctgccactccc

SEQ ID NO: 202575 - DNA, 1170 bp, Homo sapiens
agcgcacgagcggttcaaaagtatacagaaaaaaagcaagcctccctcccactcttgccaaataagtacccaattgccctctctgtaggcaaccaataatttcaacttgtgcatcttactagtttcctatgcataaacacgcatacacgtatttggtttttttcaattaaacatatgagatgacatcatatatactgatttgcacttgcttttctccccctcatgcaatagtattttgaccatcatttcatatcagcacatatgagagcaacctcatttttgtctccaatggttgcacagatttacattgcctggatgtatcaaattatttaaccaggaacatttcacttctagtctttcactgttaaacaatgctggggaaaaaaaaaaccccttctatatgtgtcaatggacacataagcaagagtactcttaaatacacctagaatatgaagtgctaggtcaaaaaatatgtgcacttttctattaagtaaaagctaaatctctctccacccagataagccattaataattgcaatttcttccctaaatgctccccttgctttctcattctaagtgaaacccagctctcccctgaatatactgcttcctcaaagtcttcccacattccatgttcaaataggcctggaagtaaattcagtgtgcttactatacatagcttcttcgtcatttttctctcttctccctgaaacctcccagctcaaaatctcctgtaacatataccacccaatatgtgtccttgatgctcctctaccaacccacgagttcttggaaattctaactttcagctcactgtcattttcttaaaaattattccttgcctaattgttaattattttaataactatatatagatgattaatatcctggtctatcagttttcttgacttcctcttctccaaagatcttttattctgcccacttccacttcacacaaccatgaccacaccctaaacactttttcattaccaataacttcactccctccttcaccttatgacataacactttctgacaactacttccattctttccagttgattccttgtctccaacaatccttcaaggccattgtgatctaaaaatctatggaacctacacccactgctaaattgaccgctcgtgcagcatggggatactctaggaagt

SEQ ID NO: 202576 - DNA, 609 bp, Homo sapiens
cttgtctttctttcctcctttccttcctccctcccttctctttctttctctctctttcttttctttctttctttcttctttttggaaatgggagtctcactctgtgcccagacggaatgcagggcacaatctctgctcactccaacctccacctcccagctcaaaatctcctgtaacatataccacccaatatgtgtccttgatgctcctctaccaacccacgagttcttggaaattctaactttcagctcactgtcattttcttaaaaattattccttgcctaattgttaattattttaataactatatatagatgattaatatcctggtctatcagttttcttgacttcctcttctccaaagatcttttattctgcccacttccacttcacacaaccatgaccacaccctaaacactttttcattaccaataacttcactccctccttcaccttatgacataacactttctgacaactacttccattctttccagttgattccttgtctccaacaatccttcaaggccattgtgatctaaaaatctatggaacctacacccactgctaaattgaccgctcgtgcagcatggggatactctaggaagt

SEQ ID NO: 202577 - DNA, 208 bp, Homo sapiens
cacaaccatgaccacaccctaaacactttttcattaccaataacttcactccctccttcaccttatgacataacactttctgacaactacttccattctttccagttgattccttgtctccaacaatccttcaaggccattgtgatctaaaaatctatggaacctacacccactgctcctcactctgttatgtatttactttcttctt

SEQ ID NO: 202578 - DNA, 499 bp, Homo sapiens
aatgaatgggtctttaaaaaaaaaatcagcatggaaaagaggcctgcatagagagtggaggcagcaactgtctagttcagaggagcacagtagatacttaaacctgtgtgaagcacagctgtagatcagatcctggttcaacaacaaattcttaaaacttttttggggttaaattggagaaatttcaatgttcactggatattggactatagaattattgctgatttcttaggtgtatgatggttttgtgggtagacagaaaaatgccattattttaggagatacatggtgagttatttagataagctgtgccttgatgtctgcaacttaaaaatggcttaacaaccaacataatagattgatagatacatacatacataggaatagttaacagagagaagacaaatcaaattatttaaactaggtgatcagtatagggttatccactgtcctatttgaacttttctttgcatgaggaaaggttcataattgacagttc

SEQ ID NO: 202579 - DNA, 435 bp, Homo sapiens
agatagggctttttctgggatgtggtagatgctaaaacttggagagttaagtttcagttctacttctcccatctaactacctgtctaaccatgagaactagttgcttaacctttcctgttctcaattgcctttcctctaaagtgaagagttctactgagacaatttgcaacttttggtataatatacttgttttgcacatcatcaaacacaatggcaactatttggttatctcttaacattagggaatagaaaatcttagggtgttagatattggtatacatgattagaaactatagttcttctgactcataagcctatatttagagagatttgatgttctgttggaaggtgcaataaaggttttacaaattaccttttcagcatatctaaacagcatatcattgcttactcctctaccacttggtacacagtga

SEQ ID NO: 202580 - DNA, 557 bp, Homo sapiens
tgatgcagaagaagatacaggtgccagaatccagctcattggcagcaccaaggctttgagactgaccactaagaagactaataagagaggcttctcgggcaaatctcttcattagcaattttcataaagtaattcatctaatcccacaagttatacagaaatggcagtaagaaaaacaaaaagacactgaacacatcaaaacaattcaatgcaacaggaacttaacagtattgagtaagaaatctgggcgactaatttaatgagtaaaatagttgggaaaacaaaccctcccatcccttgtagattataaataaaagcaaaaccgccacagaactagaggtcttcttctttaatgttactttaaaattgctatgattgtattgtacgttatttaatgtctgattgaaacacaaatttacatgcatgtttgttacaaaaaaaatgaaaaaaaaagtcacaatttgtcagctctgatttcaaattgcaattatttttaaggtgtataccatcgaagagaatgggtatttttttgtatgtattctggaagaaaacaacaa

SEQ ID NO: 202581 - DNA, 325 bp, Homo sapiens
cgaagcaaatataaaccaagcaagataaaatccactcatgttgactatcatagtattgagatccaggaatccatgctgtctgtagttaaagcagattatcttcactgccatctattggtctttatcctgaattaggagagaaatcccccgaggttctgcatggcaaataaagagttaggaaagccaaaatatcagtgggtatcataagtgatttactctagataaatcactgaatcatagtgacaagcccttaggagctctgccttagaatttcccaagggtttcgtagatgatcctgcagcaaagaatgaattccagggtgtca

SEQ ID NO: 202582 - DNA, 434 bp, Homo sapiens
catcattctcaagttcttgttttcctcacctctgacatcaaactggtcatcaataccttttgatttgtggtggaaatgttgtatgaatacatctcattctgggtaatatcatcttctggcttatttcatatctttggcatgtggactactgcactagcctcctaattagcttctatcattctagttttcttctatcaaaccaattttcagggttattgcctggattctctttctacaacaaaaatctaatcatgtgattctcactgccttaaacatttagggatctatattatatgtgggataaatcctaaaattctcaatatatcctctaacatccttcaaattctagactgaagccccacatctggctcccattgttcctccaacaaaccaggggatgagcacaggtttattctttaagaaacatgtgatgc

SEQ ID NO: 202583 - DNA, 297 bp, Homo sapiens
aaaatatgagagtatattacaagtaataagggtaagtattcttgtgcattctttgaaacagagtctctagtgctacaagttaaaggtagttcttccttaagtgttgtaaaaaaattctttggagcactgcactgctacttttcttcttcctcctttataagaaagtttcttagaggcaggcatagtggctcacatctgcaatcccagctactcaggatggccgaagcaggaggataacttcagcctgggcaacacagcaagactccatctcaagaaaatttattctttaagacccag

SEQ ID NO: 202584 - DNA, 793 bp, Homo sapiens
tgtgcaatgcttgaagatagttttgccttctggaaatctagggccaacggtttgcacaggcagctgccttgctcaaatgcaggaaacttgagttcctttctcaccagaatgttctttttgcagattctgccggggccacccacagtgtgtggctaaccctgatagctgtcctgtgtcccagcgggagtgtgtgttattcctgactcaagggcagggcagagacctactgcctagacctgagcccaggtctgggctgctatctagtacaagcagatggtgagaggcagagagagcacagggcagctagagagagtgctagaggaaaggagggtgagggcatgcttcttctttgataggttttctgaagactggggaaacagcattttggctgtgatctgaccccacagtggtaaatgttttgactccttctgctacatttagaacactgactacttctgtatgtgcacaacggtgttccaggtcctttagacgcactaatttacccctcacagtcaccctatgcaagagtgctatattttccccactacacagatgggggaagtgaagcacaggaagctaaataacttacctagggagtagcagatatgggacttgaacctacgtactctctggctccaaagcccttgtatctagccatcacattatgttgccttctttatgatttgtagagatggggccttgctctgtcacccaggctggagtacagttgcaggatcgtagcttactgcagccttgaactcctgagctccagcaatcctccagcttcagcctc

SEQ ID NO: 202585 - DNA, 230 bp, Homo sapiens
tgggcagatcacttgaatcctggaggttgaggctgcagtgagcagagattgtgccactgcactccagcctaggcagtgggagtgagatgctgtctcaaaaaacaaaataaaataaaataaaacagcaggaatgacatttgacttaattttattctattgtagaaactgctgaaaatataggatttgcttgtgaacttctgactgaagacaccaccatctctcgatgggga

SEQ ID NO: 202586 - DNA, 300 bp, Homo sapiens
ctgggagtgttgagtaagcaaccaggtacggtgtaatgcttctgcagttgatcacactagagcccgacccaaaaccccaaaccactctccatcctccccagcctcgcagactgctggcttctccaagccatctttccttctctctgtcatcatgcaaaagctgtaactatgtttcagaaacgcaatctgtatttcatagacattaacagatgttctgtcctctgcaacatctaaaagaaccaaacacaaactccctataccaaaatactcccatctcccctaagcacacacagttctact

SEQ ID NO: 202587 - DNA, 451 bp, Homo sapiens
agggattatcttaattaaaacttagaaaataatgacttttggtttaggccagggcctttgttttcttttttgctaccaggtacttgttgcctttagactgaccaaccagatccctgcactggggtatatatcccatctatcttcccacataccatacttggctctctttggatagactctgatattaagtacttgtttctcttctacttgaaagtatctatatttcatggaggatggtgcttcttaacgttctggttgcagggctctaggcctgaagggcttttttggctagtgaagatgggtttcatcatgtttttcaagtcacactttccttcggtggtggtcttgttgccatacccagctgagcttatatctaaccagccctactttcagagagttggcattcaggtgtcttcatataaagtcagttatgctggagtaacagagaaca

SEQ ID NO: 202588 - DNA, 466 bp, Homo sapiens
cctgaatgaagagaaggtagtaaaggaaatcatttagtaatggaaaaaataaacacaagattttagtaggaagaaggtactaaaagccctgttaaaagagtcctgggagcttccttgactggcatttgaaattaatcttatattttcctcataagcagttgttagcatagcagaattttgatttgtttagaagtcaaatgtgatttactaattcaatccctgtggtttgagggagaaaggagtaggtccctattagaactgtgaaatcagtacagtttgctctcataaatgctcatacacaaccctcctcacttcctctttttcttgtggttctttttagtccccaaagtccagcaaccccttttttccccttgaccaatttaaaacaaaccatttgaatggaatcgtagatgattgcaatttagtgtggatttagttgcattgaaaaatgctgtcacatgttgga

SEQ ID NO: 202589 - DNA, 495 bp, Homo sapiens
gtcctcaaatttgctttttgatctgtaaagactaagatatttatcatctagttttacagaaaagtttgcagatcttctggtttaaaagagcaggagatttagtgtcaggcaggtttggattgagcccaagggctgccatttactgattgtatgactttgagcaaggtatttatcttttctaagcctcaatttcctcatctataaaatgggcacacaaatagtatttaccttggagagttaaatgggataatgcatttaatgtgcttaacacagttgcctatcagatgcttaggggctcaaaacattactattgttgttgttgttgttttaccctaaagtaaatgagacaaaatagcaaagctaaatgaggaggaatttttaagttacatcagaaactgtaatagattctaaaatattataattaagaaatttcatacttatttaaaaaggcattttcaatttaacaatttaacaatttaaccctcttataagtta

SEQ ID NO: 202590 - DNA, 367 bp, Homo sapiens
cgacaaggcgaaaaaacccatctctactaaaaatacaaaagtagatgggcgtgatggtggcatgtgcctatggtcggccgctcagaagactgaggtgggaagatccttgatctcctgggctcaggggattctcctgtgtcagcctccccagtagctgggattacaggtgcacatcatcatgaccagttaatttttaaattttctgtagaggcgagatctcactatgttgctcaggttggtcttgaactgctggcctcaagcaatcctactaccttggccttgccatatgcaactccataggtagctttttctatttcgtcacatggttcatcttctgaccttggccttgccatatgcaaggggatcc

SEQ ID NO: 202591 - DNA, 292 bp, Homo sapiens
gcccttgtgcccctgcctgcttttgcccattcccctgggctctggggatgtgtgtgctgaaacctgggcctcagagatggtcagtgagaaggactaggtcattcattgcctctctgggccctcttagctaccacacagaagatggggcccaggccccctgcaggggtcatggacattatgagggaggagagcctgccaccctagtcctgcccgtacctccaacagccctgcctgaccttttggggacctcccccagagcctcttcgcatgccttggtcgcttttacctacat

SEQ ID NO: 202592 - DNA, 437 bp, Homo sapiens
aggagatgtgtcctgtggatggacatggtccacagagttgaagcacagagggtgaagcgggactatctggagacactgccagatcacaaccttgaaaacctggtcaaggagcttcattgaagtttaggctgagagcaatgggagccatggagaggttttcagcccaaatgtgatgggctcagatctggcctttagaaagctggccgcagctacagtgtgaagagtggtcagagggacaggggaggctgcaggaagatcaggcacaggcgctgcagtgatttaggtgagagatgatagagccacagggaagggcagtggggtggagacaaagccagcagatctgagagatgcacagcctttgtggttaactagatttattggtgggagaggcagcatttttgctattcatccagcataaacaggaagatgacttattg

SEQ ID NO: 202593 - DNA, 483 bp, Homo sapiens
gatgattctggcccctggggacatttgtggagacatttttggttgcctcaacctgagggggtcaggggaagtgtgttctactggtatctagtgggtcgagaccaggggtgctgctcaacttcctgcagtgcaaaacacagtgctcacaataaggaattacccagcccagaatgtcaatagtgctaagactgagaaacctgggcctacaactgttttcaatacaaatacaaatgaaaatgagggaggcagtctgaactttacacactggatcaagatccttttcaaaggtggaaataaagcaaccctaaaggaggaactccacctagggtacaagaagagaggaaacgttttgttcctttgtgttccgcatgtcattaggaagtacacatgggtggactattacattacagtgaatcatgaccatgtgttcattctaaacattgttgtatttgttattcctaactttaataaactgtaaaatct

SEQ ID NO: 202594 - DNA, 379 bp, Homo sapiens
tatggaattccttccttaatttccttttcacactgttcatggctggtatacagaaacaactgattttgtgtgttgatcagttgctgcaactttgctgggtttgtttattacctctaatagcttttttgtggattctctgggatttcatatatacggattcacatcttatggaaaaagaattttacttcatttcccaactggatgtcttttatttctttttcttgactaactgctctggttagaacttgcaatacaaggctgcagagtggcatgtttgtcttgttactgaccttaggggaagagttttgttcttcactactgtgtatgatgtcagcttgagggttttcacaaatgccctttatcatgttcaggaggtcct

SEQ ID NO: 202595 - DNA, 237 bp, Homo sapiens
aagtacacagtattatgacagtaagatgtatgttgggggaggaggcagaaacgaatggaaggaataggacggtgaagaaagggacattactaaagttgagcattggtatagtgagtagtaaataaaggtacaaaatattaggtctattctttaatagactgagaagtaccagcttgatctaattgaccaaaaaaaaaaaaaaatgaattaagaaaaaacatttggacgaaaagacca

SEQ ID NO: 202596 - DNA, 299 bp, Homo sapiens
cagagacaagagacagtaagagaaatggcctgtctcctcaccaccacttacctagcaagatgactaaaagttgaaaagcctgacaaaataagtgttggctgagatatgtagcaactgaactgtcataccttgcctgagggagtgtaagttggtaccatcactttggaaagctgtttagcaagatctactcaagcaggggtatccaatctttcggcttccctggggcacaattggaagaggaagaatcatcttgggccacacataaaataatactaacaataatgatagctgatgagcta

SEQ ID NO: 202597 - DNA, 739 bp, Homo sapiens
  misc_feature (647)..(647): n is a, c, g, or t
gatccgaaaccatgaagtgtgaactcggtgccctactccggccatagcttagtgcctccctttgagagtcaggctttggggtatcttttgctgatcatatttgggcacaggtggtgtaaattctactccaaatgaatgccgttttctctcacccattctacagtgagcagccccaaatgtgaacactgtctcttgactatggctgggtgaccctgggcagctggtgaacctcatcaaatttccatttgctcatggggagaaggtggagaatcagatccacaccgatcaagttgtggagatcggtggggtaatacacggagtatccagtgggtgcctggcacacagaaagggctccacaaacccttgccccttctcctcaccatattgccgaagggtaaagggaaaggcatgtctggacctctaagaaatccaaaggcatgagaagacagtaggacgggcacccttgggagcgttttctctcacaaactaaaacaggatgacatgccgaagtgttctgatctagcagtcccagatttcccctcaggcaaaacttccctgagcagaaccatagctttgttgcaaaatagagataagtcacctggcccattaggagtttaaagagtgcttatcctgaaatgtgactgctnacataacgggcctttgtctgtacataactaggatggaaggctttatgattcacttttcattcactgatatgacacacagatactataattaa

SEQ ID NO: 202598 - DNA, 537 bp, Homo sapiens
  misc_feature (45)..(45): n is a, c, g, or t
gctgctccaggattcaggtagactaacatatgcacaaaaatatanaatgtaataaaaaatacaacaattcctttttaagtacctttagaaaaaagcaggcctggaagtttggttccttttcctcccctgttgcaaattctcatggtttggggtttgggtgggtggagagcgcgtgtcatctgcgggttggactgcccacggtgggcgggcgggcctctctactcgaaggtgaccacgtatagattctggttaggtctacctggccaggtagacctttctctgtctttactgccctatgctggacagcgcctagaaggtctggcacagttagaacacagaataaataattgtcatgggaatgaatgcatgaattcattctttctgatttttgtcccccaaaatataaggagaaagccatttaacgcgttggtctaactgagcctcataatcttttctgcaaggaaaagatgtatattcttcaggggaaaaggaagattttgttgttgttaagatgatattacctggtttgagatgctt

SEQ ID NO: 202599 - DNA, 802 bp, Homo sapiens
aaatcggtaaagaggaagtcaaactgtccctgttagctgatgatatgtgattgtatacctagaaaaccctaaagacgtatccaaaaagctcttaaaattggtaaatgaattcagcagagtttcaggatgcaaagacatcatgactgagaacccaaaagtgaatgcaacaaaaaaggttttgcacagcaaaagaaataatcagcaaacagacaacctacagaatgggagactgtcttcacaatctgtacatcagacaaaggactaatattcagaatctacaaagaagccaaacaaatcagcaagaacaaaccaaacaatcccacaaaaaagtgggctaaggacatggatagacagttctcaaaagaaggtatacaaatgtctaacaagcctatggaaaaatgctcaacatcactgattatcagagaaatgcaaatcaaaaccactgtgcaatactacctcactcctgcaagaatggccataatcaaaaataaaaaaataatagatgttgacgtggatgcagtgaaaagggaacagttttacactgttattgggaatggaaactagcgcaaccactatggaaaacagtgtggagattccttaaagaactcaaagtagatctactgtttgatccagcaatcccactactaggtatctacccggaggaaaagaagtcattattcgaaaaagatacttgcacatgcatgtttatagcagcacaattcgcattgcaaaaatatggaactggcccaaatgcccatcagccaatgagtggataaagaaaatgtgtgtgagtgtgtgtgtg

SEQ ID NO: 202600 - DNA, 255 bp, Homo sapiens
tgcagtgcttttagttatcagtggagattgtactgcatatgctatcttcagatttgaaggtcatcccagtacaagaactgaagatgttcaactaatttagctgaagtgataacagctctgaggcaagaagagtataagtctaggttactggatcaagggataggttattagggctctccagagggacagaaccaacagaatatatgtatatataaaaggggctttattagggagaattggctcacgattacaagg

SEQ ID NO: 202601 - DNA, 386 bp, Homo sapiens
cgcaaccttcatgcaaaccagactgaggtcatggcttatgtcttcaaagtctgacagtggtgggcagttggaggggcaacagattcactgctcctcccagggcaacatgagttcctaggcgacctgctgtttaacaacaatttcggcagctgtaaaactagtaatcctttacggtagaataatgctctgtactctagaaaacattttcaaccctttctctcctttgatgctcagaaaaaccctgtaagacagataggtagagtaaaaccctgggataacatgaatttagttaaaacaagatagcctattggctcttatgcttggcccaactcccaattctcaaataaggtcaacttaggttctgttctgctggggtgggggaaagg

SEQ ID NO: 202602 - DNA, 529 bp, Homo sapiens
agctcactgaaacctccaccttccgggttcaagcaattctcatgcctcagcctcccaagtagctgggattataggtgtgcaccaccatgcccagctaagttttgtattctgtagagatgggatttcaccatgttggccaggctggtctcaaactcctgacctcaagtgatctgcccgccttggcctctcaaagtgctggatttacaggcgtgaggcactgtgcccagccacattgagtgttctaagggaagccaaatcttactctcttctgagcctcagtttcccacttgtgactttaagccagggggctctggaaggatggttcttctcttttcaaaggacacaaatttcagaaggcctcctgaaagaacagtgcaacactgattatgaaatgctccattggaaaaagactttccagacagaaactagaatggtgattgccaggaccttgtgggaggggaaaggggagcagttatttaatgagtgtagagtttcagttttgcaagatgaaatgagttccatggatgaa

SEQ ID NO: 202603 - DNA, 311 bp, Homo sapiens
acagctgtataaatctgggcaattattctcctacaccttagtttcctacaaaaaaatgtgcctccttcacaaggttgttgtgggaatcaaatgaatttggatttgcgaagtgctcaaacaatgcctggcacagcatgagcactggccacgggcatatcttctctagggaggagtatctgtgaatgtggttttctgtgaatgtgaagcaaatttaagtaatgaatcattgcttccttttggcagcatggtgcaggaatctaaaatatttttgttaaagtttctttatatttcttcaaagttttgatatcact

SEQ ID NO: 202604 - DNA, 426 bp, Homo sapiens
gattctctcagtttcaccttggggaggaaacacttaggggtctgtggacagaattcaaggagttcgtgaatttagatagaaaataattacccctttacttcctcttactttcactggaagtggaacattttcttccatgatgattggaggtggcaaaccgcagaatcagtgacccccattaccaacagaaatcacatatagttcacagatatcatgcaaagtcttttaagcttaatactcccatgaaatcccaagacttatccaacccatcgctgggacttgttgttgatgtgttatgaagaatcacatctcttaaacgacatcacaactccttaaaaaaaaattctgggctggtcacagtggctcatgcctataatcccagtgactctggaggctggggtgggaggatcactagaggccagtagc

SEQ ID NO: 202605 - DNA, 676 bp, Homo sapiens
ctgtcataccccaatggaatcccatgtgaaggctttggctgtggaaaagcagaaaaccttatagaaaaaaaggatattttaataagctggctaatcctctctagccatacctctttcaaatggattttaaaatcaccatgtaattatagatggagtccaagtcagagcaggaatgtgaaatgcctgcaagatgctccatataggcatactctccaggaggctgtaaaagaagcacagtttcaacttttggagaactttgaaaagcaatatcacagtcagtttttctgtgggttaccacagtctttcaactcatgctaaaggaaggagcattcagccctgactgagaactcatgagttagaaaaactgatatcagaaaccaaaaagcagcaaaatatgtcagagaaagtgacaattcaagccacttgcttcttgtagatatctacaacaaagaaaatatgtttgtggcatctcataaaaacaccagctaacttaacattgctggcaagccaaaaagaaaatatacctgagggtgtgctaacataaactaaaaaaaaaaaaaaaaaaaagaggaacaggaggatgctttaaatacactgacatgattttccttgtgttagctttcaagggcattattggaagctcatattaccaataaatacattattggtcttgttt

SEQ ID NO: 202606 - DNA, 314 bp, Homo sapiens
cccccaatgggatcccccccatagtctctttcacacactggtgttatgccaattgtgaatcttgtttccttgccaatttgactttatactaccgtggtcagtggtgaagggaataatgccagttaccaattctgcatttggcaagccaaaaagaaaatatacctgagggtgtgctaacataaactaaaaaaaaaaaaaaaaaaaagaggaacaggaggatgctttaaatacactgacatgattttccttgtgttagctttcaagggcattattggaagctcatattaccaataaatacattattggtcttgttt

SEQ ID NO: 202607 - DNA, 454 bp, Homo sapiens
acccactcatgtcttcaaaaatactttgctctcaaataataaagacaatttctctcatatgttaattgagagatctccgtatgaaaatattattatgaaattgtactgaataattcagaaattgttctcatggtatcttctttggatgctggcagtattattttattaaatcaatttaatactggatgtagaacaattcagctgtaaaatgctgagaaaaatcttttatattcactctattcctcccgtgagatgtaagagtgttcaactgttttcaacgtcagttaaaactactctggcccgtaagcataaatatgcaaggcaatacagatcatgtgacagtttgcattcttggcttgtactcagagaataatggctgaggtagaatattgctctaaacccacctgatacgtatgagtttataaaggagaaagtgcatatctgatatgtatga

SEQ ID NO: 202608 - DNA, 523 bp, Homo sapiens
gcaccctcactttgtctcatcaaacactgtcttgtgaatggaggaggcaaaaagagagaggggaaagtgagagagggggatggaaagactagtgttggaaggactaaaatagacaaaccaaacaaagacatgtagctgccacatgacaaactcacccatcagaccagatttcatccaaaacacccccagaggaaatggcctcagaacacagtgacaagagaggtgggcagattttaggtggtggggtggcttccgcaaggcaggggatgccgtgccttgagtacttgactgcccacagctgcatcttatgcctgggcatttttgtaagaagtgggaccacggctgcggtccctaaaggagggctggaatgccttgaaggagggctgactggcctataaagcccatcacatgtatctcctggagcactggacgtgtctcaacctccccaagcacttaacacttaacaaattactcctgatcaccaatacctagcagatgaagcataaccccaggccagcagggc

SEQ ID NO: 202609 - DNA, 100 bp, Homo sapiens
ataaattatctcttacaggcatacaaacataacggaaagacgttctgagggaataaacatgatgattagataaaagatgagaagttggcctatataactg

SEQ ID NO: 202610 - DNA, 284 bp, Homo sapiens
tgaggcagcctctctattcttggggaatttaaatctcagcagggaaagacagtaaataagaaagcaagtgaataagaaaataaggtaaggcataagttataagaagaaattaattaaattaaaccaggaaaatgatatatacaggatgctccagtggattagatggtcagtgacatgctttctgaagaggcaacagttggactgagagctgaatcatgaggaatggagagggcagctagtgcagaagctacaatgagtttgatgcagttcaagggcctgctggg

SEQ ID NO: 202611 - DNA, 283 bp, Homo sapiens
tgatggggaataaggaaaagggcacagatggcaacgccaggagaactcgcgggcccgagcagagctccagaggcgaacactgaaagacctgcagagacagttcctgaaaaagagctgccagaaatgatgcttaaaatccagagcagaatgcgcagactgaagatcaacatttttttgggggaggggggagggggacgaagtctcgttctgtcgccaggctggggtgcagtggtgcgatctcagctcactgcaacctctgcctcccgggttcaagcgattctcc

SEQ ID NO: 202612 - DNA, 257 bp, Homo sapiens
aggatcgcttgagcccaggatgcggagattgcagtgagctgagatcgtgccactgcactccagtgtgggtgacagagcaagagcctgtctctttaaaacaaaacaaaaatgctacctttggggagaaactttgaggctatgctaatatcccacatcccgcttttcctcaaacttccacccactaattttaccatccattggtggccgggtcttgtctacagcagttactgctgtgctgtttccctgatggcagtttt

SEQ ID NO: 202613 - DNA, 582 bp, Homo sapiens
tattagaaaatgccccttaaatacttcagttttattcctaatgctttaaatatgtttgttcttggcttagaaatattttccttagcactgttactcttttctaaataaaaaccttggaaagaaaaaaatgagtttttttttctctctaaatggttttagccctaaaacagtgtttctcagcttttaaaatccatttccaaaaatgaacaaactctctcatgtcaacagctatactatttgaaattctaaataaaccaaacaccaggactgaaaacaagataaagaactgtgacagccgggcacggtggctcattgcctgtcatcccagcactttgggaggctgagttgggttactctaatctggagactcttagttgatggttgctctaatctggagactcctagttgatggttaatctggagactcctagttgatggttgctctaatctggagactcctagttgatggttgctctaatctggagactcctagttgatggttactctaatctggagacgcctagttgatggttactctaatctggagactcttagttgatggttgctctaatctggagactc

SEQ ID NO: 202614 - DNA, 231 bp, Homo sapiens
atgaatagagttcattaaatttaagagagagaattttaaaggagaaaggaatgataaactgtattaaatgcaggtaaggtcaagtaaagttaggctagagaagcaacgactaaattgagcaagatgaaactgctgatgacctttacaagatgggtttcaatggcatggataaaacaaatgctccatggaagtgaagtaaggagaaaaataggataagacaaagtagagaca

SEQ ID NO: 202615 - DNA, 343 bp, Homo sapiens
tactcctgacctcatgtgatccccctgcctcggcctccccaagtgctgggattacagttgtgagccaccatgcccggtccctaattttggtgtttttagtagagatgggggtttgccatgttggccaggcagctcttgaactcttagtctcaggtgatctgcccgccttggcctcccaaagttccgggattacaggaatgagccaccatgcccagccttgaaacagaaagttttctaagaggcattcccgttctaaaattctatgatgttaagtcatagctttaagtttactaaaaaccgattagctctttataattgtaagcactagaggaggaaaatgata

SEQ ID NO: 202616 - DNA, 348 bp, Homo sapiens
cgaccttggcctcccgaggaactgggattacagatgtgagccactgcatcctgccagaaatggtgaattttgaatttgaattcagctcttcctcaattcatagcccacattctttctagcatctacttccaaagatagcctagagagtattttttatcttctatagctgtaaaccttgatatgggcattctctgatggcctgtgtgttttgaaaagattaatggataaggcagtggatttcactgctaaccttgctacaccgtagctgtgtaaccttgggtaaggcagtttctttatctgtaaaagaatggaaagatcacctaaataaagtactcagtaaacactcaa

SEQ ID NO: 202617 - DNA, 482 bp, Homo sapiens
gaagaattttgtttcatttcagttgtgggtttttctacccaatataggtcagctggatctcacaagctattgtggcttctaaggcatagcctgtcgattctaaggaaatttgtattgttctcctccatcagagaaaggggagagtttcttgggggagaggaagcaagaattgctaagactggttaaggaaatgtctactccagagtttagctctcccatgcctttgggggacagagaattctataaagatcatgaggcttcccagagctttccatctttttaaatgaggaatttgttaaaaatcatccataatttagtaatatgttgctttaagatggcaatattttaaaataaataactccatagtaatcaataagccttctattcttttaattgttatttgctagaagcttttgctggacttgctccatggatcacaatttattatttgtttggtgtatgaaaatagtccattagaaatt

SEQ ID NO: 202618 - DNA, 307 bp, Homo sapiens
acttttttcagatcgactgtgggtttagttttagttgtctgaaaatcacttccaccactgattattctaagatgacattgttgatcttgaatgatacagttaccgggagcaatgaactaagtaaactctcactgtagagttcagaagggtgttgagttagggtgagtttccaggatacaaaatctggttagctcattggctgatttataaggggcttattagcctatgggagtaagttcttcattggtggtggtaaagggcacagggttgggaataagggttgttggggtttaaatcctggctttgc

SEQ ID NO: 202619 - DNA, 828 bp, Homo sapiens
ccagcctgctctgggctcttgttacaggtgaatgtcactcactggcagctctccctgctccccccagcacaggggtgaaagtgggcagtaattctgggataagggacactttgaggcaaggtaatcccctcctgccagtccctggaggagaggaggggagtgtgcctctgaggctccccagcagggcgggcacgctttctcttcctgtcctgttctccaagcctccttgtgggaaaagtccatcagcccttagggagggccgggcatcacctggagctggcgctagggagagaggccaaggcagtcaatgaagagccttggtgggcccagtgctgaaggaacggtggaatattctggtcatgagtcagtcaaaaatggccaagctccaggcctggcggtagccttgggggtctatgtgtagaagagagggtggacatgcctgggccagttctggataaaggcaggggatggggaaagccatctggggcaaccactgtccccctggcatgggattaatgccacttagaggtggaaaagaggcagcagctgccatatcccaggaaagtcactgacctttagaacaggagacagaaatagccctggagagttcagaatcctgtgtgagagaggtggccaggccaggcagggcaggccccaacatgaggaggggaggagaaccatgttagtacccactgtgtcagacatgatgcccggcatttcacaggccttcctcacttactttccacctccagccagcagggtatgcatgattgtctccattttatggatgaggaaactgaggctcagagaggcgtggccaaacttgtc

SEQ ID NO: 202620 - DNA, 169 bp, Homo sapiens
gggaaaatgagatatcccttatggaggctcagaaatctgtttttgttagagactcccagaattttgtaagagtcatcaatcagctcccatgtacgtctgaaagtcctttatcgcatccctgagtaagggccacccattccttccttaacactctctagaaatggggatc

SEQ ID NO: 202621 - DNA, 538 bp, Homo sapiens
caagcagttaatccagactcaagcagtcaagcaaaaaattaaaagacagtggatatgttagattaagtaaatgggagtccaagatggactgatctcaggcatgcgtggatctagaaccctgatgatgatgtcaagggtcttcttctgctgtgtgggctggctctgtttccacctgccatggcttcattctcaagcaggcttctgttgtgtgcttatagcctcagggcaacgtcatcacggctcactgtctgaaaggaagatagactccttctcaccagttatatggtaaatttcagaggtgactctgtgttcctccttatgtcagtttttcatcccttaatgtatcacggtagccaggagtcagggggatggcaaacttgattgtctggatcctgggttatgtgctcatttcttgaaggaggtcactgtggttatgagttgtcggggagtagtggcttttaacatttttggcacatttcctttcagtcttatgtgtgtgtgtgtgtgtgtgtgtgtgtgtgtgtgtgtgtgtgtgtgt

SEQ ID NO: 202622 - DNA, 669 bp, Homo sapiens
ttaatgaactaagctcacaattgtgtgaccattgaggtgatcatccctctttaatcaaaacttacatttttgtagcagcagaacgatgaatattgaatgctcaaaaagcattcagacttcctgcttctgtacaccttttggctacagattgttttgttttgttttgttttgtttttttgagtggttacattgttttgtgctaacatctcagaatttggttttgcaattcatgttgattctgccataatggcattgtaaatcctggatcctccttcacattcagttcaatcctttgcatgagaaaagagttcttgtacctagaacttaattttttttctagtttcccaagtccctttaagcaaattacttatgaagatattctaattaatgtctctctgagtgagaggtttatgcacctctaggaagatggtaaacaattcattcttaccagcaagattagagccattcattctgtagacaaatacctccatcaagtggatatagattctttgctttcctactgataagaaaactaagaagccagtggtgcccatacctgccagacaagctcagaaggacaaaggagtcttaagtatctaaagtacatcatcaggcctgctgtaaacatgtgctaattaaagagtattaaaaatatagtgaaaatataaa

SEQ ID NO: 202623 - DNA, 120 bp, Homo sapiens
cctgggataatgttattgataaacttttttggtaaaagttaagaaaaaaagtggtgattacatctttccttcagtatgaaaagttcccccctttagttaattatcatggtggtggtggtg

SEQ ID NO: 202624 - DNA, 210 bp, Homo sapiens
ggaatttttataaaggaaataagatagcttcttaccagtttattgtaatacatgtaatatgttagatatgtcgaatgcaattactatcagatgaacagttcttttcctactctttcatgaatctgttttagagcagtcacttaatgtttgtcgtttttcatttccttattaaaactgaaataaatgaaatgacctgagaatccttctaac

SEQ ID NO: 202625 - DNA, 420 bp, Homo sapiens
gcaaggatccacgggagaagcatgatttcctgggcagggtcatacaatcacttactgcttcatacagtcactacctggctggggtgggggttcctttgcctctgtgctgctcccaagtaggctatctgttgccccaccctgcttttcttcgttcttcgtgggttgtttgcctagtcagtcccagtgcaagaacctggatatttcagttgaaggtgctgactgaattcacttgctcctttcattcctctctgtaagtgccttggaccgcagttgcatctaatcggccgtcttggccctgacccactaattttcttagtgtgttttttgttgaacagagatttttattttgatgaagtccaaacttatcaggttttatgtttttgtttgtttgtttcttggctagtcctttttctgtcctgt

SEQ ID NO: 202626 - DNA, 414 bp, Homo sapiens
ctgggtgacaggcacttcgtccctcctccagcctggggttgggagacagacctgtggccctcttccaggaggcagtcgcctgggctgaggtctcaccaggagagaggctgcagggctggacttctgagctctgtgctgagaactgtaggctgcagcagtagaggctatgtaggagcatgacctggggaggcttcaaaactgccttgcagacaagatccatcagcccctaaggagaagtccgggcagatagctgcattccccaggtccctcctaatggatatgttgaatctggttgcctgcaacattaggaatttcaggacgtccttcagaaaaccctgtagtaccttccatgccacactgtcatctcagaattcctgttacgacagctgtttcataaaggttagcaacttgttt

SEQ ID NO: 202627 - DNA, 406 bp, Homo sapiens
tggaggacagcgatggagagggagacggaagactattgtaggttggtagttttgtccttgtctagattgactgtccctgggcaagatattgcagctgtctttgtgacaaggacatttcatctaaattggagtcactttttgagtcaagagtgatcaaatgtaagtgctttgaaaagtgcatagtaccttgtatgtgtcaggtttcagcatcctgttaccatggagctcccctctcctgtgattaacgtcactccagtcacaagtggttttaggcctggagtctgaggttcctctagtgctggtttcctgtgtttaattcatatccatcgattaactctttttctgctccgtaaaccactcacaagctcacgagaaagggcggctggtatgctggtgttagcagtga

SEQ ID NO: 202628 - DNA, 1457 bp, Homo sapiens
gcctgcctattatctgttccactggagtgtaatcacttgagagcaggaatctgatccataatccatgtattctactctccttatggccaggcagtacctggcagctgagcagcataaacatttgtggaatgaatgagtgaatgaatgaaccaatcaagatggcatccttcttggtgtgggtaggtaccttccaattggatatggctcagggaagatacgagaatttaccggaagccttgaacagttctggggaacaatggagacacactgtggcttcccaaagggaagagcgagaggtgatcagacagccagttctcattcttgcaaaacttgacaagcaatgacttgaaagaggaggatgggaggtaagtaatgagaccaacccatgctgtgctgagtgaggtgagagtcagagctcaggtggctgattaagaccccgagcactcagaatgcagaaggctgcaaagagggtcaccagcccatcagcggccaccaaaggctgtaccaagtccacctggaacctagccacaagggatggtgatcatgatccatgtgaggcaagatagtttactggttacagtggtcactggcctattttcaattccttcaccggcccttaccggctgtgtgaccttgatcacttgcttaacctctctgtgcctcagtttctgcatctattaaaaaaaaatgcctggctctttgtgcctggctggaggccacttagcctagaattttggaatcccagggtttaactcctggcactgaatacccttgttggaaggtagagaatgggatgtcacctctggggtactagagtatggccaaatgctgttaaccaggcagtcagtctttggaagaaaatactctgcttttacatcccctggtggtagcagaaagttacacgtgtgaaaatatgcaggggctgctcctgtgtgtgttggggtgagggtgtagtggaggttaaaggtattttgttccagccaggcttgtaaaagaaaacaacattaaatgggcatgtgcagacaccccccccccccatgaaagtgtcttccttatctttgtctcctggttgtgtgttcgtgaatgcacaaccaccaaaaattgtggaccgcatctctgaccaagatccaaggaggaaaaataaatgagtccaagacaaagcaatttacagatattaattcccaaagaagagtaaagatgtttgctttttctctcagcttgttggttctcagcattctcattgtttaactattctaatggtttctgcctccttctttgtgttttcctaagagtcctttcttttcaaagttgggatgacttccagccctcacttgcccaatctgtcctgtcacctggctgttgggcttcatgtatgaaagtgaaaaccgaggagagtagagctatacggatgataacaatagtggagcttgatttagtgcctctctactcaggctttg

SEQ ID NO: 202629 - DNA, 1123 bp, Homo sapiens
gcctgcctattatctgttccactggagtgtaatcacttgagagcaggaatctgatccataatccatgtattctactctccttatggccaggcagtacctggcagctgagcagcataaacatttgtggaatgaatgagtgaatgaatgaaccaatcaagatggcatccttcttggtgtgggtaggtaccttccaattggatatggctcagggaagatacgagaatttaccggaagccttgaacagttctggggaacaatggagacacactgtggcttcccaaagggaagagcgagaggtgatcagacagccagttctcattcttgcaaaacttgacaagcaatgacttgaaagaggaggatgggaggtaagtaatgagaccaacccatgctgtgctgagtgaggtgagagtcagagctcaggtggctgattaagaccccgagcactcagaatgcagaaggctgcaaagagggtcaccagcccatcagcggccaccaaaggctgtaccaagtccacctggaacctagccacaagggatggtgatcatgatccatgtgaggcaagatagtttactggttacagtggtcactggcctattttcaattccttcaccggcccttaccggctgtgtgaccttgatcacttgcttaacctctctgtgcctcagtttctgcatctattaaaaaaaaatgcctggctctttgtgcctggctggaggccacttagcctagaattttggaatcccagggtttaactcctggcactgaatacccttgttggaaggtagagaatgggatgtcacctctggggtactagagtatggccaaatgctgttaaccaggcagtcagtctttggaagaaaatactctgcttttacatcccctggtggtagcagaaagttacacgtgtgaaaatatgcaggggctgctcctgtgtgtgttggggtgagggtgtagtggaggttaaaggtattttgttccagccaggcttgtaaaagaaaacaacattaaatgggcatgtgcagacaccccccccccccatgaaagtgtcttcctgagtctgaccttcctccccggtggtgccacctctttgattctgactggcttgaacctcgcgcctgtcagt

SEQ ID NO: 202630 - DNA, 667 bp, Homo sapiens
aaggaggaggggaaagctagagcctcgccccactcaaaagaagtaccataaagagccaaagaaatgaaagaagccatattcgtaccatcaaaagcaagaatgttgctgccttccaggagttaacctggacacgttagtgactttggtacctggcccgaattgataacgactgaattttagaaccaacatttttcaaatgtatttttgatgaaatgcctacttctccctacacacacacacacacacacacacaacacacacacacctatctccaggcagatgcacacaggtgtccttggagctctactccctgaagccaaatgtcagtaagatcctgcggatttccagatgaaggaagcctcttgtctccccccacttttttcagtcggcctgctagcttccacacacaagcccctctcgcaagacaaccacctggctgaaatttagccaggtgtcaaatgtatccatctcattttcacgtgcaataatgtgcctttctgatcaatcttcacatccttgcatccattccttcctccctgctactcaagaagcaagaaaggagcacacacatcctcccaggcagtccagaggaaaggcaggcgtgacaaagaacacagacacagtctaatgacaatttagcctgtcttctattccttgactttcttgt

SEQ ID NO: 202631 - DNA, 652 bp, Homo sapiens
ctcacaaatttgtgttttattcaaagggagagggatttgatgtcttctgaaagtgttgattttagtgataagtacaagatagtgggtaagtgaggaagcaggagatacaacaagtgtcttgagggtatgacaagtaatcaacagatacttagtaagcatctgtcacatactcagtttagcaatgaaagatattcagttcctgcccacatagagcttacattttgctgttggagtggggaaaaaaaaccagacattaaataattaccattctaaatacgtctaaattattgcaaataaatattgcaaagagatatgggactcataatagggggcgagaggttagagaataccctcaacactgaaaaaagtggcattaaagctgtgacactaatatgggagataggagggctgaggtggagtgctgtcttctttcgtatgatccatcatttaagaaataggctgggtgcagtggctcatgggagtgctgtcttctttcgtatgatccatcatttaagaaataggctgggtgcagtggctcatgcctgtaatcccagcagtgtgggaggccgaggtgggaggattgctggagcccagaagtttgagagcagccagggcaatatagcgagacccggtctccattttttttttctta

SEQ ID NO: 202632 - DNA, 223 bp, Homo sapiens
gaatgtcccatgggcattctaatggtaacattgtctccatcccatctgttctcatcgcctgtatttttaatcttgggtaaccatctccttttcctcaagtcacctagaccagaatcatgagagttatcgtcactctcatgtccaggtactcaccaagtcctatcagttccttatcctaagtatatatgctatcaatccttccaaactctatcactattaaagt

SEQ ID NO: 202633 - DNA, 108 bp, Homo sapiens
gacacttcctttaaaaactacacgccaatgcccaataatgctcagccttggaaaacagtgagtgtctaatcaagccatttaaagcagggagaagattttaattggttg

SEQ ID NO: 202634 - DNA, 809 bp, Homo sapiens
acacgccaacctgaagaggtccatttctatgtagcaggcacacattttcactgtcattcttctctctattctcatagtttcattctaagtttgtcatgacatcatcttactttcttgtatcataggtatctgaagtctcatccattcgtctggacagaaagacctggaagggcctagaacagatgtcgcattcatctctctaacccccagaataatgaattctctatcagtttccatcacaatacatacttgatgatatgaaaaaccatagacacacacaatttcccaaactaaaatggctgtagatctatgactctcctgctcaagaaaccatagagaacacaaattcattaaagctaaaatactataggcattacactaaatcttaactggttaatttaaaagtaaataatttgcaaaaactattatagtcatcatgctaaatcttaactagttaatttataagtaaatcatctgttaatttttgatacttcagtgacaattcattcgttttataactaacaacaaacacagcaagatttcatgggttagaatcactgatctggatcctgtggcaaagtgtcccacttctaccaggtatttagtaaaaagaacttaactgaatggacctgtacttctatttgtttttctctcttgtttattctgtgcttcttgtagagtatcaaccaatgagacagcttagaatagggtctgaggctgaagcaggagatcacttgagaccaggagttagaggctgcagtgacctaagatcataccactgtactacagcgtgggcaaaagagtgagac

SEQ ID NO: 202635 - DNA, 312 bp, Homo sapiens
ttaataaatattgtgtggtgacgataaaaatattgctgcatcctagcaggaacatatccttattccatgcatacagaaatttctaacctgtgacatttatgaccatgcctggcaataccgcattaaagatagcttctaataggatgtgccagtttggatgaatgaccattttggcatttcactaaataactttgttctggatttgtattcagcaatcctctctcaaatgcctctccctgtgggcccatttttcagatctcattcttgctctctccttttatctggccaaaaaatatcaaggtcgtgtcacgg

SEQ ID NO: 202636 - DNA, 551 bp, Homo sapiens
ggcagaaaactctgagtcctcagagtgtgaaaggaagagaaactgcctctgggatatgcactcccactggggaacctggcaatccaggccacggggaagaccttaaccctacccagtgctggagctgatttaatgagctgaggggagtatatgagaaggagcagcttcaggatgtgctttgcttgcactcctagactctactggggacagagggaagccattcctgatcctacctcacagaggaccatgcagaagtcagccaactagctcaggcggtggccatgggctgagaggagtgagaagctcccaactgagattcacaatataatctctagcagggatggacctccttgaccagaactgaggggcaagtgggaagtgcgctgtgcccacaggtgtaggagtgtcttggcagccagagaaggcttatggtctgggacagttttgagtgctgaatgcagcctgcttgcaacctagatggccgctgccagtagaacactgtgggtctgagacctgtcttgccaagtgcataggggctgagtggggcttac

SEQ ID NO: 202637 - DNA, 538 bp, Homo sapiens
caaccatatttatgggggttagtattgattgttcgcggtgtggtagggtgtgttattattctcttttgggagagggtgatatggtttggctccgcgtccacacccaaatctcatctcaaattgtaatccccaagtgtagagggagtgaggtgattggatcacgggggtggtttcccccatgctgtcctcatgatagtgactgagtcttatgagatctgatggttttagaagcacctggcattccccctgctggcactcactctgtcctgccgccctgtgaagaagtgccttctgccatgactgtaagtttcctgaggcctccccagccacgaaggactgtcagtcaattaaacctcttttctttataagtcacccagtctcagatatttcttcataccagcgtgagaacggactaatgccgagggggtacccaatgcagagacctcatcttacaccaaatcatcagttgcatttaatgacccaggactgatgagagaatcgtgagagagaaaacactttagggaggacctggaggggc

SEQ ID NO: 202638 - DNA, 688 bp, Homo sapiens
ctgaaatgtatattcatgctctttgacaatgtgaagtctgaggacggagaggacagagaaccggggcgccagatgtcaagtatcagagcccatgtgacaagagagaaataatactgtgctactgaccaaacacggtgtttccagtgtggtgagaaagggttctggcctccccttgtgagcttactggcctctctcttaaaacccatgatggccagctgtttcctgtgcagagtgattgggtggacagaatgggtgaaataattcttcatacatatgtccccatatgtaacatgtccatgtgttttctcccaccttcccttccataagtattaatatttattgagtgtttactgcatgtgggatcaaggtctagaagttgcagatacagtagaaaacaaaacagacaaagtccttacattcatggggctagaatactgtggggaaggcagacaatggatgagctaacgaataaaaatttcagcttgagattaaaaaaagaaaacctaggctaacaacaagtatttgggtaggaatggaagttgggggagacattatagacctctggagattccatacatgtcaaaatgggactgagcaattgaaggagtcacccagtcaaagacttgggcaaggacaacccaggcagaagcaacggcaagtgtgagtcactgaggtaggaggaaggttg

SEQ ID NO: 202639 - DNA, 138 bp, Homo sapiens
tttacgctatctaaaaaactaaaacctacccaaagaaattaccaaaaggtttttttgtgtgtgtttttctttcgtttgtttgtttttttgagacagtcttgctctgtttcccaggctggagtacagtgatgcgatctc

SEQ ID NO: 202640 - DNA, 269 bp, Homo sapiens
tgagaaacccaactgtgcagccattaaaaagcacggttataaagtctgtacaacagtatgaaaagaaatgctcatgaggtaatgttaaaggaattgtgaaattacggaaaaactatacacttgaaaagagacttaaagtataaggtaccaaaaagataaggattgtatctagttgtattagagtgatggaatagaagtctgttttctatattcttacatttcttgatgtgattatactccttttataattacatttttaaaaaatcgtc

SEQ ID NO: 202641 - DNA, 485 bp, Homo sapiens
taagcaatgggaatgtcaaactatttcatataatagcttatatttcagaaagttactgctttataacattgtggaatctattttttatgttggtatgtggggatactagttttacttgccttatacgttgtccataatctattatccatagtttgtttttactatatacttaataagaggctgtgtcttaaagtgatcctgctatattaataatgactcctagtttcctcagtctttttggcaaggttggggagaggaaactattacatattattaaaaagtttaagatctatggttttcaagtttaagatctgtagttattatgttttatgtaagaaactgtaaaatataatagaattagaaaattataatcttcaagtggagaaggatataatattcctgtagttgtagaaattataaaagattgctaaatttgactaagtaaaaaaaaatttttttaaagattctgcgtgacaaaaaaaaaa

SEQ ID NO: 202642 - DNA, 234 bp, Homo sapiens
ctctctgcctttctgggtatggcccagactcatacaagcctgttagtgcaagatctcatcactggaggcgaaactcacgagacatcctcaccatggcacaggcctgaggttttcaaggttgtgctgggcgggggtaagaatctgatgagggagcccatccctgccttatgagaacagctccaagttcctgacctatgccagtgccttccctataactttctttttcttcttttt

SEQ ID NO: 202643 - DNA, 472 bp, Homo sapiens
aatccgcccccctccccgccccagttggtgtttcaaaccctgagacttggccttggaattcatggggtgatgaggaccccacagccagaggtgccaggcgttccctgccccaaccccagagcaggaggccatcattaaggcaggccagccaggtggcttttcagtgccagccgtagctgaatatattaggcagggagacaggcaagggtttgtatgagacccacagaaggaacagggaatatgctggtctgggttcaagtcccggttttgctggttagccgtgtgcctctgggcaagtttattcctctgaggcttagttttcccatctgtaagatgggcatagaagtggtcactactggctgggcacagtggctcacgcctgtaatcccagcacttggggaggccaaggcaggtggatcacctgaggccagaagtttgagaccagcctggccaacatggtgaaacgctgttt

SEQ ID NO: 202644 - DNA, 462 bp, Homo sapiens
tgggggatttaggctgtgtctgtttttgtatgcataattttagtgttttaaaatatatatgctatatataaaatatcaaatatccagctttattttaaaattttataacagttcttttcttgattgtaacaaatactttctaaaagtaatgtaattactctataatattgtatacgatgaattgttttaatttcttaatcatacctttgttagataagggtattccaatgtgtgatgttttaattaatagtctagtgagtaaagatgttttactgtgcaaaagatttaggataagctctatatgtttaggatacagttcttaaggtaaattgcagaagctgcattaatgggtcaaagatgggaatagttttaagactaagtggttttccacaagaattgtaccaatttacagctcatcagtgtgtttgagaatgcagttttcattttactgaagtgaacttt

SEQ ID NO: 202645 - DNA, 434 bp, Homo sapiens
atcaggagaccaagtaaagcagattctcctgtgtggtgggccttatccaatcaaatgaagaattgaatagaataaaagactgagtaataggaaatttatcctgcctatttgagttgggacatacatcagtcttttcctgccattggactcaaattgaaaaactgactcctcttgggtcttatgcttgccagcttttggattgaaacttacaccattggctgttgtggttctcaggcctttgcacttgtactgaaactgtactgtcagctctcctgggtatccagctaactagttgtagatcttgggacttcttagcctctattatcacatgagcttataataaatcaatctttcactgtctctctctcttgctctctctctctgccctcatcttcatccatcacattggttttgttttctctagttccttttcc

SEQ ID NO: 202646 - DNA, 399 bp, Homo sapiens
gctccctgacacccccatacaccctctgtgcctctctacttacagagcaattcataacgttagaattttttaaaatttggataaactttttaaaagattctcatcactaagacaagttttagaaatagtattcaaattgatcataaatcttaatttgaaaatattatagtgttctccctttcccctaaggttagagcaggattcaggaataaacatttttcatgactttttaaaacattttatataaggagaattttaaacatacacaaaactagaaaaaatagtatacacactcctcttgtacacatcacccagcctcaacaatcactagtccctggccagaccctgccctatccataccccgtccactttcttcctgtattgtttgaagcaagccct

SEQ ID NO: 202647 - DNA, 443 bp, Homo sapiens
ttcctcattcacataacttgccagaaaagatatagagagattgctgcatacctggatgacttcaaggtagtaaagctataacttttgaggggttataatttccaacacactctctcactgagtctaaactttttcatctaattttcttttgtttgcatgttgaggtgcatttggcagagggctgaatttttcacatataaaaacatatatgaaacatttttcaatacaagtcaaatataataaacacacattttcttgaggatagacatcatcctttatcacttccctctgtaaaaccaccatcaaacccaaccaagactgaatgacagaactagaaacatttaacaacggcatcatcatgccttaagcttagtacacaaaatagcgttgtgtttaagggttgaaacgctttctatgttgtaagttttccaagaggtacaagt

SEQ ID NO: 202648 - DNA, 522 bp, Homo sapiens
gtatcgttatcctcatcttgtttctttgagacattcgtctccaaaaataaataaatcaataaaataaagtgcagtagaagacagtgtccttattgttgtaggtgaggtggtagattttgtatctgagccaccatccctgctgaaattgccccggacaggctgatctggtacaggtggcacctgggaagtggcagcctcgcttccgctggccagttccctggttcagggttgccggcctcccagatccacacctgtggtccagactctgctgtctggctgcccgttggatcttctgacagggatggccatgagtcttctcagtccagacatgtctccacctggacttagggtctgttcccccggaaccagctcccccttcctgtccatcgctcagccctccaagcccagaggaccctgctgtggccgcattttcagtcaactctcccatcgccagactttgcccttggttcccaccatggtcacctttgacaaagcacggaggggcggtttgccccgttccac

SEQ ID NO: 202649 - DNA, 605 bp, Homo sapiens
aaccggtccggcgttacggacgctcatctgtttctttgagacagttcctctgtcacccaggttgcagtgagctgagatcccaccactgcactccagcctgggtgacagattgagacttcgtctccaaaaataaataaatcaataaaataaagtgcagtagaagacagtgtccttattgttgtaggtgaggtggtagattttgtatctgagccaccatccctgctgaaattgccccggacaggctgatctggtacaggtggcacctgggaagtggcagcctcgcttccgctggccagttccctggttcagggttgccggcctcccagatccacacctgtggtccagactctgctgtctggctgcccgttggatcttctgacagggatggccatgagtcttctcagtccagacatgtctccacctggacttagggtctgttcccccggaaccagctcccccttcctgtccatcgctcagccctccaagcccagaggaccctgctgtggccgcattttcagtcaactctcccatcgccagactttgcccttggttcccaccatggtcacctttgacaaagcacggaggggcggtttgccccgttccac

SEQ ID NO: 202650 - DNA, 711 bp, Homo sapiens
catcaatctgtgtatctgttaagtcttaatgagcagccaaccaaacccaggggtgtggccctgcttcttcagtgggttatgtgatttgagctgttttctcagcaaatgatgagctaaccaatacgggcccagtttttggctagtgagattgaggattgggctttaaggtgcatggtggtgaagtctgcagttcacacggaaatcagagcacattaactgctgggtgatctcaagcctaaatttcttatggagctgctccaaccaactgagccttgtggttattttactttgtgcaagaagtaacagtgaggcagagaaagagaggtgataaaagaaagattgggacttaaagcaagatatttcagatagtatgtttgtttttgtcacttactcttaggtaatagacaacggagtgaagttcaaaggcaactatgttgtgggtgactccatcatgaaagcagctcttttgtaaatcttcaacaaatgtaagctccctgagggtgaccaagataatcttgttgtttttgtatccctggctcttagcataacccctgacttactttctgattgaatgatgtttatccaaatgactgctgtgcaagggaaaactgtatttctttaaagaagtttctcattgcatctttgatcttaaggtaggctatccatcattttgaagttcattcttggtgcaactggttatttcctttattt

SEQ ID NO: 202651 - DNA, 455 bp, Homo sapiens
ggacaaagtcccctctactttctgcggctgtcactgaaatgtcagcagtggagggaaaaccagaagagaaaacctctcactgacaggcgccctcagtgtgcaaagagctcaagtttcagtgctggggtggggtgggggctgcgcccctgcctattcaccccactcctcccctgggctgctccactcccatgatgactgggaatttatcctacaacaggccacgagctccttgttctgcagtaggaaattatccttcataagagggcaactgttagtattgtttgtttgttttttaatttccaaaagtaaggagaagtttattaaataagagcgggggaagggaggagggagaaggagagggaaagggcccgagaggcagctgaccccagcatttcccgtctccccttggcttctcccatcccccttgtcccagacccccctccttctggttctga

SEQ ID NO: 202652 - DNA, 547 bp, Homo sapiens
caaaaaatagaccaatgggattacatcaaactgaaaagcttttgtacttaaaaaggaaacaacaaaatgaagagaaaatctacagaatggaagaaaatataagcaaactatacatctcacaaggagttaatatctgaagaatatataataacttaattcaacaatgaaaaacaaattatcttaatttaaaagtgggcaaaagaccttaataggcatttctcaaaagaagacatacaaatggccaacaggtacatgaaaaaatgctcaacatccctaatcatcaggcaaatgcaaatcaaaatcacaatgagatatcatctcactctagttagaatggctattaacaaacagacaggctgcgtggtggctcatgcctgtaatcccagcactttgggaggctgaggcatcacagtacttgattgcaaaatgtactacaaggctatagtaaccaaaacagcatggtattggcataaacacaaacacagagaccaatgaaagagaataaagaacccagaaataaattcatgcatctatggccaactgtttt

SEQ ID NO: 202653 - DNA, 456 bp, Homo sapiens
actctggaggctgaggcaggagaatcgcttgaacctgggagacggaggttgcagtgtgagccgatatcgtgccactgcattccagcctgggcaacgagcgaaactcggtctcaaaaaaacccaacttacattatccgcagacacattacatacaaaagtaaccattttctttcaatgggaaaggaggtttagaagctagagattcaaagttaccaggagttactttttcccactaggaattcactacagtcctgacattggactctaggtagtttctactgagggtaagtgactcgtccctcttctgggcaactctttttcttactgccctcagcagctatttcaggcctccaccccttccctcccagccaggacgtcctcttcacagaaaatggaaacctcctggtttcttaagtagttgtgaggctgaacctgccttaatccctcccagttcag

SEQ ID NO: 202654 - DNA, 453 bp, Homo sapiens
agtctttcttaatctgtagcattttctcttctctcccttttttcatgtaatttgttgtggaagaaatggggtcatttgtcctgtgtcactttaatagttttctttcagttttgttcttctttgtgatcaaagatatgttttaaaagcaaaattaagatcatattgcgcatactgttttatgagctactttttatacttaacgattgaatgaggacatttttctattatttactcttcttcaattagtttttattttctgttaaatcttatggaataatagtaactaaaatgagaaagatgtagttgattatatttaaagtaaatctggccaggcatggtggctcacgcctgtaaccccagtgctttgggaggctgaggcaggaggattgcttgaggccaggggtttgagaccagcctgggcaacatagtgagacccccatctctacaaaaaaa

SEQ ID NO: 202655 - DNA, 448 bp, Homo sapiens
agtctttcttaatctgtagcattttctcttctctcccttttttcatgtaatttgttgtggaagaaatggggtcatttgtcctgtgtcactttaatagttttctttcagttttgttcttctttgtgatcaaagatatgttttaaaagcaaaattaagatcatattgcgcatactgttttatgagctactttttatacttaacgattgaatgaggacatttttctattatttactcttcttcaattagtttttattttctgttaaatcttatggaataatagtaactaaaatgagaaagatgtagttgattatatttaaagtaaatctggccaggcatggtggctcacgcctgtaaccccagtgctttggtagctctagccataagcatttgttatagtgatatgtgtctgtacccattgcggtctccagcgttccccctctatcctaaa

SEQ ID NO: 202656 - DNA, 201 bp, Homo sapiens
ttcaaaatatacacaattcaagactgattctctatatgaataaactacaagtagaacttgttttgtgtatgaagtgtggttttaatatcagtaatatttttatattgcactatttcaaatttgcgtaattcagaattgcatatggtgaggctgaattgtattaataaaactgattaaagtgaaactacttttttttaaatg

SEQ ID NO: 202657 - DNA, 654 bp, Homo sapiens
cacctctggggttcaagtgattctcctgcctcaacctcctgagtagctgggactacaggcgcatgccaccacactcagctaatttttgtatttttaatagagatggggtttcaccatgtgggccaggctgatcttgaactcctgacctcaggtgatccacctgctttggcctcccaaagtgctgagattacaggtgtgagccaccgcgcctggcctaattttaacaatacattttattttcatattcaagatcacaccactgtgtaagtagcggagctgggatttgaacccaggccactgactacagagtccttgctgtgaaccactacacagtagtgcttgatgaggatatatttgtggaatgatgaatgagttaactgaatgtgtcacacgtgcacatattcgagcccaagtgtatggagcatgtgagcatatgtgtccctatatgcactcaggtgtatgtgagcgctcctgtttgtgcctgtgtgtaccgagtgtgtatacaagttcgattgtgtgtgcttgtatctttcaggggaataagggtggctttgatccagcctaaattgggatgtttccagcccagggagggtttattgagtgtggggagaggtcatagcttctcaaggagctggtgggaagaccaggcccacc

SEQ ID NO: 202658 - DNA, 738 bp, Homo sapiens
tatcagttatcgcgactatagccagccattctgcaatcctgtcagtcacagctagtgaacttcatgtccatgctgtggcggctgaggaaggcccctcggcccagtgggggctccaggctgcctggtgtgggggatggcttcgcagattagcaccaggcactgcagcgggggctctgagtcagtgctcccagctggagaagtctgcgcaggtggcttgtaggccctcatatgtccagagcagttcagcaccttccaggtggccgccttgagattacaggtgtgagccaccgcgcctggcctaattttaacaatacattttattttcatattcaagatcacaccactgtgtaagtagcggagctgggatttgaacccaggccactgactacagagtccttgctgtgaaccactacacagtagtgcttgatgaggatatatttgtggaatgatgaatgagttaactgaatgtgtcacacgtgcacatattcgagcccaagtgtatggagcatgtgagcatatgtgtccctatatgcactcaggtgtatgtgagcgctcctgtttgtgcctgtgtgtaccgagtgtgtatacaagttcgattgtgtgtgcttgtatctttcaggggaataagggtggctttgatccagcctaaattgggatgtttccagcccagggagggtttattgagtgtggggagaggtcatagcttctcaaggagctggtgggaagaccaggcccacc

SEQ ID NO: 202659 - DNA, 393 bp, Homo sapiens
atcatctctaaatatcaaatcttacaagattatattgctgtcctcattatgtagtcacagaaagactaagtaattcagattacctatccattaagaggcagaacagaggccagatggagtggtttatttctgtaatcctagcactttgggagattgaggcatgagggtcacatgatcccaggaatttgagaccagcctgggcaacatagtgaagccctggctgtacaaaaaaaagctgagtatggtgatgcattcctgtagtcccagctacttgggaggatgatgtgaggattgcttgagcccaggaggtcaaggctgcagtgagctatgattgtgccactgtattccagcctggtccacagaggggagaccctatctattttaaaaattaaa

SEQ ID NO: 202660 - DNA, 438 bp, Homo sapiens
tgttaagtccatttttaggtgatactaacttcaagttcagtctcacctaactattagatatcttaaggaatacattgtatttatgtaaattagtaggggaaagtagagaaaagttggttcgtatctgcaaacgtgtatgtatatataagaaggaataaaatgcacatcgctgccacggttcttgtttctgtccctggttgtggagggtgttggcttaaagcctttactaagttccactccccctttgccagcccctcatctgttgggtggcctgaaccttcatttgtgagcgctctgagtcattagcagtcctgaggtccctgggttgtggtcatcttcaattagttttttcccaaggccagtttttctttttaatgaaaatgttctagggagtgatggaaaatgtgaaagctaaaataaataaataaataaataata

SEQ ID NO: 202661 - DNA, 496 bp, Homo sapiens
ataccaaagtcaactatattcttacacagcaacaaacggggaaattaaatttttctttaaagaaagtagtaccatttataagagcatgaaagacttagattatcacctagtaaaatacatgcaagatcgctatgctgaaaagcaaacactgataaaagaaatcaaagatgacctaaataaatggcgagatataccatatttatgaaagactaaacatatttaacaattctgcccccaaattaatgtccacattcaatttagtcctaatcaaaatcccagcaggattatttgtagaaatcaacaagctgatcctaaaatttataaggaaaaacaaaagacccacaatagacaacatagttttgaaaattttgttagaagatgcatactacctgatttccatacaagctacaataatcaaggcagcatatatatacgtgggcaatcaatttttttttttttttgagatggggtctcactctgtcacccaggctggagt

SEQ ID NO: 202662 - DNA, 200 bp, Homo sapiens
aagacaagtaaataaaaaagcctttctgaattcctgagattttcacatatcctaaatgtaggacttaggttcagttaatctagatataagaatgtgtataacattatttatttactatatcctggctagttctaaaaaggttgagcatttcatataaaagatttgtatttgtataggctgggcgtggtggctcacgcctg

SEQ ID NO: 202663 - DNA, 548 bp, Homo sapiens
tctagaggacccccaaagcagttaatacacacacacacacacacatatacgactacccacctcatagcaccattgtaagaatatataaaagtacctggcagaaggcacagtatattgcaggtattcaataaatcaacattttagactgaaaagtactaatacttttagattagtttcagaaaaagcttacctctatgtttagcatcaagaattacatatttttttaaaataaaactgtgtataataaagtaaaaacagagaacctagagtttgattaggaaagaaagatagtattttctatcatttaattatcctaagatttccaacaaatcattgtcctcttttaggcaagaatagtacactgagaaaacgatggttaaaaaaacaaacaaaccctataatgacttctacacctatttgtcaggttactgatagttctaactacattaccccataaattgtatttatttaatgcatggaaatttctaaaacaaggtggtgtttataataaaacgcacagattcaataaaactgagaaccattttaat

SEQ ID NO: 202664 - DNA, 327 bp, Homo sapiens
gtattactttctgcctggtgattctactcaagttttaatacttaagtaatatatgacctttctttctcattctttttcacttccttcttagaatttaccattccctcttttatgcttcctattgtattttgtcaaagacctgtaaaatattattgtactggttatcatgttaatctccttctgtcaaaaccacattcattcactgaagtagtacctaccttttagtgtttttgtgatgattaaatgagatagtttatgtaaagcttttggcacattgtctggctcaattatttcctgctattatagtggctattataacaactacag

SEQ ID NO: 202665 - DNA, 292 bp, Homo sapiens
ggggtgctcatgatctcatccagatcttcaggggtgcttgtgatctcatatagatcttcaggggtgctcatgatctcatgtcaaataccatctcttagatttgtttcctcaccagggctagtgaccagatgaggcctggcaaactcaagaaatacttgttgaatgaacgaatgatttcaactgtagactaaaataaccatcaaatgtcaattgaaagcattaaatgtacagggctgtggacaagatgggcaagttccccagacccatccacctctattttatttgataaatg

SEQ ID NO: 202666 - DNA, 363 bp, Homo sapiens
cagaaccatgtgatgcaccctgtgggcggccacctggggactcaggacatgcacccagatccctcctcccctacccacttcaaagaaagtgctgccctcccagtggtgatgaagaccttccgctggccccagcctctgggatctggcctttacttgggtattcatgtggccctgggggttggctttgctgaagttgggcagagcaggtgggttctggaatgtgcaggggcaaccagagtgtccatctgtttgggtgaagccagctgtttaggtctgaaggatctgtttgatttttagaaacatgatgtgttccagagttagtaggtggtggtgatggagggtattggcgtgaagagtgtggat

SEQ ID NO: 202667 - DNA, 383 bp, Homo sapiens
aactgtttcacctaccaaaccctaagagccatgagggcagggactgcgtctgtcatgttcaccactgggcctacagggtttagaatagtgcctgacatactggggtcactcaatgagtacgggagtgctgtatggtgttacaaaatgggggagtttcagagatgaaaacaagatctgcaagaccaccaggaaggattctgagaccagcagcaaccatctggaagaggtgtacaggctaagcatccctaactcaaaaaatctaaaatgtttcaaaatccaaaactttctgagtgtctacatgatgccacaagtggaatattccacacctgacatcatgcgacaggttgcagttaaaacgcaggtgcacaacacagttttatcag

SEQ ID NO: 202668 - DNA, 519 bp, Homo sapiens
tcttttcactttctggaccttaattttccctttatggaagaaaatgaaaaccaggccccacctgagtttgttgtgtgtagcaaagagggagggaaccaaacctactcctaaaagaagatgtggtgaatttgattcacaccaataagtatccatcttctttagatgaaaagctccaacctgctgcaagtttgcagggtgcacctgcaataggcatttgctattcctgttgtttacacttcacactgaatttcacagacctatttccatcatgatccacaatttaaagaaatatttcccaaacttgtatacacatttcaatatctatcaactgaaacaaacatttcatgaaacaaaacctacccttacgtacaatatagaatattttccattgtattcctgttcgtattttaaaaatcttggtcacgacccactaaactcattacacggccttcagataggtcacaactggaactttaaaaagcactgcccagagtaaatcacaacggttcaacatccacg

SEQ ID NO: 202669 - DNA, 341 bp, Homo sapiens
cctttgatcccaaagtgtgggattacaggtgtgagccactgcgcccagccccataccaataaatagtaatgctataaaagtattctatcaatctagtttaagagtagaacttcaataaccatgaacaagctggaaatattttttgggttacaggggcaaactctatggttttgggtaaagcacaataaatttgtaattaaccaaaagctcctttcctcaaagagatattatactacccctcggcccactggcaattgcccggcaggtcaaggccagtgagccatgagcacatcactgctccaggctgggcaacagagtgacaccctgtctcaaaagagaaa

SEQ ID NO: 202670 - DNA, 683 bp, Homo sapiens
ggatgaaaatcaagaacaagcacaccaagtcaattatagtaagagtcaaaattgtggttgccctgtggagtaattatcactgagaaagaggatgaaggaacttcctaaagtcttggaaatgttctgtttaccaggacatgtacatacatgaaatgtcattaagctgtacattgaagattagcacacttcatgcatgttagtatatgtataataaaataaaaagtgattatggggaaatagtagagttatacttttaaagagaaaatataataggagggaaatatcacagtagtagattatacttttaaagggaaaatataatactgtagctaaaggtacctgaagcaattcatcttcttacatttaaaaaaaaaaaaaaagcagtaaaatctttcctgtttaaaggtgtcaagtataaatcttcctccattaaaacaggatgataccctgtggatgcttacctcaattaccaagggtaacttccctcactctccacagctcttgcttttgagacttgcgaacgtatttttccccatgaatagcatgacatgatgcgattggactgtgtaagaaagactgcaacataagcaaaatggcaatgccagagcttgctagaaaatccaagaagctgtatctggtgatagctttagagatgctgccttggaagacactgaggtcaagca

SEQ ID NO: 202671 - DNA, 336 bp, Homo sapiens
aatcatttgtctatataccagcaatgagtaagtggaatttgaaattaaaaacattatgccatttacattagtactccctccaacagtgaaatacttagtataaatctaacaaaatatgtacaagatttatataagcaaaactgcaaaactcaaatatcaaagaactaaataaatggagagatatttcatgtttgtggataggaaggttcagtattatcaagatgtcagttcttcctaacttgatatatagatacaacacaatcccaatcaaaatctcagtaagttattatgtgaacaaactgattcaaaaatttatatggacagacaagagaacta

SEQ ID NO: 202672 - DNA, 447 bp, Homo sapiens
agccatagtatcagtatggccaccgccatggtgatcgaacagggattccttatcagcaaacaggtccatatatctgtcagggatgtctacacttgtggcatttctattaccgacatatgtacgagagtgcaaacacaaatatgcctatcatctggagaacgctactgtgggactagggattggttataagaagcaactaggatgtggcgcacagggtcacagcctggtaatctcagcaccttagggaggctgaggcgcgcggattaccacgaggtcaggggtttgagaccagcctggccaacacgatgaaaccacatctctactaataatacaaaaattagccagtgtggtggtgcgcacctgtaatcccagctacttgggaggctgaggcaggagaatcgcttgaactcaggaggcagaggttgcagtgagctgagatcttgccat

SEQ ID NO: 202673 - DNA, 898 bp, Homo sapiens
gttgaatcatacggggcagtttccccctgctgtcttgtgatagtgagtgaattctgatgagatctgatggttttataaggagcttttcccctttcgctcctctcacttctctctcctgctgccttgtgaagaaggatgtgttgctttcccttctgtcatgatgtaagtttcccgaggcttccccagccatgcagaactgtctagggcaggaaatgtgcaagataagcctaaaacatcttgtcacgcaggatagcaagggaacaatcaaaaacatgttcaaagaactcaacagccaacttgaagaaactactcatgtccaaagtttcagcttaaggtgaaataaataagtggcaggccgtccatagacgccacttctatcatgttgactgcagtagggaggcataggaggtgacagcaggagtggctgcaggagcagcagtggcagcagtgggaaccctgtgccctacactctgcatccctgaggcagctgactgtgccacccccaccattacccggctgggcaggacacaccttcaggcttggatcctcctccgctccagaccctggcccatgtcactgctctcacccacaccagtgtgggaagggcgtgggaaaagtcagacagtccccagagcccgcccttgggagccccgcagagcctgccattcctagggccacctggatggggctggaccaaggccaccacagcagaagagcagcatagttgggcatccgtgcggtccccagaaagacctgaggagttggatcccacgtggcctcttgctgacaccattggactgctcattacgcatcagacaatgcagcacagggtgacatgccactgggagcaagtggtcccctggaccagcacagctggagtcaggaaccccaggggtcg

SEQ ID NO: 202674 - DNA, 642 bp, Homo sapiens
aaaaacaaaccacgtggcttcaagaaaattacatgttgtgagtaactttggccttgtccctaacccccgatggacatgtccattctgtcaacaggggtgtttaggtgctaagtctgggaagcgctgattaggagtcagagaacagacatttccaactgttaaattgtcatcgcttgtatcagccattatatagtcagttactgggggaatatgcacccgtgatgggcgttaggtgataatgattggaaactagtgaagctgtgagctcacagttgctgaatggtttcttactttgcttatcaagtgggtaatgaagatgagtggattagaaaacaccaacctgttgggcatggtagctcatgcctgtaatcccagagctttgggagactgaggcaggagatcaagaccagcctgggcaacacagtgagaccgtgtctctacaaaaaataaaaacattttaaaaaagaaagccctcagctgttcatgatagaaaaatagagtaaatagcaaaatctatacgtaatcaaatgctagatttgttcggtgatatttaggtattgtagctatacttttcagctattaaaaagccttgttgtttctgaaattcctactgggaaaatagctttgttattgcaagtgtga

SEQ ID NO: 202675 - DNA, 567 bp, Homo sapiens
ctccttacttcaccatcagcaagaactcacgaattagggaagtgaacagtatgacagtaggataagaagtcagaattacaggcttggagaagtgattcacacctgtaatctcagcactttgggaggccgaggtgggcagatcacaaggtcaggagttcgagaccagcctgaccaacatgatgaaaccccatctctactaaacatacaaaaattagctgggtatcgtggcgggtatctgtaatcccaaatgctcaggaggctgaggcatgagaaccacttgaacccaggagggtggagttgcagtgagccgagcttgtgccactgcactccagcctacatgacagagtgagaccctgtctcaaaataataataataatgaactgagactcagaaaagatgtttgttcagggttacaaagctcagacaggacagggcagcattggaaaccaaaattggtctgactcctaggctcatgctgtaaatcacggtgcaaggcttctactatctatgtttttcctaaaagaatgtataaatgaaaagatggttaacatattaagcaaaatatgt

SEQ ID NO: 202676 - DNA, 967 bp, Homo sapiens
  misc_feature (759)..(759): n is a, c, g, or t
  misc_feature (761)..(761): n is a, c, g, or t
  misc_feature (921)..(921): n is a, c, g, or t
  misc_feature (928)..(928): n is a, c, g, or t
aaaaatcaagaagtctttgtaataacaatagacaccatttactgaacaattatcaattttgttgacaattttttataatcttgaaaacaatgctagaaagaagatatgattcaaattgataggtgaggttaactagtctagagcgattaagtagccggttcaaggcaagtcactggtacagctcagcttagtctggatggaagtgccatctccttcctttctcaacatttcactgcctggccccccatcatgactgtaggtattcccaatattcctcctttgtcatgagaattcccagaagataacagagaagacatgaatacaacaacccaatagggcttctcctaaatcttccaataattacagcctgaaaagtactccgaagaccctcttaagaaaaggaacatatttcacactatgacactatgaaagcccagtgcttccaaatcctatttgtagtaggaaaaagaagtcctgacctccttcacacacttacatagtaagtatgaggttctatcttggtcaggctgaaagttccatagcaaactgattattatttggagctcaggttcctccaggcattgtgctgcccagcaaccttttttatcacttctgaattccaaacaattctccacctccttcagtgtatcaaatcataagcatctgaagtgtcagaaacctcaactcaattttctcccaggaccttctctaaactcctcaagaatactctggtcttcaatgaagacttaagtccataancnggatcagcgctgatccgcttaaactgttgaggtttagggctaagcatagtggggtatctaatcccagtttggtcttagctattgtgtgtcagatatgtaaagcactttcgtagtctatttgtgtcactgagtttttacaactcagtgagtttagcttatngggaggngtgatctaaacactcttacgcgctctatgactggtaatc

SEQ ID NO: 202677 - DNA, 153 bp, Homo sapiens
ccccctccattttgttaggagaagcaatctcctcattcctgcgctgtggagatatatttctcagctagggcgcgagcagtgccagcactgcccccggtgaggtccctggcagcaataaaaatttttattgtgattatgttggtgtcggggtgt

SEQ ID NO: 202678 - DNA, 367 bp, Homo sapiens
cccaagcagttaatacagactcaatggcaatacaatagtggaaagttacaataatctaatcaattctactggacttgtctaaggacgtaaaatatcaagagagtatctagtgtctgcaaaagagtttagaaaaagcattaaccaaccaagaaactagaatatcttcagtaacaacaacaagtagcgtgccatgacaggctagcactaaatcttataacccttgaagtcaatctgtcgttttagtgaatatgttgaagcaagcgtaaagggtaatggcctgtgaagaccactagttccgtatgccctagtagcttactcaccaaaccaccttacctgagtctgtattaactgcttggggtcctctaag

SEQ ID NO: 202679 - DNA, 334 bp, Homo sapiens
cacattgtactagtcctctgattagtagtatttctaaaataatcccaccaattattctggttattactttttcaatgcttttgataagtaacaaatatttgaatgcctgttatatacaaattgctatgccacaggaactatagacacatcctctcccttcaagagttctcacagtcaggaaaatgaaacacaagcaatttaaaagtaaagtacaagaggccaaataacaattcaatacagtgacatccaaaggtaaaaaattattggttaccaaatcagtagaagagagaagtcatatggaacagagtcttctaaatgatctttacctgaatcc

SEQ ID NO: 202680 - DNA, 574 bp, Homo sapiens
gggcatcaggattcatggacaacaaaaaaatctctgattcctccaaaaggcgtgtgggtcactgagctccggaagaggctgcctccaccaggtctcatttcacgttgggaggttacagcgtgggtcttgtttccttggctttcccccatctaatcccaaagccaaggtcacaacctcttagcaatggggtgacaatctcatatagagctgcaatcaacagccattcttgccaagctgatattaacatttcttttttctttttgatgttacacacaatcctgtccttgctgtaccagaaagccatttcacccatctgtctgggaagatgatccaattttggtgcttttatcatcaatgctttcagcaactttgttctacttcccctactgtaattacttttgaatcatcaacgcacccagacagccttaaacctcagagaacagaatgctaaaaaaagaaaaaaaaaacccgcaatggcaaggcatggagatgggatgttgtggagaggacggagtggggagaagaaggaactccaaaaggagccaattaaaacatctgcttccccagtccccca

SEQ ID NO: 202681 - DNA, 638 bp, Homo sapiens
gggcatcaggattcatggacaacaaaaaaatctctgattcctccaaaaggcgtgtgggtcactgagctccggaagaggctgcctccaccaggtctcatttcacgttgggaggttacagcgtgggtcttgtttccttggctttcccccatctaatcccaaagccaaggtcacaacctcttagcaatggggtgacaatctcatatagagctgcaatcaacagccattcttgccaagctgatattaacatttcttttttctttttgatgttacacacaatcctgtccttgctgtaccagaaagccatttcacccatctgtctgggaagatgatccaattttggtgcttttatcatcaatgctttcagcaactttgttctacttcccctactgtaattacttttgaatcatcaacgcacccagacagccttaaacctcagagaacagaatgctaagtgaaataagccagacaccaaaggccaaatatgatgccacttttatgaggtaccagcataggcaagttcacagaaacagaaaggagaatagtggttgccagggactgcagggaggaggaaatggggggtggggttattgtttaacgagtacatagtttctgtttggcatgaaggcactcgacatgaa

SEQ ID NO: 202682 - DNA, 383 bp, Homo sapiens
gcacatgcatcccagaatttaaagtaaaaatttttttaaaaagattccagtttggtctatctggctctgaagtttctttttaaaaatttgtaacagccaccctttgaaaagcacttgctgtatggtagacattgtcaagtgtcttccgaacattatttcaaatcactccttccacagtatacaagtccatgcaatactggatctgagatgagtggggaagtcattggtcaatttatacggcatggttgaacaaaaataaaaccacactggaattttctattgtcatcaattccagagtattgagaagcatggcagataggatagagacagcctataagcaggaaaaactagcttaaataaaatcatgattcaagtcctattcc

SEQ ID NO: 202683 - DNA, 420 bp, Homo sapiens
  misc_feature (412)..(412): n is a, c, g, or t
ccacccaaaccaagaacagaacatctaattatgtatcttatatttccctgcactctccttgcctgttatatccttgtgcctctttcacagaagtaataaatgctatgctgagtttgcagtgtaactttctcttttttttatcttttttaagggactttgatcatttgttatttactctactaactttctaagtttctcttccctctgacctccatcccaatccactttgagattcttggactgacctttttttggacatttgttgaacatgtgaatgctgacctagtaatctatccattctcctgtatttatttctgtaatgtttcgtgattgttatttttatatcttgtacctttgtatgtaatgcaactaaacacaaccacccactacctaaaaaatcccaaacatatanctgaccta

SEQ ID NO: 202684 - DNA, 750 bp, Homo sapiens
aattagttcattagactttaagtttaattagattttaatcggtttaattagactttaatttgttaacagtatgtagcatttccatccaacaggatgaaaagttgaacaatctcctcaaaaagcaactataaaggtgaatgaaagtgtcaaaacaattattttagcattctggaaattaaccaaagatatgcatgcaaatgaagagagaagtgttattcatgagaatcactgaagcatgggcagatatagggcaattttatagttttcttgatgaagaccattcctatgcctcacctgtagctctactgctagacagttcaacctggatgagacaggctatgaaaccaatagtcttagcgctggtaccagggaaactcacttgatttagaatcttgtcagttccagaagtgctctcatgaacaagtaaataaggaggaccagcagttctgctagcctgaactagattctgtttggtgcaggtagcagactgtcagactagcagaggattttgtaggaaagaccaagaagttagggatacgaggaaagcttgttaagttcttcatgtatctcaggttgacaggagttgttgccatgcaaacaacgttgtgtagttagcccatgccaccccacattcctggttgatgaagccaataacaaacacatacacacacacacacacacacacacacacacacggtgagagagagatagagagattgaaactgattggcagaatctacaattaagggg

SEQ ID NO: 202685 - DNA, 257 bp, Homo sapiens
actctcaggtgctgcatttctgcacgtcggggaacaagggtgaagaacagagctagtccagcactgctccgtcctcccgcatttcttcttctgtagagtcttttgcaaactagagagtcttgcagagagttgttgggttttcccaggagatactgtatgcaaagaattgtcatgaagacataaaatcaagtcttggtgtaaaacttttaataaatttaaaggcatgtctctgtttttctcctcctccatggggattt

SEQ ID NO: 202686 - DNA, 931 bp, Homo sapiens
atttatgtctttaattctcatccaaatattgccatcccatcaactctcttcaagggcaatgataattaagttcagttgcctattttaccaattttcaatcatataaaagccaaaaaagaaaaaaaaaaagcaagaaagtggatatttgatataaatgggaaatgtcatttgtttggggaagaatcagttacattctggctaggaggaagtgtgtaacaagttgaataatcattcctttctcttacctaagcgcttccactgacatgtccacctccagggttggacctgccacagtcctgcgtgacattcacacagtctcttttattctggggacacagggcagggatgtaaagaagaactcccctggcttggacagtattactcatatttgcagtacaggttgagctgcaccaacctgaggcccgagggatagaggtgcttgtatgaatttgaacaaattgatttgtatgtgcgtatctgttataagctgggccctctgtggcatgagttccaaggaagcccccactccataccttaccccagcctaagggcaatattgcttctttacctccatctttggaccccacacggtctctgatatttgttttgtaatagcagagacttgttcatttcacacaactagtgagtggcagagctgaaactggattctagagctttcagcatctagggcaacactctccccatttatggtctagtggtatgtggactttgatttcggcctgtggaagcaagattctcaagggcagggctgtgctctatgcatctttgtgtccaaagcccctgttagacagtagttgcttctaaatgtgtgtggcattgtactcacaaagttccccgtttcgtagctataagctcaagcaaactcttctttcaaatgatgttagtgctgtatttggtaatctaagagaaa

SEQ ID NO: 202687 - DNA, 577 bp, Homo sapiens
ttgcaaagagttgagagatggcagtgaaaagatgagaaatggttggatttgaggtaattttggaaactgggctgatatgttttactgtgagattagagggttccaaggattttggcttaagcagaaatggtggtgtcctaggcggctggcctacgtggtagtgtcttttactaagatgaggaagtttatgagggagcaagatatttgggaggaggaatcaattattctgttttggccacactaaatttgagatgcttactgacatctttataggtacgctaagaaggcatttgaatatgagttcaggcctatgtatagtttttagacccatttttcatcactggcccctgtaggtctttaggttctcgccatattgagcaacctaaactttttctaggcccctttttacataagctgttacctctgttcaatgaaagaattaagttaaggctcagaagggagacagtaatggttcattctttgttagtctattcctaatatttaatgaggttcataatcctactgcttcttagctcaggaagctttaagctctcttggggcttgttatctgagtgct

SEQ ID NO: 202688 - DNA, 435 bp, Homo sapiens
cccaaggccaagagacctaaatatactacagataacaaggaggtaatggggcttcttgattagaagtcctcaccctgaagcaggccagaaagagcactcagataacaagccccaagagagcttaaagcttcctgagctaagaaggcatttgaatatgagttcaggcctatgtatagtttttagacccatttttcatcactggcccctgtaggtctttaggttctcgccatattgagcaacctaaactttttctaggcccctttttacataagctgttacctctgttcaatgaaagaattaagttaaggctcagaagggagacagtaatggttcattctttgttagtctattcctaatatttaatgaggttcataatcctactgcttcttagctcaggaagctttaagctctcttggggcttgttatctgagtgct

SEQ ID NO: 202689 - DNA, 295 bp, Homo sapiens
actattatataaatggcactgctccaggaactagaaataccacattaaataagagatatgtgtctctactctcatggagcctacatctaactagatagggaaaagtagacacacaaaatacacaaaatttttcaacaattgtacactaaaataataaacaaggccagtgagttagagtgatgactggtgtctggctgaggtttatatagagtggtcactgaaggccacaagaagaaaatggtcaagggcactccaagtcaaggggaaaggagaatggctggagggcaatgagtga

SEQ ID NO: 202690 - DNA, 523 bp, Homo sapiens
agtcctggggatcagataccctaattgggtctcacaggtgtgttagccagggttgtccagaaggacaaaaccagtaggatataggtatatataaaagggagttaattagggagaattggctcacacgattacaaggggaaatctcacaataggctgtctgcctgctggggaaagaaaaaagccagtagcatgacttttgttttgaataaaatatgggtgtataactcaggagaaggttcagagttaaagctgtagatttgggagctaaggtctccagaatgaagcaggatacagagtttatggtttactcattagttagtcatgtgccagtcaatctgatgaaccaggggattctccactttagccacacattagagtcatctaggaagctttagaaaatggtgatgcttgtgacttacacccaaagattctgatttaattggtctgaaatgtagactgggcattgggacttttgaaagctccccaggggtgattttaatttggagacaagattgagagccac

SEQ ID NO: 202691 - DNA, 444 bp, Homo sapiens
caatgcactccagcctgggtgacagagcaagaccctatctcaaaaaaaaaaaaaaaaaaatttgccctataacatgggtgggcttcattcaatcagttgagggctcaaaaacaacaaaaagcaagaggcaattctctagcagactgcctccagactgaaactgcaccatccactctcctgggtttccaggctgctggccagcagactgcaactgcaatattggctgtcctaggtctccagtctgccaaaccacacagcagattctggacttgccagtctccataactgtgtgagtagagtccttacaataaatctttcagccaggcgcggtggctcacgcctgtaatcccagcactttgggaggccaaggtggggggatcacaaggtcaggagatcgagactatcctggctaacacggtgaaaccccgtctctactaaaaatac

SEQ ID NO: 202692 - DNA, 586 bp, Homo sapiens
agggaacaggggccagggctgggaaggcataagaacagaagataaatttgaggctctgttacgctggtcatccaacccaaccaggtatctcttgttatatgctaacttcattttccctttcttgtccatagtgggaaaaaataatttttaactggctatgtagttaaaaaacctaacaaaaagcacttttctatataatgagtggtttatattaagaataggtacaatgtaaatactggtaagtgaaagttcattttgttcagtgctatgggctggtacattgcatttcaacactagttttttacttttatctaccctgagggtagataacccatattccaaaatacagtattattttcatttgctgtaacattttaagaaatatgtagtttctaaaacttcatatactttatatggaatatgaacaactttaatatgaataaatagtctagaaaaaaatttaggaaaaattgccatgaaatcatgagctaagtcaatggttattttaaaccacttaattttgagactagtatttcatacagaaaaagctaatactgatatcacacactaattgtgtataaaacac

SEQ ID NO: 202693 - DNA, 277 bp, Homo sapiens
tctcactctgtctcccagagtggagtgcagtggtatgatcatagctcactgcagcttcaaacttctgggctcaagcaatcctcccacctcagcctcccaagcacctgggactacaggtatgcaccatcacacccagctaatttaaaaaaaaaaaatgggtcacgagcccctgggaggaggtagggcaaatgggcgggaaatgctcattttggggaatggcttcgagggaggaaaccgcagccgactccctcctcaaatctggccccaaagacccgcc

SEQ ID NO: 202694 - DNA, 1290 bp, Homo sapiens
ggagaccgagatgcgtcacactcatagataggcgccacgccccgagagttatggagaatgttacccacgctataagtggaaacagtactgagggcgcgttgtacactataagtggggttatagccgaaaaggcgcagaaaaagtttggaaccgcgggggcctgtgcaaaaggtgtatacaccgtgaggaaaaagtgtgttgtaggacaattataggctctttttcgaccgtgtgatttccaaaaactttagggaacttgagaaaagttgggaaatttggagaaattttgctcttataacatagggacccatgatttctacacgtggatggtccagcgcttgactaagtgccttggcactattttgttcccaccttaagtctcccacctataagatatttgtgattattgtcctctactttatgtgtttggaaagtaggcttagaggccttatgtagccatcgtgaagttacacatttgaccaacagaaagctaacattttaatgccatctgtcatctgatccaagggactagtcataaccacaaaatggattgagaggcttaatgggttgagggagaacttatagcatattctaactcagagaggtatgatcagtcaaggatttttcctcgtagaaaatttactctttatctttctgtgttagattattctatgagattatatttcttattacgaattggaaaactgcttaaaagatttgtttccttgcttatgagaataaatgaaatataaaatttaaaagtccagtgcttttcgatgaaaaatgttaattctgtcttttccccgtctcctataaataactggcatattttcctacagaactgtttgtcacatttaaaggtaagatgtaatcacacttctgatatgtaaatactgactggtatattttgtttatgcatataaattgaacagtgcataatgaaacttttgttactattggtatacttgaatagcaacactttgccacattccttttcttatacctactgtatttcttctatagggaatcatgtatagatatgagtaaacttttgattgaaaatttagtttgtcctaatgaatgcaagattattgtacatttttagtgatatttatattatcttaaatctaggaatatttgttaattcttttagaattatagagtattaatctcacaaaaccttctagatacttattttgtcttttgagaaaatcagtaatgttggtttaagtctgaacaatatgagaaaaagctttgataatatcactaaaatcacatttaagtatgccc

SEQ ID NO: 202695 - DNA, 1205 bp, Homo sapiens
gtgtgggcaccgaggaccaccaataagagcgcccccagtagtaggagaatgtgcccacaaaactggcgagatgtggggagggccaaaaaggtaacacggaggcaaaaaagtgtacccggagccttgaaaattgttaaccgtgttgtcaaaaggtttttaggaagattaggccttttccgcggtatcccaaatttttaggacttgaaaattggaaatgtgggatatttgcctttaaaaagagaccgtagtttaacagtgagtggccagccttagtaaggcttgggctttttttccaacttaagttccaactttaaaaaattgggatattggcccaccttagggtttgaaataggcttagaggccttatgtagccatcgtgaagttacacatttgaccaacagaaagctaacattttaatgccatctgtcatctgatccaagggactagtcataaccacaaaatggattgagaggcttaatgggttgagggagaacttatagcatattctaactcagagaggtatgatcagtcaaggatttttcctcgtagaaaatttactctttatctttctgtgttagattattctatgagattatatttcttattacgaattggaaaactgcttaaaagatttgtttccttgcttatgagaataaatgaaatataaaatttaaaagtccagtgcttttcgatgaaaaatgttaattctgtcttttccccgtctcctataaataactggcatattttcctacagaactgtttgtcacatttaaaggtaagatgtaatcacacttctgatatgtaaatactgactggtatattttgtttatgcatataaattgaacagtgcataatgaaacttttgttactattggtatacttgaatagcaacactttgccacattccttttcttatacctactgtatttcttctatagggaatcatgtatagatatgagtaaacttttgattgaaaatttagtttgtcctaatgaatgcaagattattgtacatttttagtgatatttatattatcttaaatctaggaatatttgttaattcttttagaattatagagtattaatctcacaaaaccttctagatacttattttgtcttttgagaaaatcagtaatgttggtttaagtctgaacaatatgagaaaaagctttgataatatcactaaaatcacatttaagtatgccc

SEQ ID NO: 202696 - DNA, 710 bp, Homo sapiens
cggagaagtgcaagataagggtgtagaggcatgcacgaggtggttgaagtggtgagaatggtaggcgcggtaggtggtactgttagaaattaaagtgaatggtccgcgaaaaattgggtgaggatgctgtgatcgaggctacttatgaacttgagctcgagaaaggaacattccattggctttatatccactaattacctgccttttatgtgtcagtcagaaacaattttttttaaataactggcatattttcctacagaactgtttgtcacatttaaaggtaagatgtaatcacacttctgatatgtaaatactgactggtatattttgtttatgcatataaattgaacagtgcataatgaaacttttgttactattggtatacttgaatagcaacactttgccacattccttttcttatacctactgtatttcttctatagggaatcatgtatagatatgagtaaacttttgattgaaaatttagtttgtcctaatgaatgcaagattattgtacatttttagtgatatttatattatcttaaatctaggaatatttgttaattcttttagaattatagagtattaatctcacaaaaccttctagatacttattttgtcttttgagaaaatcagtaatgttggtttaagtctgaacaatatgagaaaaagctttgataatatcactaaaatcacatttaagtatgccc

SEQ ID NO: 202697 - DNA, 727 bp, Homo sapiens
cgagtaaaaatgtatcctgtagaagattttgaagcatcatttcaatttatgcaggaatgtgctcagtatttcttagaagtgaaagataaagatataaaacatgcacttgctggtttatttgtggagattcttatccctgtagctgctgctgttaaaaatgaagtgaatgttccctgtttgaaaaattttgtggagatgctttatcagactacttttgaactgagctcgagaaagaagcattcattggctttatatccactaattacctgccttttatgtgtcagtcagaaacaattttttttaaataactggcatattttcctacagaactgtttgtcacatttaaagaataaagatccgaaaatgtctcgagttgcactggaatctttgtatagattattgtgggtttatgtaattagaataaaatgtgaaagcaacactgtaactcaaagatctttttccctgtagtcgtcttatgagcatagtgtcagcactttttccaaaaggctcacgaagtgtggttcctcgtgacacacctctcaatatatttgtgaagattattcagttcattgctcaggaacgcttggattttgcaatgaaagaaataatatttgatcttctcagtgttggaaaatctactaaaactttcaccattaatccagagagaatgaacatagtctcagagtcttccttgtaatagcaaacacatttcaatctcgggaccggc

SEQ ID NO: 202698 - DNA, 1131 bp, Homo sapiens
agtgacctttgtcttaaacaattcatagattcactgaaattttcttcaactttaggaaaatgaaatatattccacagtgctgtaagtcttaaatattgattttcctctgaaatcttgactcatcctacccaccaacattctccctttgtacactatgttctttgtaatgttcacgttacacaagtgaaaattagtaacattagtaaattttcattgcaggtttatttgttcatatttctggatatataatccattactgttaaacttcatatcaatgttccgatatttcttcatcttatgttttatgttacaaaacaggttatttcactatatgtatttttaattgattaattcttcccttttttggaaatgaaacagccctctcaattattgggacagaaaagttatttcatagggaatacttcaaacactgatatctacaacaggcagtaagattcgtcacaacaattggtatactgtcaatataccatacaaagttccatctggtcttgattaaaaattattttagttttctcaggaaaatgatacagagggagaattgcctagattatatgagagaaaaaaaagtagagagaaacataatgttttcttagattattacagcagtgaactatttccacctggtaagaagggtgcacttgagaatggggtacaagtactctaggaacatagatgtaagttctggatgcacagtagttgttgcttagctgtaagctggaaatttcaaggcagaaacagcagataccacaactataactgggtcttcttgttttttgttttatgtgtatacgtgagattatggggaaagacaaaagtaatgcatagagatttattttttaacattcaattcataagcagtgtttatacctctttgtacttacttgaaaagtgtatattatgtaaatttagtataaaaacacttggactaattcataccatgtggtaaaatttcacattcaaaagaaatacccttctgttattaaaaataaaaaaaaaaggagccaggagggtggctcatgactgtaatcccagtgctctgggaagccaaggtggagggatcatttgaggccaggactacttgagaacagcctgggcaacatagctagatcc

SEQ ID NO: 202699 - DNA, 505 bp, Homo sapiens
agcaggctctccttaggggctgcaaatagccatgggtgagacacaatccatgatgtggtcttggcctggttgggatgaggccagaggaggctactaggtaacaagaggcagaaccctggcccttggtgaggcctggagcaatcctgggcttgaaggtaccaggaatcttcctcatgccccaagaccactctgaacagcagaagagtgctgctgaatgctggcatttgattaggtttactacaaccaacctactggcagggaacaagatcccttctcccataatgtctccaagtgagcacctgggacaaggaaggaggaatctctggtcctctgagagatgagagcatccaagaggtgaagcagcactccccagcccctggctaattgttctcaggactgtgccagacaaacccctgatggaatcccagggagcctgggatcacacctggcctgctggcctctgtggctgtcctaaggtcttcataaagaaggctccccctcctgc

SEQ ID NO: 202700 - DNA, 435 bp, Homo sapiens
tcttgagttgatttttgtataaggtgagagataaggagccagtttcattctcctacgtgtggcttgccaatcttcccagcaccatttgttgaatagggtgtgtcctttccccactttatatttttgtttgctttgtcaaagatcagttggcttcatttctgggttctctattctgttccattggtctatgttcctatttttatgccagtaccacgctgttttggtgactatggtcttatactatagtttgaaatcaggtaatgtgatgcctctagatatgttctttttgcttagtcttgctttggctatggaggctcttatttggttgcatacgaattttataattgttttttctaattctgtgaagaacgatggtatttttatgggaattgcattgaatttgtagattgattttggcagcatggtcattttcac

SEQ ID NO: 202701 - DNA, 302 bp, Homo sapiens
gtctcattacagtcatcttcagatcttgtatgaggaagaaaagaaagggagaaaaaaattattcaccaccccacctctcattttcctcatggggttcctccagttacaattgcatggcaacctagcagggggtttctagcagcagcaccaagagcactagagcaacacctggaaaaagagacgcatacaaggatgacacacttaagtgtgcatgagaggcaatttctccaattgtacagaagctgtcaaatgataaactagcagcaaaagataacattaaaaactgctacaagattattaga

SEQ ID NO: 202702 - DNA, 311 bp, Homo sapiens
gtgattctctttgagaaataggaaatgactctccaaataatgttaatatataactgataaatagaaaagctaaatttaaacaaacactgttaggttggtgcaaaagtaattgtggtttttgtgattaaaagtaacagtattgctggagctatggatagtagacactctttcaaagacagctgaacatattttatgctactatagttttctctttcattgctttcaggttgtagcttaggtcacatttctcactcacaagagtgagtgagtggaaaattgtaaagcaaagcaggattactatggaaggtagc

SEQ ID NO: 202703 - DNA, 400 bp, Homo sapiens
gtcaggatgattattctgggacacgctgagctttgggttggtccttgtccaaccacagaattgctgcatgccctttggaggtgttttactagcttctccatgtctagatgtactagtgttattatacaatatcagatttccccacaaaatgccaatgcaattggctattcatttgtgtgcaccaacattattatttactgtacttagtccgttttgtagtatttagtgaccttcaccagaagttcagcattcttggcaggcatttttcccttggccacagaggaaccctgtatttctctggctctggctccttccaagagatgggaatgtaatagcagcagctgaagatatgaaaataactgggaacaaaatagacatcaaattcagaaaaggactgaaa

SEQ ID NO: 202704 - DNA, 638 bp, Homo sapiens
gtctaagtgttgtactgaaagattaataattcttcccctcaaaaatacactagcattattttcattcctataaggactactaaatttctcatatcaccatagaatttttgcttgctaaaattccagtattgacaatagcttgactattatcccataccgtggttcttggaattgctttaaacccactgtgggaagcgattggcaagcgggtactgtaacattgtgaggacccaagaagtaaggtattgggatgcagcttatttactgtaatgtctttaatgtgggcgagtggttccacaaaaccattgacagtacagaacatccataggttgccaacagcgtcttacgttagggaagacgaagtaggtggtattccggagtagctgaaaaccccaattcatgtttttgtgagtggagtaactgctcatcagcagcacttgccagcccgaagccctgaggcgtggcatcaccagacacgccttcccatctgggcaggatatgtgggctctgcttcctgatcatcccacacgctaacactggtctatgctgtggaaatgaagatcttcatttttctcatgtaggtattttaacatcagcaggttttgtgagaagcagctcagtgtgtaattaggattaac

SEQ ID NO: 202705 - DNA, 292 bp, Homo sapiens
gggaagctgtcagggattatctgcggttcctgagtagctgaaaaccccaattcatgtttttgtgagtggagtaactgctcatcagcagcacttgccagcccgaagccctgaggcgtggcatcaccagacacgccttcccatctgggcaggatatgtgggctctgcttcctgatcatcccacacgctaacactggtctatgctgtggaaatgaagatcttcatttttctcatgtaggtattttaacatcagcaggttttgtgagaagcagctcagtgtgtaattaggattaac

SEQ ID NO: 202706 - DNA, 361 bp, Homo sapiens
aagacttcatagtgtggtttctaaatcttcctgctctctgcttccaaactggagcggtgatgatttacgtgtatctgggaaccgttttcctcagcaccctgctcctgccagacctggttcttgccactcagatgagtcaggctcatgttttggcttccacatggaccctcccttctccccaacacagttcccagaatacagacttctccccaggtctaagggttttcacaacaacattctgagatgtgattaaggcaatcctgaagagatggggaaaggacagtggatggacagaaagaagttgacttctaggccaggcgtggtggctcacgctgtaatcccagctacttgggaggctgag

SEQ ID NO: 202707 - DNA, 136 bp, Homo sapiens
gtaatgacaagactgccatttaaatcactatttgccctattacatagttcttaatatatttatagtgtgatagtaactatatcatctaccttattgttcaagccacacaattattttttttttttttttttttttt

SEQ ID NO: 202708 - DNA, 376 bp, Homo sapiens
ctaagcagttaatacagactcaactttttgggatcccatttgggaattaagaaaactaattaaaacttggtaataaaaaatgaacccttttatagctctgaatcaagatgtctaagcttcttgaaattgctgtcttgtaaaattctttggtttattctcaccatctccttaattctgtagcatttgacattgctgctttatgaggctctttgtacttttggcttctctcaagtaatattttgggtcccatctctcttgttttcctttactgagtctgtattaactgcttgcaagcggtaattacagactcacaaagccacagacttgttttccacgagcacgttcttaccttagccacgatgtgaccaagccacac

SEQ ID NO: 202709 - DNA, 152 bp, Homo sapiens
tatggagaagtgtcaaatgatgcagcccaaatcaccttttcatgtataatcatctctgtttctgagctcctattacatgtatgttttatataaatcatactggcacttaatcatttattattttgaattataatgttattattttatgttta

SEQ ID NO: 202710 - DNA, 560 bp, Homo sapiens
tgctgggattataggtgctacataaaattgaaaataaagtagaaaataattcctttagtagcccttgcttttcctcctggtaatgggccaaatttttttttttattgggagatggggtctgccacggcactccagcctgggcgacagcgagactctgtctcagaaaaaaaaaagaaaaaagaaaaaagctatcacttgttggtgagatcccttaatcaaatcagatgtatttaagagaatttggtataaagtaggtttatcagtaggttttggagctaaagcaccaaaaagtaactttcaagagttaggaatctcatggtagggaagttttgggcattcattaaatccagggctggatgttttttactctgtaaaacactgtgtaaaaagatgccaagctgttaagtacagggcagttttattataggcttgcctgtgatgttggttactttctctcttttttttttcttcctctagttctactccctgggtagaattaaaaacggttttaaaatgagcgttaattttctgcagtgaacatgtgttttgatagtaagagc

SEQ ID NO: 202711 - DNA, 717 bp, Homo sapiens
ggccaaggaaagagggttagaggaaggaggagttcttctgtggcccttgggtggaggtagttgccgggagcagggtcacctctctggtaaaggaggtgaacagagtgaccacttgcttgtaattttaattgcagataagtttttggatgtgcttccagcattttgtccgttggcagtaaatcagttgttgaagggaattgctcatcaacatccatcacctagaacgctggccaaatactgggagccctccccattttccataagctgatgtatttcacccttagtcatttaaactaaacacagatgtttttataggcctgattgacgcttcagccattgtgattttgctctaggttccaacgaaattctataaacctgtcagattaagtttcttaactctgaaagaatattgcatgttcccgctcccccttttctgttttctttcccctccctccttttccccattactccctgccttcctccctctttctttcagctgtaacagctggaaaccagtaacttgagcttccaatagaatacatttactttctattaaatgttctcaccacaaagaactgataaaaatttgagataatgggtacgctaattactctgatttgatcattccacatgtatatgtgtatcaaaatatcactttgtacctcataaatatgtacagttgtcaattaaaaataaaataaaactgaaaaatagtag

SEQ ID NO: 202712 - DNA, 395 bp, Homo sapiens
acaaaattatgtaatagtagtacatactttcctagatgtttcagtatataatatggcaaaacctcagccatcagatttgaccgaccaatattccacacacatctcttccattcacataaaatctaacaccttaacaataatttgcaatgttttccaccaaaagctgggagcctttatttaattaatacgaaaaacatctattacttatttgacagactcaaatgaaaagaaaatgcactttaacagggaaccagattttactttgaagctgtaggtttgaattggtgcttggatgagggttgccaagaatccagggttgccaagaatcccgggttccaaatccaagaactgaggtcaaacctgcaggaggggtggtgaaggatgcatgaggaggg

SEQ ID NO: 202713 - DNA, 323 bp, Homo sapiens
tcttgaactcccgacctctactgatccacctgcgttggtctcctaaagtgccaggaatacaggtgtgagccaccatgcctggccgggtcttggatttttataagaagaaaaaaaaggtgtggggtaggggagagccaggtgcagtagctcatgcctccctggttcaagcgattcttctgcctcagcttccccagcagctgggattacaggtgtgtgccaccacacccagctaattcttgtattttagtagagatggggttcaccttgttgcccaggtctcgaactcctgagctcaggcaatccacctgcctctatgtcatttt

SEQ ID NO: 202714 - DNA, 374 bp, Homo sapiens
atagaaacaccagtcaatatttgaagactcaaggattagaataaattacacagcctatgaagtttgctttagaattgcatcaaagtaaagatgattctaacatttctctgcttcgggtatttgctaacttatttcctgtattcaaagaactactgtgtatggttgagagggaagaagaatgcaagcactttaaaaaaaagttgtggaatttaggagatgagtcatgcacttttcccttataaaacatgtgttccaaattcatggacctttgcaggggtcagaggtgcttctcagtagtatgttacctagcagggggaaaaaaaaatcagcacactttacgcttcctttcaaagtaaaggtgagactcaacattg

SEQ ID NO: 202715 - DNA, 474 bp, Homo sapiens
tgtatactctatggtggggaggaatatttgactgtgttgttcactgccatatccccaacctttagaataattctggaccctgtagtagatgctcagtaaatattcactgaatgaatgggtgaatgattacattgtcttcacatttgaatgcacattattttttaaacaatcccctattgatggacatttaggggtttgttttttttttttttttcagttttttctactttttaaaacaatgctgtattgaatatttttatacatatatctttgtactgttttataatgatctctaggataaattcctagagatagaattgtgagtttaaaggatatacacattttaagttggatgcggtggctcacgcctgtaatcccagcatttcgggaggctgacgcgggcagatcacctgaggtcaggagttggagaccagcctggtcaacatggcgaaaccccatctctactaaaaatac

SEQ ID NO: 202716 - DNA, 678 bp, Homo sapiens
gcctgggcaacaagagtgaaactctgtctcaaaaaaaagaaaagaaaagaagattgccagcctgaggacaattctgagtcttggaaggactgacagaggggaaatccggtaacagtaacgtggaagtcagggagtttagaatccagcaggtaaaatgtctgaaatcaaggttcactcaaaggagggaccatagattttgtggaagactgacccattctgatcttgtcattggaggaagggtacaatgtggaccttggagattgaggacaagggtaccctaggcccaaagaccttgatggtaaggggagctaacgctaagagtttgctcattcgatgcccatttgacactgtgctcatgttagacccctcatttattgaagaaagggaggggagaggtgaggtgtttgtgtgtggcagtagggctaagagtgacctttgggaatggtagaaaggttagggagtagtgggaatttcaaggaggtattatttggacttgaggagagacatcttctttaagcattgaggagtcactgaaagattttgttggaattggggatcccttagagtaggggacttgatccagatgtgtgttgggaaggagctggtaaaatggttggccttgggcagtggtccagtgacaggaggtgaaggccgaggcgggatagtggcagtggtggt

SEQ ID NO: 202717 - DNA, 871 bp, Homo sapiens
ttggaaataccaaggtatgaaaggcctctgaggtttgctatttttagccagaaataccattgccaccaccaaatagggcatttaatttgtgcacctcagaaagggccaggtttcatagttgtcaaaagaggtcatttcaagttcatgagatctgttctcttttgggacaggtcccccaagggagcctctgctcgactgaagatatcatctgtgtttgcagctctagctctgtttctttggtatcactgactttctcttgttggccacaggaagttgaaggaagtgtgtactccattatcatcaaaaaatgttcccatgatgctcttttaagtgttatgcaaataagttgcacctgctttgtctccaacagtggctgcctggggaatgtgaggattgtcccaaagcacaatcactggctcctcacggcaaggccatgagaacgctcagaagacctcctaagacccttgaggaggttagaaggaaggggaaacaagcatgtagcatcttttcactagagtcgtctttaagatattttgatatcctctagcaagaatagagataggctaatccagcgaaatcagtattgcctttttttaggcaataccctgcccactccccctccaactaagctacagtgagctctcttgtctctgatactcatatcaagataaaccagatgattccagggctaattgcacatggaattcaatgttacatagtaataacttgcatattacccactagtcttgatatagttttctcaccatcatagatacactgatttttacatgtagatacattaatatctacaaaagactttttttacaaaaagagggaggggaatccgaagtataaagtgatcggtacacta

SEQ ID NO: 202718 - DNA, 1068 bp, Homo sapiens
ctttttgaaatgtgtttgaatatctgatatgataaatactggaagatctacccaatgaatccaaagcccacgtagatcctcaataatttaagatgtaaaaggttcctaacaaaacatctgagaaaccagagcactgactcagttagtgtttccattctaggtacccgccctacctccccagtgcccacagtaactaggtttttgcctatataaaactaaacagtctcctaaaagatgcagttactttgaaggtttgttatataaggttttgtgagcccactgtagaaatagactggatggggcaattcatccaattcctaaattttgaagactctgattacaaattggaggcattgtagtacagaagagaaaatcagtggatcatctatgagtcaagatgcccatcttttgatttctaatgttatactagctacctacgacttcaggcaaatcatttatttttttgggcatcagtgtcacaaactataacatcagagaataaaccaaatgatctcatgtcccttccagttctaacttccatgatgtgagggaagcccaaaattgccaatggaaaaaagaaatcataatggacattgctaagcactctacaaagcaaatactttaattgtgaaaaagttggtgatgtgaaagaatttaacagttgcacactttctcctagtattacttcctatattttccaggaaaagtgactggcacctttagatgactactgtgtcataagaaatatcactataagaatcttttaaaaatttacaaaataagaagtgaatattggttacagaaaggacttatcagtaattacttcaccaaggaaagctactaatatttggtaacttaatctaagacaggaaaaatgggggataaaattgttaaaatagaaaactttataaatctaaaacatgtcaacacacaaacagaaagttaaaagctccacactgaaaggaaagggactctttcctgaaataattaaggtttagtttatccaagtcctgatagaattggagatgatttttgtttgttttagtttaaaaatttttgaaactgaaa

SEQ ID NO: 202719 - DNA, 173 bp, Homo sapiens
gtctctgaatacttttctgttccatgtgttttgttcttctcaacaaataccaattgtgtttatgtttgatctcctttgtccgtcttccatatcccttatggccactaaaaaccaattttacatctttgttcttttccatataattttatatgacttattccagtctgtatccc

SEQ ID NO: 202720 - DNA, 363 bp, Homo sapiens
tctgtaaaatggggatattaatgcctcatggggtgtgaggatcagatgaaacaatggataaatcacttgaggaagcactcagaaaatgggagcaactattctaccaaatgggttatttattgacctgcacctctaccatctataaaagggtgtcattgggattcttgaaaacagcaaatgaaatggaaattctgcacatttaataatgatgtaaaagtctgcccttgggtctgaattgaactctgcttttgttggctgggtggctgtggagagagttcctaccccatgggtctgaggacaaaatggcaccaatcgcctccataaacagggttcgccacttcgcaattcatcacttacagttta

SEQ ID NO: 202721 - DNA, 247 bp, Homo sapiens
agagagccctctatccttgcgataaggcagagagtgtaactcagctgattggcacaagccacctgtagaccacaaaactgaaagagcacactgtaacacacggccactggggcttcaggagctggaaacactcaaccctagatgctgctatggagtcaaagcccaaaaacactcctcacgacctgtccgtctgcatgctccccctaggggtttgggcagcgaggcacggaagaagtgagcctagcta

SEQ ID NO: 202722 - DNA, 571 bp, Homo sapiens
aagcctggaactatgcggctagtagaagtcagaaccatttcttaccctaagtgggaatcaaacatattaactaccaaggctgcaactagcttagctgtgtgctctagggcataccactctaatatttcctcatataaaaaatggagataatactaccaccagcctttcctagaagttgtgagatgaaaatgggataataatattcataaattattttgctttgcatttagacatttagagttctgagtacgataaattcatttcagtcacgtgtataatgatgcttggtagaagggcaaactgagaagttagactctcagagtttttgactgtactatcctttccctttcctgtaatggagtaaaacgtttgcttcccatgcacggcggctactttggctctagcctcccttaagtaaaaaggctggtgccactggcattatatttaatttggagatggagataatataaacggatcacaaattgggtctgtgctccatcaatggatgaatgaataaaatgtgattacacacacacacacacacacacacacacacacacacacacacaca

SEQ ID NO: 202723 - DNA, 344 bp, Homo sapiens
tcgttaagagagatggggtcttgccatattgcccaggctggttttgaactcctggcctcaagtgatcctcctgcctcagcctcccaaagtgctgggattacagatatgaactaccatacctggccttctttactgagttttgagagttctttacgtattctgggtacaagtcactttcagatttatactctgcaagtattttctcttattccatggcttgtctttcttttcttaaacgacactgtttttagaaagctcttgttttaaattttgatgaagtctgacttatcaattttgctttggtgccatagctaataaatcttcgcataatctaatgtcacttt

SEQ ID NO: 202724 - DNA, 165 bp, Homo sapiens
actaaatgttactgatattaggaacttatattggaaactaaatgttccttttttaaaagtagttaaaattttattattcctcttgtcattgacttttgatttttagtttttagccaaatggaaaggattgtttctctcaatgagtagtcatatggtttgatttca

SEQ ID NO: 202725 - DNA, 733 bp, Homo sapiens
ccgagccaggtgtgggatataatctcgtggtgcgccatttttcaagcccgtcagaaaagcgcagtattcgggtgggagtgacccgattttcaggagtcctaacctaaaataaaatagaacatactgtgcttaaagcaaggggggaatcatgtaacaataaaaccagtgaagaaaattctaatgctcaggtaaggcctcagaaaaagtggaaaacagctggtcctcaggatcctccagcctttgccaaggaaaagtggttttaatcactgaagaatgaggcttcaacatatggaaagactgtaagtgtcttgacactgaaattttctcttgtaggtgttcctggacagcaagtgagtgacttgctcacaggcggtaattcagggacccaggtttcttctacctggtagctctactgtccttcagaacctcagagccctgtgcattcagccagcaggagaaagaccactactaaggtcattcactttgggagaagccagtcttcatgccatgaggacgttcaggcagccctgtggagagaaccacatggaaaggatctgaggtctctcaccagcaccaatttgccagctatgggaatgggccaccttggaaggagactgtccagcccaagtgaaggctgcagataactgcagctttggccaacatttggctatattgctttgggaaatctcaagccagaaccatctggccaagctgctcttaaattcctgatcca

SEQ ID NO: 202726 - DNA, 601 bp, Homo sapiens
ttaagagagtgctgaagaagaataagttaactataatatattcaatcttgttatacaatcagagtaattaacaccacgtggtattggtacagaaggagatgaacagtggaaaagaatagggaactcagaaatttggaaatttagtacacaacaggagtggaggaaaatcagtaggaaaaggatgagctagtcaatcagttttgttaggacaaatgattttgcatgttattcatgattcttacctcccacaaaacagaaaattaattttagatggattaaaactctaactgtgcaaggttgactctgaagcttttggaagacaacacactgtaagatcatgagagtaaagctgacctgacaacgatgagctttgaccaagcaatttcatttttaggtaaaaaaaacaaaaaacaaaaaaacccccaaaaaactagaggaatttccactctacatatacaagaaggtatgtacaaagaggctctttttacaatttcttgtgacagtaaaaaactaggaaaaaagctaaaataaagaaattgaggtatatacgtacatatagtgaaaagaaaaataaaattgaattatataaaattatatactg

SEQ ID NO: 202727 - DNA, 462 bp, Homo sapiens
catttgcattcccaccagtaattaattgaagttttttttggtccacatcctcaccaaaaattggtattgttagtcttttttgtgtttagaacattttattatgtgtgtggtgattgttgctttaatttgcatttcccaagtgaaagatgatgttgaatagcttttcgatatttatttgtcatctgaatatcttctttggtgaaatgttcagttcttttgcccattttaaaactggggttttcatttacttattgatgagttttaagagttctttgtatactttggatacaagtcctttatcaaatatgtattttgaaaatattttctccgagtctgtggctttacttgttattctcttaacagtgcttttcacaagggaaaggctttaaatgctgatgaggtccagcttattagttttttttcttttatgaatcaccttgcagctctattagtttttgtttc

SEQ ID NO: 202728 - DNA, 353 bp, Homo sapiens
agaaaatatccacaatgaaatttctacaagattagaggaaggagagaggcaacggggattccatttctactaggagtatcaacctctgagagaaaaatatccatctctgtggatgtcatctgctctgcagaaaaccctttcctggaactcccaggaactgctgtactgaagctcctgcacatctgtgaagtgtggaagctgtgggtgaaaacagtaaatacttccagttgcccgtgtgtgtcacttaaccgaggaatcctgggaaagtaaaagttgtcaccacaaaatagctactgtagtggaagaacgtctctgtcattttctgtaatgaaaaatctggtaacatctgcaca

SEQ ID NO: 202729 - DNA, 591 bp, Homo sapiens
ctggtgtcgaactcctgacctcaggtgatccacccgcctcagcctcccaaagtgcagggattacaggcatgagccacttctcctggctcaaagcagttttaaaagagtaatctgctgatagtatctaggttggattgaggagtgaagagattctgtaggtaggggttcagttaggaggttattgtagacatagagtagtaaatgataaggatccccaggtaggacttgacaatgggaaaaaaaatgatgaattgtgagatgttctgcaggaaaaatcaatagggctacctggttcctagcaaggtgcaggagaaatacaaggagaaagatttaaacatctttttgaggcatcaaagctgactggccaggagaattagggttccaatgagggaagtaaatgttcagccagagaagcttattgattggggagagatggtaagttcagttccgggcacattgaggtctatgtggaaatgtcaagcagacaagggaacaaagctaaggaaatgggagtcatgagaatggaagggaatgagacctccaagagggaggtcatagagagaaaaaaaaggttggggtcttgcaatgcta

SEQ ID NO: 202730 - DNA, 252 bp, Homo sapiens
ctggtgtcgaactcctgacctcaggtgatccacccgcctcagcctcccaaagtgcagggattacaggcatgagccacttctcctggctcaaagcagttttaaaagagtaatctgctgatagtatctaggttggattgaggagtgaagagattctgtaggtaggggttcagttaggaggttattgtagacatagagtagtaaatgataaggatccccaggtaggaccacttgcgaggctagacaccttgcgag

SEQ ID NO: 202731 - DNA, 491 bp, Homo sapiens
  misc_feature (1)..(1): n is a, c, g, or t
  misc_feature (12)..(12): n is a, c, g, or t
ntctagaggatncacattgagagaaaggactacatgagccccgaattaataccaatagaagggcaatgcttttagattaaaatgaaggtgactttaacagcttaaagtttagtttaaaagttgtaggcgattaaaataatttgaaggcgatcttttaaaaagagattaaaccgaaggtgattaaaagaccttgaaatccatctaatcaaagaaatgaaagttccatacaaattttagaagtgttttttctatttctgtgcaggatgtcattggtatttagctagggactgcactgaatatgtaaattgctttgggtagtattgtcattttaataatattaattcttctgatccatgagcatggaatatatatttcattgtgtcctcttcaattactttcatcaaattttcatagttttcttgtatagaactttcatttctttgattagattgatttctaggtattttatatttatgtagctactgtaaatg

SEQ ID NO: 202732 - DNA, 440 bp, Homo sapiens
cttatactctattgagaagaacagggcggggctccaagaggaagaaagaatacttcattctttctagataaatacttcattatctaggcaataaagtccccatttcccaaaacaccctgagttgagggggaggtaggagatccatagactacaattagatcagcgtggaagatatatttaatttttgtttggttttgtgggtaaggtgggaaatatcaatgctaaaatgaacatgagttgtgtggacacacattatccataatctttcccagctggctacaaaggttaaaagttggccacattctgattcacctcacttttcattcattctgtggtccaagagggcaagctatttactgatctgaatgtttactgatctagacattttaagtagggttaacctgaggccagtgcatggtggtgtttcatccaatccactg

SEQ ID NO: 202733 - DNA, 239 bp, Homo sapiens
taatataaggtgatttcagttaaccaccccactcttttttactcaattgttttgtgtatttgataagtcactagctatatactgatatccttagaaataatatataataatctttttcaggttatcaagtatcattagaactaactcagcccactagctaatattttgtttttgtgttaaaaggaaagttaagggtaaagcaccaggcttaatattgaaattatttcttttttcataag

SEQ ID NO: 202734 - DNA, 377 bp, Homo sapiens
ttcaatttctagaccaagtccttgtgtgaacatgtttttgtttctcatgggtaaatccctaggaatagtattattgggttatatgctaactatatactgtatgagaaactgtatctgttttctaaagtggctatatccttttgcattcccagcaatgtgttatttcttcgccaataattcttaggttttaattcagtacaagtgtgcttttcccttacctcatggagcataattgtaatgactcctttaaagttcttgtctgatagttttaacatctgggttatcttgatgttaacatttgttgattgccttttgccctgagaactggtcctactcctggttttccattattcatgctatgctgtgtagattctggg

SEQ ID NO: 202735 - DNA, 601 bp, Homo sapiens
tattcacagcactacataatttaagtgattaaattcatccccctttggtgaggttggggggagtttctaggagaatgacaccctcacctttggatgttgagagatgcatatttatggaagtgtgcatttcctctacctgctcagtctaaactgactttcttcctggacagatccttgtgatgatgacttctgtcacagatcacaagagagccagtcacaaactgggtgtctgcactgaagagagtcctttagagactgagtgtctgatggacctgtgtttgcaattgtctttttctatttatgtgacttcggaaagttactactgagttttatttcttcttctccttaaaatggtaatgataaaagtgaaaatacctagctcatagggtggttgtgagaatgaaatctgaaaacatctataagcaccctagctgcataagagctataccagtttttctcaaaatgttaagtacctgtgaagtcatctggagatctttttaaaatgcagacactgattcattttatttagttgatctagggtgaggcctgagattttgcatttctaacaagctctgaaatgatactgtgctggttcaagggc

SEQ ID NO: 202736 - DNA, 400 bp, Homo sapiens
cacacagatggctcgcttggctgtgcctccccagccttcgccacggccctgaagaacctctacatgagtgaggtggagattaacttggaagacctactgggagtgctggcttccgcccacatcctccagttcagtggcctgtttcaaaggtgcgtggatgtgatgatagccagactcaagccaagcaccatcaagaaattctacgaggccggctgcaagtacaaggaagagcagctcaccaccggctgcgagaagtggctggaaatgaacttggttcctctaggggggacgcagatccacctccacaaaatcccacaggacctgctccacaaagtgctgaagtcccccagctttcctgagaactgttgctttctggaccgggacataggacggagcttga

SEQ ID NO: 202737 - DNA, 196 bp, Homo sapiens
gtttaaatccattgtttctttgactttctatcttgatgacctgtctagtactgtcagtgtagtactgaagtcccccactattattgtgttgctgtctatctcatttcttaggtctattagtaattgttgtataaacttgggagctccagtattaggtgcctgtatgtttaggattgtgatattttcctgttggaca

SEQ ID NO: 202738 - DNA, 250 bp, Homo sapiens
gtttattgagcacctgctgtgtacacgcagcactgcacgccggttactggggttgatacccgtccatgctgctactgtgggggagggccgagagcagtgtttctcaatctgggttccaccattcctgacgggaatgtctaaacatgtgctttccgtgttcccagccatctaactgtgcctggcgtgagcctgtgctggttactgggcagccccgctgtgagtgggcacttctgggggatccaggtatgag

SEQ ID NO: 202739 - DNA, 483 bp, Homo sapiens
acagtcaggaaagttactactgtataaagacaaaggaatttatttcactggatgaaaatcaaaggtcatataatggcaggcaggcggtttatttacttcagataattaatagagagttcaccactggggaagcagcagagatattgcaatactctgacaataaatcccttcacaaagttgtctcccacctatgcctgttcctacagctatgtgcaggcagatcccttgcacagccttcttctctcctctcagcaacatctggacagcttcttggggtggaatatttagttttaggtaactgcttatgtaactgagctcttccttctggccttctttcctccctcagaggaactcccttaaaggtatcatgtgtcagatttcatcagggaatttgagaagtcccctggaatctccaagagaaagatctttttctcatatgggaaaattacaattaaaaaaactaacactctgccataatagttt

SEQ ID NO: 202740 - DNA, 352 bp, Homo sapiens
gaaagaatacttccatcaaattggaacatctgagttatgctgagaaaaatctttcttatgtaaggaagagatataatgttgaagattcttgtgtttaaaaagcctatatatatttttattgatgcattaaaacaccataaatcaatggttagccatcttaaagatttcagacacttatctttttgacaaatcatctatcaaagtgttttgcttgaaatttgaattaagtggagcaatatgacaaattattttaaacaatattctgctaacattatataatagcatagagacattttacaggcagtgttttagagacagtatccatagtctgcaagacacacaaaaagtatga

SEQ ID NO: 202741 - DNA, 751 bp, Homo sapiens
aatatttcggccgttcatggtatttctttctgaaaacggtaacctttcttcttctatgtagaacagcagtgcccggcttacagtggctctggaaagaaggcctgtgtacttggagacaccccagccagtggggtgcactccaggctctgagggcttctttttccaccagtgtggagagcctgtggaatgtcgtccgctcacagaccagcctgtgggggcagccggctggtcctcaggaaggccagggtgctcagaacagagattgccattccctgctgcactcctgccagcctccctgaggcgaggcacatcctgacgacagcccatgcgcatcagatgcctcctccatgggagtcaccaagggaaatccattctttccctgagacctctgtatgtcttgccaaggctccatgcacaggtgcggggctgcgtggatcagagcaggtgttctctgaaagaacaggtgccagggctttctgctgactgcagtgaaacgcctccatgcttggatgtcaggagggctctagctcaaaccctgtgattctccagtgcagtgaaatcccggaggacacagtgacagacctcccatgtgaccaggtctcccataacgcatgtcccttttgcaaaccgagctaaagccacactaccagcctgctcacacaacaagcgtttattatttctcaccatctttggaaccagtacttggtgcccggaagcaggctgatcacagggtggtaacctctggttggtg

SEQ ID NO: 202742 - DNA, 425 bp, Homo sapiens
cttctgctgctttcatattcactcctaaataagatttagaatctttttgtcaaatacaagaaaacacatccatagacaccattgtgcttctgtgttttacttctacatctctactttttaacattgttctagccaattaagccaagaaaatgaaaacaaaacaggcaggtaatgactaaaaggcagaaaagaatatatatgtgaaaataactaaaacatacaatattcaactggaaggttagattttgtttacaaattaaaaacacagtatccttatagaatcagtaataaccagttagaaaaaatccgaagttccactatttggaaagctgtgtcgtcgggtcttttcagggcctggaacatctggagcgactccccatcctgatcatacgtgaactgtcccagaagctgcccttcttcctgat

SEQ ID NO: 202743 - DNA, 395 bp, Homo sapiens
tgcctcagcctcccaagaagctgggattacaggtgcctgccaccatgcccagccaattttttgtatttttagtagagacagcgtttcaccatgttggccaggctggtcttgaactccttacttcaggtgatccaccctcctcggcctcccaaagtgctgggattacaggtgtgagccactgcacctggcctaaaataatcttattcgagaggaaaatacttatttgagagaaaacggggccgagcaattctacaggtaaatgaaaaatttcatgattgctctgcttgcttttcattttgaaaccataggaaagaaagatgatttatgggatatggtacaagtattaagaagagttatttttttttcttggatttgcaatgaccagcaagaagcag

SEQ ID NO: 202744 - DNA, 781 bp, Homo sapiens
gctgggcatggtagtgcatgcctgtaatcccacctcctcagtagctgagactactggtacatgtcactacacccagcttttgttttttaataaaaattttagattgcttaattctaggaaaacctattaagattttgattggaacttaattgaattaataaattagggagattatatatatatttttgataattccttgagtatggcatctctccattttttagtctttgaattacgttttgtaacttctgatttaaatttgtgactcttacgaatgcaacttttaaaaatatatacagcttttccaaatatgtaggaatgctgttgccttttcctctgtctctctctctctctgtctctctctctctgtctctctctctctctctctctctctgtctctgtctctcctttcttttcttgacggagtctcgctgtgtcgcccaggctggagtgcagtggtgcaatcttggctcactgcaacttctgttccccggggtcaagggattctcatcagttgatggacaaagttgttttcggccaggcgcggtggctcacacctttaatcccagcactttgggaggccgtggcgggcggctgaggcaggcggatcacctgaggctgtctcagcctcccaagtagctggaattacaggcgtgcacctccacgcccagctaatttttgtatttttaataaaaaaatgcaaaaaattggccaggcatcgtggcgggcgcctgtactcccagctattcgggaagctgaggcaggagaatggtgtgaaccc

SEQ ID NO: 202745 - DNA, 507 bp, Homo sapiens
tccgcaagtgctgacccgggtgcttccttgttgaattggggttttatagcttcttacctagtgtttccccacttctgtttttttacttttaaccctcttttactataatgtaatctctttttcccttaccttcccacagatgcaagaatttttctggtgttttttgactgctgtatgataaagaagtaatgttgaaatttaaaaattatttagttgattgaagattataatataaagtttatattaaaatattaatttatagaagacattgttttacacttacctgtttaatatgatctgtacttagtttttaaaaatattctgagcaaaaggtgatctcagtgcactgcagactccgcctcctgggttcaagcaattctgcctcagctattctggaggctgaggcagggagaatttcttgaacccgtgaggaggaagttgcagtgagccaagaccatgcccttgtactccagcttgggcaacagagtgagactatgtctcaaaaag

SEQ ID NO: 202746 - DNA, 437 bp, Homo sapiens
acctggacttacagacacccacagaaccccccaaaatacctcagcaaagtagcttggacctgaagcccctatttatagacccatagaaacatcctacaagagttcttgagacggagcccaccctgaccccaaacccagggtcacccagcaccataagcctcagtagaagtgtctgaatttcccttattaaaaaatttttttaatttgttttttgtagagatgaggtctcactgcgttgcccaggctgatcttgaactcctgggctcaagtgatcctcctgcctcggcctcccaaagcgttgggactacgggcatgagccaccgtgcccggcctgaattctccttcagcttggcccctccatagcccccaatcccattcctggagaagccagaaccttctcgccttccccagccctggcctcacatctggcaggcctg

SEQ ID NO: 202747 - DNA, 665 bp, Homo sapiens
  misc_feature (584)..(584): n is a, c, g, or t
  misc_feature (602)..(602): n is a, c, g, or t
ggtgccaagaccattcaatagggaaagtaccctcctttcaacaaataagtgcagaaaactgaatatccatattaaaaatataaaaactcaaaatgcatcaaagggccaaacttaagagttaaaactatacaaattttaggaagaagcaagaaaatattcatgccataggattctggcaatgattccttacatataagacaaaagcacaggccaaaaaaaggaaaaaaacacaaagatgacttctcaaaatcagaaactatgtatatcaaagggcacttaagagagtaagaagaatatccacagaaagggacaaaatatgggcaaatcatatactggaaatcctgattttatttggtttcactttattgcacttagcagatactgcgttttttacaaactgaaggttgtgacaactttgtgttgagcaagactattggcaccatttttccaacagcatgcacttgcttcatgtttctgtgtcgtctttgggttatacttgcaatcaatcaatcaatcaatcaaccaataaatcaacgttgtgtatgctgtgactgctctattgaaatggtcgccaatccggcgancatttcaataaaatcccnttcacactgatgggtcctcaccaccaaagctcgagggtttctcagacaccgtactatcatgct

SEQ ID NO: 202748 - DNA, 517 bp, Homo sapiens
ttgtgtttttttctttctttctgggattccttgtacacacgttagattgtttgacattgtcccacagctcttcaatgccctcctctttttttctccttccattttagttttagataatttatgttggcctttaaaattattcaccagttcttccttgttgagtatacttctgagccagtcaaaggcatttatctctggtactgtttgtttctagcgttttacgctgacgttcttgaaattcctcgtctgtagtacaacatttcagtcatctctgagtgtgcttctgttgatgtttctctctcttgacagtgggttcagatttctctagtgcaagacttttcaacctcaatatttttgatgtgttgggccaagtaattctctggggggaagaaggggctgccctgctcgttgtttggtgctgagcagtatcccgttggacaccagatacctcccctatagctgtgacagccataatctttcacctgtgccctaggccatagggttcgcttccctccca

SEQ ID NO: 202749 - DNA, 686 bp, Homo sapiens
aaatagtattacagcaaacctacctcaaacagtttttacctatgtcaggattaaacttaaaattcttggcataccatactttttgcattcagcttgaattttcagacttaatgcttggcatatttattacagttagcttgagttttcctaaaatcaattataaatagccttcattatctgagaaaatatttcaaaactttgtaacaagaaacattaacaacctacaccttttttcctggatctgagaaaaaaaaacctgattttagcagtgtcttctcttgtgtttaaaatatttgggtctgcaatcatgacaaagaaaatggaagttcaagctgcacctatctagcaactttcagtgacattaacagatgaaagtgcatctcgaaatgacttttggctcaagaacaaatatatacttttataaataggttagcttctttctcagacaacttcatttaactagaagaaattaacgacagagagttacaactgtaacctgagggtaacacttctttataagaatggataataactaaatgagtggccctattcaggaaggaaaatttggcctcagaagaaatccttaggttttactgtaccagtctgtaagtgctgctaaagctcagtgcatttagatcatgtactcttaatatttttctcatgttcaaactgatgatgaaatgtga

SEQ ID NO: 202750 - DNA, 480 bp, Homo sapiens
aagttttagtatgcaggatgaataagttggagatctcatgtacagcatggtgactatagttaataatactgtattgtaaacttgaaatttgctgagagagtagatggtaaatagtcttaccacaaaatgaaaagtaactatgagaagtgatggtatgttaatgagcttcattgtggtaatcatttcacaatgcataactatatgaaaacatcacattgtacaccttaaatatatacaatatttatttatcaattgtaactcaacaaagctggaaaaggaagaagagagaaggtgatgtgaagatggaagaaacagagacagaaaaggtgctatgcttgcttctggctttgacgagtgaagccaggagccaaagaatgtagtcagcttctagaagccgaaaaaatcaaagaaaaggtttttctcttagatcctccagaaggaacacagccctacagatgcctgacctccagaactataagt

SEQ ID NO: 202751 - DNA, 584 bp, Homo sapiens
cacttgatgtagttattcatccactacaaaaaggtgttctaatcacttgcagtgctactgaaagcatgtcctgtgaatgttacttgtcagtgacaaaataggtacagaaattgaaataagagtttagaaatttttagagccgtttgatggagtagctttgtgaatctaataattgaggcttacattttgtatgtctttatttttctcataatttatttttattttataaacatgtctgtttgcaactcattagaactttaaaaaaaaaaactagtcattcactctaggtagagtagaagtactgactatgaaggatctttaaaggtcaatagtggtcctaatacgtaaaataatttgctcatatggtgtatttaaactattggcaactatgtaaaagggggaatgggttgaccttcatgttacaaatattaatttctcctgcataaaagtaccctcattgaaatagaggatagagattataaattatttttttctgtcttctttttacctagataagaatttaccacatttagtctggtaaataaccatctgtatggtcacagagagccacacagaagtgaaaa

SEQ ID NO: 202752 - DNA, 278 bp, Homo sapiens
tctgcttctgtttcctcatctgtaaaatggggataatacaaggttatatgtcaatccacataaggtgctgagaacaatacctgatccatgggaagtactctgtaagtgtatgattaaataaaacaagtaaattccaagaccaaggcacccatgaaaatgctgatcatgccccatccctgaagggcaggggtgagcaggcttagatgaagtaggctgtactcctcctgacatcaaccccaccagacgggcaatggagcaaaactgctgtcccctccata

SEQ ID NO: 202753 - DNA, 486 bp, Homo sapiens
tccccccaccccaatttaaacttttctctgattataaactatcctgtccaattatatgactcttctttaaactttttgttgactattttctgatgtcttttacagttcaatttcaatttgacgttcattttcatctgattttatttgcaatttcactgttatgcagtttgtcctggacttcatatctttagcattataatttggaaaatgtgtgtacacatcccaaatggtgactctcagtcacttagccacttagtttatgttagtttctcaatagaaacactactgatattttgtactgaatacctctctgtcgtggaaaaggggcacttttctttgtgcattgtagggcattggcagcacccctggataaactatccaccctactcacctctgcctccgcttgagacaataaaaaaaatccaatactgtcaagtgtcccttggtttggaagcaaatcacccctaattgaaaaccattggttta

SEQ ID NO: 202754 - DNA, 366 bp, Homo sapiens
ggaagttgtagggaacatggacaggacagtgggagaagggtgccacagagcaccccagaggctcaggcattgaaggcctcaactgatgtcttcaggtgaagacacaggtggggctgcaagtaggactcactgaacatctaagattttccttcccttcatgccttttctctgttggttctgtgaatgctaacagccaggctcacagctcctaggcaggagattgaaggactctactttcatgaaaatgacctgtccaaaagacaatgccagttgggactttctcacacgtagctctgctggtttaacctgtagcgaaatttaccaatcagaggctctgcgcatggacacagcttctactgagtgttt

SEQ ID NO: 202755 - DNA, 488 bp, Homo sapiens
tagatcatggggggtggtttcgtccatgctgttcttgtgatattgagtgagttctcatgagatctgttggttttataaggggctcttctcccttcacttctcccacacactctctgtctcacctgctgccatgtaagacatgcctgcttccccttctgccatgattgtaagtttcttgaggcctttccagccatgtgtaactgtgagtcaattaaacttcttttctttataaattacccagtctcaggtatgtctttacagcagtgtgagaacagactaatacaataaccatgttctcttctttctggagatctccagccacatttgacttccaggtctgtgggaagcagtccaaggtgcaacctggaacactttcatttggcttcttcatgtagaggaacatttacatgtcgctgcttgttccttctacccatggcctacacacactgccaagctgtcaccttccctgttgtgcaatgtgtttgcca

SEQ ID NO: 202756 - DNA, 387 bp, Homo sapiens
tcaaaaaacaaacaaaaacagaaaaacccaaaccaaaccaaaccaaaccaaaaaacccctaacacttgcaaatagaaagctatgtggtaataacatccattaacttgacacatcttgttttgacatcatagtgtcacttactgtttcaatgaaatggtaatgaaagaatataataaagtattgcaagttgaatgcttgaaggtaattggaataaaaagtttaaaaaaattttgctttttccgggacttcaatttgaagtaaatgagttaattactacatggtaagtgtcataagagtacaatatttattagcctgcagtaggtacacgtggacaggaagacttttcagcggtccactcccccaagagggaattttcatttccgcgag

SEQ ID NO: 202757 - DNA, 179 bp, Homo sapiens
agaaaaaagctgcagaaaataattacaaaaaaagagtgttaagatgtaaacacaaattcagagattcaggagcacaaaggattaagttaagggaaaaaagagttatcagtattttcttattcattatggagagcaggatgaattcttaaaaggtcaaataattgtgagtctgatatatc

SEQ ID NO: 202758 - DNA, 317 bp, Homo sapiens
tgtcccaaacttgatgaaaaacatgaatctacacattcaagaagctaaacaaacttttaagtaagataaattcaaagggatacacacaggaacacattataatcaaattgttatatgacaaagacaaagagagaatcctgaaaacagcaagagagaaacaactaatcatgtagaaggcatcctcaataaaagtcacatctgacatcgcatcagaaaccatagagccaaaggcaatggaattatatattcaaattactaaaagaaaagcattgtcaaccaaaaattctatatgtgccagaactatccttcaaatacaa

SEQ ID NO: 202759 - DNA, 642 bp, Homo sapiens
gcatgttccccaacaggagtgaggacaacagtggcagtggcagcaacaacagctgccacttaacagagctcacccagtgagccaggaaccgagccaggcacatcacacacgatccacttaaccctcagagcaacatctgagaactgcggttcagagaagggagtgtcttgcccaaagccactcagctggtaagtggcaaggctgatttccagcttgaggtgtctgactccccaaaatcttcctttttagtgactgtgccctactgcttcactaagaaaagcctctctcccacctcccgcttgatagctcaaaattaatatcttcttttctctcctcttcccttccctcttctacctctccactcccgcaaacgcccattctcccttctctctcactgttccttcccctgggctctggtacacactcacacagacacctcaggatggacaggaagctgcctttttctttatgagtgagggtttgtgctgacagcccaatccgagaggtggcagtcagacacagcaaagcctgcagtgtggtctgacttaatgagcccccgcagaagcaggaatggaaggctgtgtgtgtgtgtgtgtgtgtgtgtgtgtgtgtgtgttgggatggagaatgcagccaagggtt

SEQ ID NO: 202760 - DNA, 398 bp, Homo sapiens
cagaaataatagcaaattagatcagattgttgggtgaccttacagtcacttacctgtctgtgccttcagtttccttgcttaaaaggggctaagaacagcagttacttcataggtctgttgtaaggacagattgagttaatgcatgcaaaccacctggatcactgcctggtacatagtaaacatgatgcaagtctgctttttaaaaattactgttaaattcagcataaatgaatttctgcaggagccaggatggttcagaaaaaaacaatgaacaaaacatgggctttggaatcctggttctaacactatcctagctcaagtttcctgtatagagcctctaaggttgcatagtagggttgaatgggagtagttataattctagaggagaaaaaaaaaaa

SEQ ID NO: 202761 - DNA, 837 bp, Homo sapiens
cacagtggctcatgcctgtaatcccaacactttgggaggccatggtgggaggatggcttgaaccaaggagttcaaggccagcctgggcatcagagtgagacccagcctttacaaaaaattaagaaattagcttggtgtggtggtgtgcgcctgcagtcccaactactcaggaggctaaggtgggagaatcacttgagcccaggaggtcaaagctgcagtgagctgtgaatgtgctactgcactgcactcccacctggtaagaataaaacgccgtctcaaaaacaaaaacaaaacaaaaccaccaggaccagaagtcaacaaaaatcttatacaacactgcgcaatttggataacattaagaggtaatgcatgaaaaaaagagtttaatcaaaacagcatctgagttggttaaaaaaagttcaatgttttgtttgtttgtatgactctaagtcagagattacaatctcaaatactcacaggggccagatgagaactgcaaacaaggcaaaatggagaactcctggtccatcactgttacataagccagcattaccaaattttctcaaaagaagctaaaaacacagattgttatgcactctcaattaaatgatgctaactaatttaaaaatattttaaatattgtgcaggtccattgtgctgtataacttcttctaagctttaaaagtatgaatacagctggatgtggttgtacgtgcctacagtcccagctactggggagactgaagcaagaggatcacttgagctcaggagttcaaggttgcagtgagctatggccacacatgtgcaccaatagaggaagaccctgtctctttaact

SEQ ID NO: 202762 - DNA, 741 bp, Homo sapiens
agagaaggaggtggaagaagaagaaggagaaggaggaggagaaggaggagaaggtttgttgagcccttactacgggtaagaagcaatcctaatgtttcttgtacacaattttatttatgaatacaacaacctgaagaggtaggaactgatattcccattgtacagatgagaagacagatgctcagagagcttatttgtctgttgaagccaaaacctgtgcccttgaccacaatggacactatatcttctgagctccacttaattagagaatttggatcaagtgactaaataaatcacacaccacacacattaagatacgccagagtgacagggacattaaataaatcaagtatccatgaagtttgctgccttccaaatcagccccctattcttttgccctaagatatcccatcatagtctgtttccttcccttctctctttgccctcaacctttccttccctcttatccatgggaatgactctaggaatcctgttgagtgtatgtgtgtgcgtgttcttttctttttctctcatgaatattacacttttattagccagctatacttgtgttgatgaaaaagacaaaatggaattttgttttcctttaacaatcaagtatgaatggtctgcttacaggatgtttcttcttggggttcttggaggtaacaaaagctcatcattaaacaggtagctatcatttcttacatgcttaagtatcatctttcagataattcttatatc

SEQ ID NO: 202763 - DNA, 208 bp, Homo sapiens
agcactgtgctgagtccttcacatacaccagcctgtctttgtgcttgtaacagtctataagggaagcattattactcccattctacaggtggggaaattaagactcagagagaaaaggtaatttgctcaaggccttgtagctagaaatttggaagagctaacacataccactcttggcatagcagtttagacatggacagctttagga

SEQ ID NO: 202764 - DNA, 432 bp, Homo sapiens
catttgctttgtctgcaataatttttgccactataaaccattctgcaataaacctccttaggtaaataggtagctggatatgtaggtatttttctctctttctcatgtactggtagttatattctgaaatacgtttttaggagtgagattgattaaccaaagaatatattaataatttccagttcttatactattagtgatttcgagcatcttttgatcgtaggctttatgatatcttttgctcttcccagaagttttaaatttttaaatgcattatgtgtccatgtttaatacttctgagttccggccaggcatggtggctcatgcctgtaatcctagcactttgggaggctgaggcaggtggattacctaaggtcaggagttcaagaccagcctggccaacatggtaaaaccccgtctctactaaaaata

SEQ ID NO: 202765 - DNA, 424 bp, Homo sapiens
cagggcatgttttgtcctgggtgattcactcgcgatgactggggcaacactggtcccgttcaggtggatgaacgtctcttaggcactcagcctccatggatcactcttctctgtatttaaaaatattttgtttttggccggacgcggtggctcacgcctgtaatcccagcactttgggaggctgaaggcgggtggatcacctgaggtcaggagttcaagatcagcccagccaacatggtgaaaccctatctctactaaaaatacaaaaattagccggacgtggtggtgcacacctatagtctcagctacttgggaggctgaggcaggagaatcacttgaacctggaaggcagaggttgcagtgagccaagatcgcaccactgtactccagcctgggcaacagagtgaaacgctgtctcaaaaaa

SEQ ID NO: 202766 - DNA, 352 bp, Homo sapiens
gtcagctgactccactgctccaggcatccttggaggtgcttccccatgggctggggacagctcacttgccgcactgaccacatggtccccctgtcgcagagggactctcctgggattgaccctgtccaggaggctgcctccacttttgggatgcctttcttacaaaacactcagacgtcagagacatcacattctgtggggcagatacctcaatacccagtatgtagtatcatcctcctgagcacatccagattccgtgccctcctctccatctcccctgccactacggcccaaggcaggtggaattctccaagggccaaggacgtgggcttcagtgttagggaactaggtc

SEQ ID NO: 202767 - DNA, 158 bp, Homo sapiens
tctgtgaatgtatgaagaagcctgttgaaattgttgcaagataagcaacatccttattgttggagtgatggagaagtacttactaaataaggctaagtggtgttagaccatttgggagaatgacagcccagatgttcgttcacttcttttcctaattg

SEQ ID NO: 202768 - DNA, 506 bp, Homo sapiens
aactcaaatgagaaatgtagacccttctatgatttccaccgtaaacctattcataacattcatgcacattgcatattataaatgttacagaagctggaagtagggtggcatgaaagaagttattcacattcctgaaatataaaaccctcaaactgtatattgatccatcccgagttgcaaaatattcttcacccacctccctcctcaacaatgaaagtttgtggtcttcatgggaatgagtcctcagtcttcatcttgcagactcctttcttttctcttctcctctcacttctgcgctcctcagaatacctgtgagaatcttaaatcttctcagtttgttttacagagtcagagtcattgcattccccagcaaaacttgaccccttagggacacacttcaaatccatgaaagagctcagcaaaccttttgggaagaaaaaagtattctcccttgtgtgaaacatgaccaacattgattaaacactaataataataatacagagaac

SEQ ID NO: 202769 - DNA, 465 bp, Homo sapiens
  misc_feature (12)..(12): n is a, c, g, or t
  misc_feature (14)..(14): n is a, c, g, or t
  misc_feature (25)..(25): n is a, c, g, or t
  misc_feature (39)..(40): n is a, c, g, or t
  misc_feature (52)..(52): n is a, c, g, or t
  misc_feature (54)..(54): n is a, c, g, or t
tgcagctggttncngtcattattcngatcagacggagtnnttatttttgaananggtcataattgttgatgtttatgtgcctctgaatgcaaggcattgtgctgggtggtacccacagctagttaaatagagccttctgggtcaggagcttacactctaaaatggatagtttcaacagaggaggagaggccaggacactcagagaaaaagctgcagcacaggccggctggagaacagtggtcggatctgccgggtcacttggggaacacggtaaccacttcatagccctcgggtggtgcgactcactcccaggcatgtttctcacagtagatttgatcctccacaaagaaatggtccctctgtttcaggttggtgcaacagtcagtgcacaagtaacattcgggatggcggtgacggtcccacagcttcacgaacacaccgacaatgccagaaccacaattatcg

SEQ ID NO: 202770 - DNA, 538 bp, Homo sapiens
gggtctctcagttgtctgggttttcagcgggcttcccagggacaaaaatggttatggctagcgatttctacctgcgctactacgtagggcacaagggcaagtttgggcatgagtttttggagtccgaatttcagctggatggaaagcttagatatgccaacagtagcaattacaaaaatgacgtcatgatcagaaaagaggcttacgtgcacaagagtttaatggaagaactgaagagaattattgatgacaatgaaatcacaaaagaagatgatggtttgtggcctccccctgacagggctggccgacaggagcttgaaattgtaattggagatgagcacatatcttttttttttttttttttgagacggagtcttgccctgttgcccaagctggagtgcaatggtgcgatctcggcacaccgcatcctctgcctcccaggttcaagcgattctcctgcctcagcctcccaagtagctgggattacaggcacaagccaccacacccggctaattttgtatttttagtagagacgagg

SEQ ID NO: 202771 - DNA, 430 bp, Homo sapiens
cattttccaagggaacataaatgttatgcaaaagttctggaaagctccacaccaatgtgataatccttcaagataagccttcctccaaggtaacccgttggaggaagagatgggtggagggtgagtcacagggggctcagctatttgttaactgatacctagtaattgtacatatgtacgggcccatgtgacgttttgatacatgcacacgatgtctaaggatcaaatcaggataactgcgatgtcgtcacctccaacatgtatttctttgtgctgggaacactccaaatcttctcttgtatattttgaaatatgcaataaattattattaactgtagtcaccttggctcttctgtaaagtaactttttttaaaaacttgtattctttatctaattagaaataaacgagctggtgaaattatggctctca

SEQ ID NO: 202772 - DNA, 530 bp, Homo sapiens
gttttacatcaaactgaaatatgtaattattctgtcaaggttcaaatttctttcatcgcttattttttaagctagtactttctacaattatgtatatgttcatgcatatttatttatgttgctgtttttaaaaggaatttattttaaattacggagttttaaaataaggacatttgaaaatgtgacatttctaataccccgtgggtttttatgttcatccttgtaaatttacgtttaaaatatgttaaaactttaactgaagagatatatgttaaaataaattttggctttgaaattatatattttgcttgaactcttggaatgtctcattttagactaaatgtttcagggtttctcaaaggtagattttttttgtgtaagtcagcgttataaattaacttactttacagtttacatatgtagtgtttaagtgtgctgcaggaataaaattaagtgtgaacatgcaaataaactttttcattataaactatcttctattatggcagaaaataaaattataaataaacagt

SEQ ID NO: 202773 - DNA, 302 bp, Homo sapiens
aaatacacattttacaatgatttcatttctataaaaattcaaaaacaggcaatctgatctatggtactggaaattacaatagcagttctcacgaggagcaggtagtggctcttggtagcactgtttcttaatctaggtattagttacacaaaatgtttgttcattttgtaaaatgatttgtgctcttctgtatgttatacttcagtaaaaacaacgtttttctaagttccatatcaaaacacaccatagtgaaatttatggggatagagaggagatgcaaaaagctttggttgtggctgggt

SEQ ID NO: 202774 - DNA, 534 bp, Homo sapiens
tggatagaggcaggttgctatttttaggccatagaatgacagtttcacaatttatatttgatattattacctgccatggggtagaataaaagcttggaggcagctgtgtggggacatttaaaatctaaaattaaacaaattaatttatgtttaattcaactaaggcctttgctaattttcaagtgacattaggcctaaaagctaaatcacagtgagccatcttcactttttgcagatgaggaattttctaacattagaagtatttttagcagtcttaaaattcagtttgaaagattaataagtgaccacaatttgtcaggtaattgctttaattgttaattagccagtgacaaagcaagttgctgttgtcctaatggcagcagtatgagtacttgttagttttaaggtagaaagagaacacttttgcacggtaatcttttagtgcagtagttactgattgcttccatgctgctaccattattacctttacttaattttgcttgcatcaggaatagcaaagatcctttcaatcac

SEQ ID NO: 202775 - DNA, 765 bp, Homo sapiens
gcctgcaggactcagcccagccctcaaaacctggcacccagctggcacccaggccacatccctcagcggcacagttaattgaaaatgcagctttgaggagtgcaatgtctggggaaagactgttcccagaggggcaggagcatctggggcctctggtggctcccagggtccccatgggaggagccctgtgccctccactcccaagtctcagttgtgccatctgtaaagtgggggccgccagggaggctggaggaaggtgacgggacttcaggccttggaatggggctgagtgaggggttcacatggccaccccatccctctccacgctccacccgctggctgcatccaccaggcggtgtttctgggtcacatttgctgcaattcaggtgctaatgggggcaggaggctgcagggggaggggccggtgtctagtggggcagatgtttctcaatggagaatgctcacagcggcctgcagagggggtctggtgtggcctggggctcctggggttgggatttacacagtgagcctgggctttggggcacagctgctgctgacagagggtcttggggtctgggaaggtgcttaaagcccggcccccatgcctgagctcccacacccctgtttagggacacccagatagggtgtctcctgcaggaaattccccacataattcatttatttaaaaaatattttttgccgggcacggtggttcatgcctgtaatcccagcactttgggaggccaaggtgggcggatcatgagg

SEQ ID NO: 202776 - DNA, 532 bp, Homo sapiens
ttcaccaaaggggcttgcagtggtttattaaaatggctgcatgtcctctggcactctcttcatggagaagcggggtctatgtgccttctcttggagttggatgggcctgtgctggttttcatccatggtcagaacatgctgtggaagcccaggctccccaggaagtccctgtcttggtggccctgtcaacagcctccactgagctgagcttttcagtctacccagcctgggtgccagatgtggggaagtttccagcagggaagccttcagccccagccaatgaattcttcccagctgaggcccagacatcggggagcagagacaagccatcctcatgccctgtgtcaacctgaaataagtgaaaggattggaatcagctttaaagagtttattcaagtaaaaagctgggaatgaccattcagaaaacaaggattccacagaaacggagttagtgctctgaagtgaaaagttaaggtctggcttatataggaggaaaataaagaaatttaacaggattaaaacattttctata

SEQ ID NO: 202777 - DNA, 506 bp, Homo sapiens
caatctagaccagaaatctcaaactcctaagtaaaacaattataagcacttaacacctatcttatcctgaagtcctggaatgtcagagttggaagagatcttagagctcattttgttttatctcctcattgtatggataaagtgtagtgcaaaagagtgagttctaggccagaggtaggccaataatttaattttcccaactcacgggccaaggttctttccactgcaccataatactgatccccaattttaaggttccttgtctgtccttctaaaccatcaattcactcaacaactgcttaagtgtatatagtatgtgcacatctgtgccatttgttgggtatgcaaagtctaaaagacagggtgcctgccctgagatgctcatgacctaattcaaatgcatccttcctgtccctctccccacttctcctggatcttctcatctgtatctttttccacgtttgtaaatataaattcaatagaaataaacagttttatatatggca

SEQ ID NO: 202778 - DNA, 694 bp, Homo sapiens
gtcaaaaaactttattgtgcttttggagatattttgaatttttgtagtagcattttttagttattctaaattgtagaagctgcttctgtttttattttgtcttctatcttttcttggagtgatcacgcagaattttaccttctatgactccaaagcagcatttccccaagtatgttccatggaatatgaacagatatcatatgatgtaaaagattttgtggttgacacacttgtaaaacacgtagacaaaattaaacattttttagctgtagaatgtcttaatcatttaaaccaactaatctgtacctcctcattaactggtccaaaagatttctgtggctttttggtatcagagattgctttgacattattatattctagattatagagtatattaagcagattcttgaggaaattagttgtttctacagttactaattattgacttatatgtgtttaactcaaatataaagtttgttttaaataggatatttttatatgtgtaatgagcaactataatagtatattgattacacttcagataatccagaaagaatgactgtagggccagccatggtggctcatgcctgtaaatctcagcacattaggaggccaaggcaggtagattgcttgagcccaggagctggagatcagcctggggcacatggtaaaatcccatatctacaaaaaatac

SEQ ID NO: 202779 - DNA, 788 bp, Homo sapiens
gaggtcacctgctgcaagaagcactgtgttttctgtgcagcttaatgagagggagcatatcatttcaggactctcacaggatgcagtgttactgagaatctcatgaggcaaatcctaaatgccaggataaatttgcagagatagaactactactttttttttttaaatttccttttgttatgacttgaacgtgtaaggtcatgcttcgagcctgctatcctatagctctcaattctaaactagttgcaagtatattggacttcttgccctgacccctgtccctttgataggccaggtgaatccaaatatgcccgagtgcatctcacagaatacatctgattctaggatgggactagaggtctcctggtatttagaactgcaaaatgaggtagcaaaagctctagtcatatgcctcccatttatttgacatatcatcacaaacatgtccataatttaccaaggttgatccactgcctactacatttgtgtgtgaaaatgtgtcatgctttgtggaaaaagtgaaaatagttatctgtatggtgggtgcactttgagtgactggggtggggtatgagcactgtcttacaaaaaagtcaagagtaatatctgacaaagatactgtcctttaccctggataccaacagatgttcttgttttcattcaaaattacaattatcattgaagtgcacagtggcttttaattgagacagataaaacgtaacttcaagtattgaagtaatttttttttactgtttttaagacaactgaagatctgagcaattcttggc

SEQ ID NO: 202780 - DNA, 594 bp, Homo sapiens
ccatacttgttgttcatgtctatttaatactaacagaaagctgtgatgatcatcctgaatatggatgtccaaatatgacttttataagaatattccaggcagcaagcaccactccttgttgtagcctttctaccccttcttatgaatggaatcatgctgcaaaaatcaaagttcttaccaattttcagtcctaatgtcacacagctaaataattacattcatgtcatctttggaatgcaacatattgctaactttttttttaaatcctggtgaaatagctcaaatattggtaaaggggagaaacttccaagcaagtagctgcaagagaaacatgaaaacagtgtaattctgatagttaccaggtaataaagttagtggtctctataaagaaattatacctttcttcaagaaagttaatgcaaatgatttttttttgcctcactttgttttctctaattagctgacatttaagtgggttgatcttactctccactttccctttgacttggagaaaaagaatttgtcagacactgctgacttttcaaagttatcaccttacaacttccaaattaagcttccggattaagcttggtc

SEQ ID NO: 202781 - DNA, 703 bp, Homo sapiens
catcctgggagccggaaggggcgttgcccccacagggcaaaccttcccccggcctcctggtcggctgtttagagctgagcaaggccaagtgggtgcagctgccccaaccctccggatcctcgtctcccggaggcctgcagacccgttggctttccctgtaacccaaaacaaggagagagtgggaggtctctcgggcgttctccagatgtggttgagactttcccagtgctggggtggcgggtgacatttgtaaataaatgccagttggtccgggtacaaggagaacactatttaaaccccaaagacatcttttctccctgccccacctgaaggcgatattttagatcgccggggccaggattgaagcggggatgatggcagcaaatttgttctgcacaggtgacccggcctgtacgggcgccaagtcccagatcccgcaatcagagcggccagagagcagagaagagacctagaggatctgcaagctgacctatccacccgagactctccgctctgagcgaccccagggtgcaggcgccctccacgcgccacctcctctagcggtcccccagggtcccttcccagtcctcgcactgccctagggcttgcttggttcccagaccagcgtggaaggccgctgggccccggaacccaaggtccctctgcttctgctccactccccagtgcccagcgcctgggaatt

SEQ ID NO: 202782 - DNA, 1201 bp, Homo sapiens
gtgggaggaggcgacacaagatgggaggtggccctgtctcttgggagcaaaggcagaaggaggtggaggcagctcagggctcggaggagaggggtccgggctccttggctgtgtccctgctgtctctcgctgtgggtattcaccgaatctctcccatcctcggttttcacatctgctgcatgcaggtcctcatggttctcaagtgaggcaggtggtgagcccatcaggccagtgcccagggcttattctggggacagctcctggagaggaagggctgcctccctaaggactcctgccctgccctgggtgcaaggggttccacctgctgcccctcccccactccccagctcgcctcaggcggatagttcccctctcactccaaataagagccacaatgctgacagtggcccccaaggccctgcccagcggtccccagcttcctctagctacatctcccggccctccccttcacccactcctgtaggcgcctcgaacgcgcctcagccctgctcctcccctgcctgcagcgttcctccccaggtctcccccggctctctcacctgcttccggttttgctcagactgcgctgcctcagtgcgcccttctgtcaccatcctgtgtatagtcggaaacccctgctccctttccctgcactgaatcttccgtgtgctccttttctccatggcatttgttagctttggctatcctgtctaatttgcgtatgtatttattttttattttgctgcctgttccctcattcccccaactccccaatggcagggagttctgttttggtcactgctgaatccctggtgacctgagcagtgatgatgcagagttgttgtgatatttgtggaatgaatgaatgcaggattttttgttttaccttcacttggcacaaatgctgtggttctgttcaccactcccccctgaagtaatgaaagctatgggcccatccctgtgctgagtggagctggggacacagtgggggctaggacagactgtatccctgccttgtggaacccacagtccagtgggagaggcgacattacccacatagtcatgcaggtgacagaggcaagtgctgtgaggggaagggaaggctgagctctgagagtccgctgctcgtgggagaggggtggtcagggaaggcctccgtgaagaagatgggtgaacagagtgccaggcaaggggtacagca

SEQ ID NO: 202783 - DNA, 511 bp, Homo sapiens
agggtaagatgcctgtaggatttctaagtagaaattccagtagggaggtggaagtcaaggaatggaactggaatcaaaagaaaagtggaggctagtgggggaattcagctcaaaaaatcaaggcgtggaaaatcctgataagagcggcagttctcacttagcttgcatcacgatcacctacctaaagggcttgtttaccagagtttctcctttactcggtgtggagtagggaccaagaatttgcatttctaaccagttcccaggtaatactgatgcattaataaccactggggtagagcaaaagaagaggagccctaagaggaaccctgaagaatgctgtggcgaggagcaaagtctgagttgcttggtaactcttaaaatcagaataaccctgtaactccaggcacagtggggagacaagctaagttccaaatcacagcccaaaccgcagtaagaggaaaaatactgtccagggctttacttcattttgctgcctatcaatgaagagtta

SEQ ID NO: 202784 - DNA, 390 bp, Homo sapiens
aacaactgtggctggtgctagcgcaggcgctagatgggatcttagctggtgagtctttctagtgacatttcggactccgaatcagagcacaggctggcagctggtgcctgtctccccagcaggaggcgcctttccccaccttccccgtatccttgccacctcccgccattcctcagcctgtggtttcaggcacctaaaaacaagacaaaaagccagggtgctttagtctctgtcagcgaaagcaggggtttcagagacttcagcccagatccagtccgcgtccagccctcagcctgtgtgctgacaatgctttacattttgaaatggttggaaaaagtcaaaagaataattatattcggtggcacgtggaaattacatgaaattcacatt

SEQ ID NO: 202785 - DNA, 527 bp, Homo sapiens
aggtcatcagggagtgcaccttgagatcatcgttggtttggtccgcgagccgaatgcacatgtagaggatgtaggcggagagacagggcactgtgtccaacagcatctggggcttcaagtctgtcaccaggttgaggatgaggagggcctcgccctctttgcggcactccaacatgccctggaaatccttttctttccactgaactgggacctgcctgttgaactcatggcgcttcctctcactctgggccaacgcctgggcagcttcttcatgtaaatcttcagttgcttttagagcttcctctcattcttttcctcttactttatttttcaccacagagcttcctatcaactagtatgttgaatattttgcttattaactttgtttattgtcttctccctcgattagaatattagctacttgagtacaaggatttgagcctgttacattcactgctgaattttaggctcctggaagatacccagcattcaatagagaccacacaataaatatatgtcaaataaat

SEQ ID NO: 202786 - DNA, 593 bp, Homo sapiens
aatagctatttggagactcattggccaattaaatattgaaggaaaatttttaaatgttttataacaaatcaaaaagttcatcaggctctttagtgtcatattaccatattatctttccatctttgattcttctagacattatacatatatttgctttgtgaaattcttaattatctttttatttttcatattgtttcttcccggatcattcaatagatttagtagcttgtatttaagagagggttagtagcttagtagccgggcctggtgacacacatgtgtaatcctagccactcaggaggccgaggcaggaggatcacttgaccccaggagttcgaggctacggtgagctataattgtaccactgcactccagccctgggtgacagagtgaaactcctctaaaaattttaaaagaaaaaagagagagagggtgagtaaagttgctgcaaaggaaaatagtatatataaaaattcttggggcaattgtgtatgtaataaaggtgttgttgatgtctgttttggtggcacagtgtagcttgttcctaaatagttggtcctcggttagcaggactcagatggtgggttgcaagc

SEQ ID NO: 202787 - DNA, 519 bp, Homo sapiens
catggaggccatgcttcccaaagactacatccagccaatgactagaaagaacagagatattaaagcaggtctttttctgctagacatgagatttctcccataaaatttggctcaaaaattctgtcagtctttccatcagcctgaccagtttgctagctctttcggcttctttcagctccctccctattttccctgacaggtgttaaatatctaatcttgtcttaatatctgcttttcagaggacttggaccaatgcaagtgataataaatgtgatccaatcaaaagtaccataaaataagaactagagactgactcaactgattgtcttgtgggtgaagagattgcaatcctagctgataggttggacatggatagtgcctggcacacagtgactgcttaattgctaaagatttcttggggaccacctaagaatatatccctgtggatagtaacacagttgtaggtggactgattaaaaccattgaaaataataccttcagaggcaaaagaattgactg

SEQ ID NO: 202788 - DNA, 252 bp, Homo sapiens
tcctcacgccttcaagggacagcgtttgatcacaaagatgcgtattctaaagcaagctttcttttgagctgtaatttaccaaaaaaaaaaaaagaagaagaagaagaagaagaagaaagaaagataagacatctaccttaatatcagccaaacacatcactgccagtttggaaacattgcgtttaaagtgaagtatattccacggtgaacaggaaggagccgccgaagtattcagcagttcatattttccca

SEQ ID NO: 202789 - DNA, 531 bp, Homo sapiens
catctctgaatcaccacatagaagactgctcatcaggaacaccagcactggattgttatatgagtgagagataaaattctattgtgtcaaagtacacataacttggggtgtatttgttacagcaaccagcattattaccctaactagtacataagcctatcctggaggagccagaaagcaaatcaagggattctagctccagagtccacatttgtaaccactctgctcagctgcttctcagcaaaggaggcagtaagtgcttcactccagttcattcatggcagaaatgcaaagagagatagagctgagaccaagtctaaagtgttcttttgaggagagtgtctcactgcgttgtatttatctttggccattttgtgtcaaaaaacttctacattatcttgaaatgctgctcacaggaagttaacatttcttttcattctttaaatacaatgtcagctcagatttctgaaaacccaccaaaaatggcatgatttgagaaagtaaaataaaatacttattcgatgtatattc

SEQ ID NO: 202790 - DNA, 398 bp, Homo sapiens
gtttctagtctttggtacgtattagaatcatctaagatcttttaaaaatatgatgttcagtctatactccagacaaataaatcataatctctggggataggactcaggaatcaatatttttaaagctctcaaaataattcaaatgtgcagaaaatttgagaaccagtgcattagtccagtgtctctcaaattttaatgtgcatttggatcactgagtgatcatcttaaaatgcaaattcagatgcagtaggtctggatagtacctaaaagtctacatttctttttttttccttttcttccttctgatcttccttctgacagggtctcactgtttgactgtttgacccaggctggtctcgaacttctggtctcaagagatcctcctgtctcagcatctc

SEQ ID NO: 202791 - DNA, 551 bp, Homo sapiens
tgactatcctttgtattttgcaataaaaagttagctccataggcctaaatgtattttctttttaatgttcacctaattaaattccagatccagacactagccttaataatgattgtctttataattaactaaaggaatctaagtttccttttggctgtggggggagagagtccaatctccatcataaagtttgtttacaccatctgatttggtgaagtgttgaattgagaaactttgacaagaatgtctgtcttgagtccctgtacaactacagaaccctctgaaatgcccaggatcgttaccaacgccatctccattaagtcaagtctgtccacagtggggagagcaaaaggttggttaacaaatacaaaagtacagctataggccaggccaggctgctcttgcctgtaatcccagcgctttgggaggatcacttgagcccaggagttcaagagcagcccgtgaaacatggtgagatcttgtcttcaataaaaaataaaggccgggcgtggtggctcacgcctgtaatcccagcactttgggaggccgag

SEQ ID NO: 202792 - DNA, 912 bp, Homo sapiens
agctcggtaccccacgccgagcgtccacactgggtcatttgtctgtagagtctctcacagtgtggattttgtagattgcattcttgtggtatcatttaatatgttcctctgtgctttaatttgttgctcggcttttattggggtatggctgattgacagtaaactgcatctatttagagtgtacagttttataaactttcacagatgtatacatccacgaaaccattaccacaattgagatagtgaacatagcctttgtcccaacggtgtcctcttgactgtcatcactcccccatggatgccaccctcccataagaaagcactgttctgatttgtgttactataatttagtttgcatttcttagtgttttagctagaatcatagaatatgtacttttttgtctggcttctttcactcagcataattattttgagattatgttgttgtttgcataaatatttcattcctgtttattgctaaataatatccaattgaatggctatatcatgatttgttgttagccatttgaattttttccagtttttggcttttacaaacaaagctgctctgaacatttgggtacaagtttttacatggatatatatttccttttctcttgggaatttcctaagagtggaacggctggatcatattgtaagcatgtgtttaactgcacccaccatgagagtgccatttcctctacattctcaccaatacttgttatggtcagtctttttcactgaaaccattctattaggttggtacaaaagtaattgcagttttgctctcaaaagtaatggcaaaaaccccaattacttttgcacacacctaataatatgtgagtagtgtgtgtgtgtgtgtgaattctagctcctttgctagaattttaaaattagcttgctaatttgtac

SEQ ID NO: 202793 - DNA, 997 bp, Homo sapiens
cagagccggttcctggaaagagctggttccctggcaggctggagggcaggagctggggccacgctggtctgggatagttgggcagggaggctgtctacctggtctccagaatggacggccctgtggcagagcatgccaagcaggagccctttcacgtggtcacacctctgttggagagctgggcgctgtcccaggtggcgggcatgcctgtcttcctcaagtgtgagaatgtgcagcccagcggctccttcaagattcggggcattgggcatttctgccaggagatggccaagaagggatgcagacacctggtgtgctcctcagggggtaatgcgggcatcgctgctgcctatgctgctaggaagctgggcattcctgccaccatcgtgctccccgagagcacctccctgcaggtggtgcagaggctgcagggggagggggccgaggttcagctgactggaaaggtctgggacgaggccaatctgagggcgcaagagttggccaagagggacggctgggagaatgtccccccgtttgaccaccccctaatatggaaaggccacgccagcctggtgcaggagctgaaagcagtgctgaggaccccaccaggtgccctggtgctggcagttgggggtgggggtctcctggccggggtggtggctggcctgctggaggtgggctggcagcatgtacccatcattgccatggagacccatggggcacactgcttcaatgcggccatcacagcggcaagctggtcacacttccagacatcaccagtgtggccaagagcctgggtgcaagacggtggccgctcgggccctggagtgcatgcaggtgtgcaagattcactctgaagttggtggaggacaccgagggttgtgaacgctgtgacagagtcctggatgaaaagcgtatagacggatgaacctgctgtggggacaccttagaggcatttaatcaggcccaggggaggcccaggcgagggtgcttgccc

SEQ ID NO: 202794 - DNA, 1119 bp, Homo sapiens
cagagccggttcctggaaagagctggttccctggcaggctggagggcaggagctggggccacgctggtctgggatagttgggcagggagacggagtctcgatctgtcacccaggctggagtgcagtggcacaaccttggctcactgcaacctccgcctcccaggttcaagtgattctcctgcctcagccttctgagtagctggaattacaagctgtctacctggtctccagaatggacggccctgtggcagagcatgccaagcaggagccctttcacgtggtcacacctctgttggagagctgggcgctgtcccaggtggcgggcatgcctgtcttcctcaagtgtgagaatgtgcagcccagcggctccttcaagattcggggcattgggcatttctgccaggagatggccaagaagggatgcagacacctggtgtgctcctcagggggtaatgcgggcatcgctgctgcctatgctgctaggaagctgggcattcctgccaccatcgtgctccccgagagcacctccctgcaggtggtgcagaggctgcagggggagggggccgaggttcagctgactggaaaggtctgggacgaggccaatctgagggcgcaagagttggccaagagggacggctgggagaatgtccccccgtttgaccaccccctaatatggaaaggccacgccagcctggtgcaggagctgaaagcagtgctgaggaccccaccaggtgccctggtgctggcagttgggggtgggggtctcctggccggggtggtggctggcctgctggaggtgggctggcagcatgtacccatcattgccatggagacccatggggcacactgcttcaatgcggccatcacagcggcaagctggtcacacttccagacatcaccagtgtggccaagagcctgggtgcaagacggtggccgctcgggccctggagtgcatgcaggtgtgcaagattcactctgaagttggtggaggacaccgagggttgtgaacgctgtgacagagtcctggatgaaaagcgtatagacggatgaacctgctgtggggacaccttagaggcatttaatcaggcccaggggaggcccaggcgagggtgcttgccc

SEQ ID NO: 202795 - DNA, 591 bp, Homo sapiens
agcgattctacttcctcagcatcctgaggagctaggattacagacatgtgcccccaggcctggctaattgttgcattttcagtaaagactggctttcaccatgttgtccagactggtctggaactccttacctcaggtgatccccctggtacagcctttcaaattgctagtattgcaggagtgagccaccgggaccgcctaaggatagctttaaatcaacaaaataataagttttgttagactgtcagcagaccggcaggtagacatatcttagtttttacctaggcgcctatgtaagaaaaacaggccaggtgcagtggctcacgcctgtaatcccagcactttgggaggccgaggcgggagcatcacaaggtcaggagatcgagaccatcctggctaacacggtgaaaccccgtctctactaaaaattccaaaaattagccgggcgtggtggcgggcgcctgtagtcccagctactctggaggctgaggcaggagaatggcgtgaacccgggaggcggagcttgcagtgagcggatattgcgccactgcattccagcctgggtgacagagcgatacaccgtctcaaaaa

SEQ ID NO: 202796 - DNA, 202 bp, Homo sapiens
tgctgtcctgccagaaacaaggactttggagaatgtcacaaagaagcaaagctagactgaaaagttatgtgtcccaggctagagctataggcttagggatctatttccaactggaatatttcagtcacctttgaatcgtgctataggaaactcacgttattcccttactttgattgtgaatgttatataatgctaattatag

SEQ ID NO: 202797 - DNA, 702 bp, Homo sapiens
aaaggttaagatagtaaatattagtattttaccacaattaaaaacaatttttaaaaattagtaaaggattcgatgtgagtatgataaaatatgactgcaggaggttaaaaaatattagagattaaaatagttaaagcaatgttgacattttgtatgttgcagtcttagaatttaaaaaattttaattttgaaacctagttttatgaaatttcatttgggatcatttttagtagcattatgaaaaggatacatttggttcaagattatttcagataagaccaacgtaaggcacgtaaagtgttagtaaatgaaaatatcctttcttagatcctagttgctggataaagaatatcagctactactagtaagtggttttatgtagtattgcttatggctattttagttgcacttatatcattttaaatacagtttatgaacattgtactactccattatattattaatttatcttcgatgatatttatagtatcaatttaaaagctgtaaaacttcatgaaaagtagcttaaacaaggattttgataaacaaaagctttcagttttaaaagcaaatcatggaaacaacttcttaaagaagatttgaagtttttgttgttgctgttgatagaattatgaaccttataaactcagtattttttagttaacctaaatacataaatctatttgaattcatcttatgaaa

SEQ ID NO: 202798 - DNA, 169 bp, Homo sapiens
attgaggattgttccactcagcagaaggtggtgtgatctgtattatcatgttggatgcaaaaatttctaaggtataggcacctttgaatatgaaatatgaaagatgtgcagtcgtgggcaagatgttctggtcacttctttgaaagagggaataaaagagaattaacta

SEQ ID NO: 202799 - DNA, 426 bp, Homo sapiens
taaaagaaaaaaaaaaagattcatttctctaattaattcatctaggaaaaaaagggttggagggcagatgaaattcaggagaaaaaaactaagaatggaaatgatgtatagttgcaagtagggaaggacaaaataaaccttagtaatttaatttacaaatcatcccctgaaaattgatatatatttgttatatgaattgtctctatgccctctccattacaaaaatagaaaagcaaaaggcaactaataatgaaaataagttgggtgaggtgacagctttgtcatttttttaattggattcgcgctctccttcccttctgaaatgacgcactcaagactctgcctccacagctgtcagtttagttccctcagacattattaaaccctgcaatgaagcttccattggaataaatctaccaaaagtgg

SEQ ID NO: 202800 - DNA, 189 bp, Homo sapiens
agagaagtggtgaaacatgggtgtaaggtgaaggccagaggtgagggtggcaaggggctaacaaactagaaatgatatatcttcgtgtcaagaacaggaaaggacagatagaaacgctgtgtggccactggccctggaaacaaacactgatgtgaacagttaatgttgccagttttgaacccagctttg

SEQ ID NO: 202801 - DNA, 308 bp, Homo sapiens
cttgaaaggcttcttctcagaccaaacttagcttcaaaatggctaggtgcttccgtctgtcatttttctgaacagaatctcagacatcattagaaaagttggagaaggatgggcatgagacccctcaggaaagcgacagataggcaggcaacacaaatgagcaaggaacccaagcccaagaggtccttacccactgaacaggctttttatcttgaagtctttgtatttgatctggaggttcacagaggaaggtcccactcatttaatgcatttttttaagtacaataaattgccacacaaaagtctca

SEQ ID NO: 202802 - DNA, 608 bp, Homo sapiens
tccccactgctcgccttttctctgcaccacaagcaggttctgtaagaaaccatggtaggcatgcgtacaggcccctgttggggaaatagaattgaaaacaaaatctcttgccaacccagaaaagctctttgcaaaagtagaagagaaaaacagcttttaaaagattgaatgtgcatgaaaccagaatgtggtgcgcaccatggacaatcccccgagcaactgcaaagacgggagctctgagcctgcaataccccaagcgactgcaaagacgggagctctgagcctgcaataccccgagtgactgcaaagacgggagctctgagcctgcaataccccgaatgactgcaaagacgggagctctgagcctgcaatccctgagtaactgcaaagacggaagctctcagcctgcatgtagccggcaggtgcagcccgttacagacatgttctcaggataaacagcaaccagccctccagcaagaggactggacattaccatttgtcacacgcaggcaggtcgtcctaaattcacctcataattggagtgaccatctgtgttagctaattgcctttacccacaggaaaaataaagttcttatatttttatgaca

SEQ ID NO: 202803 - DNA, 593 bp, Homo sapiens
ggattcatatgtatctggttttctgttttggaatataacttaaaatatttttgaagaaatatggtaaagtgattatccttctggaactagatacaccgacactgtcacattaactcacagcttgttaaatactgtgcaatctttctataacattctttgttatgagactagaatcagcatatgggaattgctcttttcctgctaaactgaagtcattactaactactcatctgtgacatgtactctttcttgtaaccagggattttagcttcacaaaatttagaaactgccgcattgtttcttggcattgctttcaaatgtgacatcatttaaattttggaatattccattttagcaaatacactagtgggtgccaggttaaagatgactgcccaaaaaggggcagcagcgtctctgtagggaacaaccacagattattctttcaacctataccatcccacgcctttcaccagaggcatactgaattacaatgagctcaataaatacatttcaaaaatgggttatcaaattaccagcctatagcaatggcttccagtcactgaagacctatattgaaaaacaactgtgatata

SEQ ID NO: 202804 - DNA, 525 bp, Homo sapiens
gctttgaactgaagtctgtctcctcaatttcctctcttagccactatgctaaacggcattgataaattagagatgggcaggtgaggggtgttggaggacaggggactatttcaagcagtgagaacaccttgggtgaagaccttgaggaaactgagaccatttcaggaagtttttctaaaagaaggttgagagagctggggctgagaatcctgagaggagagaggcaatagataagactagagaaatgtaggcagggggccagatcccacaggcccttgagtctacagtaagagtttgtttatcctaaggacagtgggaagtcgttgaaagattttaagcagtagagtgtcatgatcaagtttgtacttaggacagtttactctggcattttggagaatggatgtggaggtagcaactcaggaggttgggagaccagcaggagactggtgatggtaaaccaggcattgggtggtggtggcttggattaaggaaactgagacagggactgggagagggagtcagaca

SEQ ID NO: 202805 - DNA, 621 bp, Homo sapiens
ggtggctcgcacctgtaatcccagcactttgggaggccgaggcgcgtagatcaggaggtcaggaggtcaggatttcaagaccagcctggccaagatggtgaaaccccatctctactaaaaatacaaaaattagctgggcatggtggctcgcgcctgtagtcccatctactcaggaggctgaggcaggagaatcgcttgaacccgggaggtggaggttgcagtgagccgagatcgtgccactgcactccagcctgagagacagagtgagactctgtgtcaaaaaggaaaaattgccagtggagataaaggtgtccatttgggtaggtcaggaagctgtggtattcatgcctcatggccttcattttcttagagcgtagggtaaaatcatgccattttttgcctctgtgcctcataagtttgtactccttcctcctttaaaaatcagctgtaagagctggatgtgctgtaagggctggacgtggtggcacatgcctgtagttcctacttgggaagctgagatgggaggaccacttgagtccgggaggttgaggctgcagtgagctatgattgcaccactgctctccagcctgggtgacagagcaacaccttgtctcttgggaa

SEQ ID NO: 202806 - DNA, 668 bp, Homo sapiens
cgatgcccagtcaccgctgccgcgctgccgccgcagtcagccgcgccgccgccgctgccgcagcgcgggcggccgcgcgccggtagcaggggcttggcgaggaagccgctgagcctcgcgcgctccgcgctcctggcggtcgcagcgctgcctattaattgattctcttattgatttatttaatttttaggagcggctgctcggaggcacgggtcttctcctaaacctgcagcgacgcccccggcgtgggcacaaaggctccgacggcggccggcgggggctgcccagcgcccgggagccggcgccagaggtcgcctgcgcgcgccctagccgagccccgggcaccatgccgcggcgcctgcagccccggggcgcgggcacaaaaggccctccggccccggccccggcagcttcgggggccgcccggaactcccactctgccgcctcccgggaccccccagcgtctgccaagccgctgctgcgctgggacgaggtgcccgacgacttcgtggagtgcttcatcctgtcgggctaccggcgtctgccgtgcacggcccaggagtgcctagcctcggtgctgaagcctaccaacgagacgctcaacttctggacgcacttcatcccgctgctgctgttcctgagcaagttctgccgtctgttcttcctga

SEQ ID NO: 202807 - DNA, 644 bp, Homo sapiens
tcacaaagtgcacccaggactctggctccccagctctcatagcccccatgcagaccctcgctggccctgatgtaccaggcaggaggctggctgggatgaccttgggcaaggccagatgaactgcactggggcagcttgcccacctccgtgggccaagccgggagtgactcaggccttggctgcgtgcttatgctaggagaggaggttggctgtttgccgcccctgccgggcctggattccttcacaggggaggtggagggccactgtgatcctggcttcctgggacctggaggaggacaggtgtggggtttctgcttcccagtctccaggtcatccacaaccatgagttcaggggagcctttgagtcagcctccgagaggtctgatgagcccagtgggttgtttgcttcctttttcagaagccagtcaggggttatgtccctctgtttccctgccagtgctcagcagctggggttctgagaggtggtatggtttctccaaggtcacagagccagctctggagcagagccaagagaccttgctaccatgctgtctgggtcatgtttcctgtgctgaaatgtcctctgggctgtgcccagtctcctgagcctggggcacacatggctgaatttcttatgctccttg

SEQ ID NO: 202808 - DNA, 461 bp, Homo sapiens
cccaggaaactgagtcaacttcaagtgggataaactcaaagaaatccatgctaagacacaccataattaaaattttgaaatctaaaaaataaaaagaaataaacgcatattactaatagggaacatcaattcaaaaggccaagaatttctgttctgaaattgtaaaggccaatagaaagggcacaatatttttcaaagtgttcaaagtaaacaactgcaaataataaaatgaaaaaatacaccatacaaacatcaactgcatgtttactgcagtacaattcacaattgcaaaaatatagaaccaacctaagtgcccatcagtgggtgagtagataaagaaaatgtggtggccgggcacggtggctcacacctgtaatccctgcgctttgggaggccgaggcaggcggattatgaggtcaggagttcgagacgagcctaaccaacatggtgaaaccccatcc

SEQ ID NO: 202809 - DNA, 294 bp, Homo sapiens
cattaagaatctgaaacaattgggtttttaaaattttctagactcagattttctttctggggagtccaaagcctagataagagaaaagtactcttctcacagcagcagggtgtgcctgttaaaatgtaagtcggatcctgataaagttctaactccagaacacatcagtggctccacattcttactgtgcctaaagggcacagtccagacccaccctctccaacctcacctcctacttgttacacccttttgcagtcagccccagccactctggcctcttccatgctccctcca

SEQ ID NO: 202810 - DNA, 804 bp, Homo sapiens
ttgcaggtagaaagatgcctctcctccctttccgtatgatggtgaggggcacaggggtcctaaactcagccccgccttttccagccctacaggcctgcaccctcagctgtccaccttcatcccccccaacccttggcttaattaaacccaaacgcttgctggtttcccctattccctggatcatgaggaggccacttttggtctcttcaccggattccttaccttcctaaactaaaccaacaggggccagatctgtgcgtggttttccctttggtgagatggagcacacaggcagccccttctcaaaccccagctgtactgtcctgtttagagcccatggcaggtgtggtaagcaggactgtatacctctgcacatgctgacaaatgtgcacataggagaagtgggggcacaggtgggacttggagggcagctattcctgtaggacgctgacattggcacattttttttttttttttttttgagttggagtcttgctctgtcacccaggctgcgatcttggctcactgcaacctctgcttcccaggttcaagcgattctcctgcctcagcctcccgagtagctgggattacaggcgtgcaccaccatgcctggctaatttttgtattttttggtagagatggggttttcgtcatgttggccaggctggtctcaaactcctgacctcaggtgatccacccacctcgacctcgcaaagtgctgggattacaggcgtgagccactgtgcccggccaacactgccagattttgagactaaccaggaagttcatctcgggcaggcaggg

SEQ ID NO: 202811 - DNA, 664 bp, Homo sapiens
agtttatttctccttcgcatcacagttcagtgtagttggcagctgtgatggtggtgggagtgtcagtcacttcatgtggtcattcagggacccaggctccttccaccctttgacaccattatctttaaatgtggtttccaaggtcactgcaagggagaatggggtttcatattaaggatatttatattggccaggcctgaaggtggaattcacttccacccatattccattaactgcagggacactactgttgaaactgaactgcagaaaacttgagaaatattgtccaggaagtaagcaaaatggatttggtgcacacagagcattttatgtggccactgcgaacatttacacatgtcattttcctcatatacctccattagaaaatctgtaaatttcttaactaatgtttttttatattcttacttctccttacatccagggtcttgaacacgataagagtccccattgaaaaactgtccacagaatgcctaaagatcagatcgtacccaccatgcttcagtggacaagcatacagtgagactgaccttgtgtgtatgtgtaactcatttttacagtcaacagtggagaggaatgagtcagctgggtgattgccattcagcgggcttcgtatacagcaggccttggccatttcactttctgt

SEQ ID NO: 202812 - DNA, 458 bp, Homo sapiens
acctcctgtctcctctttccttttgggactctaattacacatatgttaagtttcttgatgttgtcccatagtttgccgaaactttgttaattttgctttaaattatcttttctgtgtttcattttggttagtttctgttgctgtgagttttagttcactaatcttttcttttgaaatgtctaatctgctattaatcctattcattatgtttttgcctcatgtttttgttttcatctatacatatacatatagaacttttcaatatctggaatatagttataatgcctactttaatgcctttggcaattctaatattgtatttctgggttagttttattttattgatttttctcattacggattgtgttttcctgtttcattgcatgctttgcagtatttattggatgccagatgtaacttttaccttgttgagtgctagctatgttactgtaagtaga

SEQ ID NO: 202813 - DNA, 467 bp, Homo sapiens
ggtttacactctgggtgacattaaggaacttctcaaggattccatcctacatgatggaagaacaggaagaataaacagcattccatgggcacagcaaatccacctgtcagtcaccacccattcttcaccagcaaggacaaaatgtaaaactgtgtcaaacacacacacgtgtgtacacacacacatgtgtacacacacatgaccctcctcatttctgcttcatctggagacctacacaagttttgtgcttccttttattactggagatgaaaacatgacccagcctcctttaggagtctctgcaagcaaggccgactcatctgagtcgtgaccgctatttcttccctcagctggaaatccaaatgtgattggtacactctaagagtaccgttctaaagacacaggcacctccgtcttttcagagaaatgttgtatttttaatcaagtgaacgttttaattactaacc

SEQ ID NO: 202814 - DNA, 172 bp, Homo sapiens
tggccaagtgaggctctgctgggagctccctgtttggtggaggatcaagacagaactttgaggacagtgttccacccatattctgcacccttcttggctgaggccacagggcagacccccacccaccggccctgttcttccaagcccgatcccatatgagcaggcgtcccat

SEQ ID NO: 202815 - DNA, 527 bp, Homo sapiens
aacatggcacatgtatacatatgtaacaaacctgcacgttgtgcacatgtaccctagaacttaaagtataataaaaaaaaaagtacaagtagaaacacatattaagacagtagaataaatacagatatatcagcaaccatagtaaattttataaatgcgctaaactctaaacggtaaaaattgtcagacattatttaaagaaaactataaatatttgagttttacaagagatacacctttaacataaagatgcaatgatcgaaagtccaaggataaaaaatatgctatgcaaattctaactgaaggaactatagtaactgtattaacatcaggcaagtagacttaaagacagaaggtgttactaggtatagagggttacccatagtaatggaaattcaattcctgagaaagatatactaattttgacttgtttttgtctgaaaatgtagcttcataatatgtaaagcaaacatttccagatctatatgtagaaatagaaaaataaaagtaccttgtacttgagaaac

SEQ ID NO: 202816 - DNA, 1137 bp, Homo sapiens
gtacactttcagctgtcacagagggtaactcagatcaggcttagaaatcacttgacttaactcagcagcactttttcttttctttgtgtctgtattattttagcagccttctctaaatactggaggcattggatttcatgtcgccaaaaggaatttaaaaatgacaaaagtgtaatctgttagaaatagttaatttgtagaattttactctataaggaggtttagtttcaatttgttttgaaatgaaggaattaagttgtgtttttaaccaaatgaattggcatctttatatttaggagaagtaacattggtgattatttatttcaagaatcatgactggaaaaagcttggaagtttagtagaggagtatatgttgtacatgcaaagacaagatctgcatgaatctatgtatttctgggtgtctggtgaaggccactttaggtgactggccagagaaggaggtgccctagtgatccttgagtcacagccatactgctaggaccatgactaccataccaagaaaaggcagcagccacctgcctggcagtttgcacacctgtaaactgaagctgcaggaggaccggcgacagcaagaaaaatctgtcattgctcaacccatatttgtttttgaaaagggagaacaaacttttaagagacctgcagaagacaccctgtatgaagcagcagaaccagaatgtaatggttttccaagaaagcgtgtacggtcttcatcttttacttttcatattacagattctcagtcccagggagtgtcaaccttgtctcagaagcaaatgagatgttcatccgtcactaacctcccaaccttcccccattctgggccagtgaggaaaaacaatgtttttatgacatcagctcttgtgcaaagtagtgttgatataaagagtgctgaacaaggtcctgtgaaacattctaaacatgttattagacctgctattttgcagctacctcaagctcgaagttgtgcaaaagtaagaaaaacatttggacacaaggcactggaatcttgcaagactaaagaaaaaacaaataataagatttctgagggaaattcctatttgttaagtgaaaatttatcaagggctagaatttcagtccagctgtctactaaccagg

SEQ ID NO: 202817 - DNA, 1062 bp, Homo sapiens
gtacactttcagctgtcacagagggtaactcagatcaggcttagaaatcacttgacttaactcagcagcactttttcttttctttgtgtctgtattattttagcagccttctctaaatactggaggcattggatttcatgtcgccaaaaggaatttaaaaatgacaaaagtgtaatctgttagaaatagttaatttgtagaattttactctataaggaggtttagtttcaatttgttttgaaatgaaggaattaagttgtgtttttaaccaaatgaattggcatctttatatttaggagaagtaacattggtgattatttatttcaagaatcatgactggaaaaagcttggaagtttagtagaggagtatatgttgtacatgcaaagacaagatctgcatgaatctatgtatttctgggtgtctggtgaaggccactttaggtgactggccagagaaggaggtgccctagtgatccttgagtcacagccatactgctaggaccatgactaccataccaagaaaaggcagcagccacctgcctggcagtttgcacacctgtaaactgaagctgcaggaggaccggcgacagcaagaaaaatctgtcattgctcaacccatatttgtttttgaaaagggagaacaaacttttaagagacctgcagaagacaccctgtatgaagcagcagaaccagaatgtaatggttttccaagaaagcgtgtacggtcttcatcttttacttttcatattacagattctcagtcccagggagtgaggaaaaacaatgtttttatgacatcagctcttgtgcaaagtagtgttgatataaagagtgctgaacaaggtcctgtgaaacattctaaacatgttattagacctgctattttgcagctacctcaagctcgaagttgtgcaaaagtaagaaaaacatttggacacaaggcactggaatcttgcaagactaaagaaaaaacaaataataagatttctgagggaaattcctatttgttaagtgaaaatttatcaagggctagaatttcagtccagctgtctactaaccagg

SEQ ID NO: 202818 - DNA, 729 bp, Homo sapiens
tgaagaaataatgcaagtaagccaggtttcatgatcaaaatgaatagttattgggcaaaagctaggcagggtgtgaatgttggggaactcaatggttattttgacttggattaattaacgctagtccctcatttaaacatgactttagaaaataagaattatattaattaaaaatagggagtaaaggaatatttcagtaaacatatatttatcctttaattctattcttttaaggtcctgtgaaacattctaaacatgttattagacctgctattttgcagctacctcaagctcgaagttgtgcaaaagtaagaaaaacatttggacacaaggcactggaatcttgcaagactaaagaaaaaacaaataataaggtgagaaagcccaggataacggaactgacctcaatccctcatctttctttttgcaggttgtttggggcccccatatccagaaataggagttgtctgagctttgttttgttgttgggctagatagcataaagcccttggtaaacttttcaaagttgtactctgacattggagagttgtagtctcacaaatctgtggtctctctaaagttgtaaagttgagtactgggtagtggaaatctgggggtcttgtgccagagcaatgaccctgtgtgagaatggggacagcaatgagggagccaggggccagagtcagtagtcaaaaaagaggcagggattttctctacatcgccaactgg

SEQ ID NO: 202819 - DNA, 380 bp, Homo sapiens
tttctcaaatcaaccaggaattactcaactaggattatcctcataaatttttcattccgattcaaagtggttaagccatctgttcactgcctttctccttatatggtcatatcaattcagttattactcttccttatcgagtcttccctttgtgaggattgcattcctgtgtttatagactttaaataactaatgtataatttctttatgtgccaagaatattattttaaatgatatgtgtatgtctatccttatttgaattcaatagaatggcttctaaacacagtgacatgacagttttctcacaagagccatacacattaactatttaattatagtgaagcagctgatcgattctggcatttaaatgtgttactatt

SEQ ID NO: 202820 - DNA, 488 bp, Homo sapiens
tgagcccagccaacacatagaattatgaaatagtaaaatgattattgtttaaagtcatgaaattttgcagtttttttaatatagcaatagataaccaaaatcaagattaaataaaatatcagatgattaaaatggagcatgaaaatggagttaactttgtaagaagaaccacaaccccaatgatcatgacttagaggaaagttcagtaaataaaacagaaaatattgaaaaaggctgtttcattttaaacctgtgtcaagctcctagacctaaaatgacacttgaaattgtcctccattagaattcattgtgctacagattttctctcattctgttacatatatttatttaatgaagtagagaaattcttctctcataagctaatgctgcaaggtgtttttatatgtattatatgtatatgtacatacatatattttttatattaacataacagtttataataaatgtttaagtgttttataataata

SEQ ID NO: 202821 - DNA, 415 bp, Homo sapiens
ggggtttgaggaataaagttgggttgtgagggtcgattggaagcttggaagccaggctaaggagttggagtaggtctgctagacaggaaggaaccacaaaatcaggaacataatggtggaagggcctcctgtaaattgtcgatacttaactattttggcctatgaatggcaatagcacatggttccactaaacaggtgccctggtattgttttctgtgagaggataatggagagggttgcttatagtttgtagatatctagcaaatggtctgttttgctagtccagctagtcagaaaccagtcctctttttgaagaatagagatcaaacctgctctacaagcttatatgtttaccacaatttgggtggcatgataaagactaaatgcacagaaaggccacataccacattacatt

SEQ ID NO: 202822 - DNA, 642 bp, Homo sapiens
actttcaaatgcagacataaggctgaagagagttttattttgaaaactagaaggggtaagaattgagagttcatactggctgcaaggcactgaccaaactccatagctacagctacaaaaaaggagaagaaaaaaatggcatcgcactggctgaagatgctagaacttggagtggagagctggaaaaagagctgaaaatttaaaggaaaaatgttagcaccaagctaatcacagaaggcacgagactcaaattcagagcacaagctacacaaattcctagctgacaacaaaatttacacatgagcaagggaggcctatgaagcctagtgaaaaagcaggaagagaaaaaaaaaaaacaagattttagaatctgtgattcttttattaactgagaacatttttcaatcatttacagcttgagtggtagaaagatgaatctagacaggcttgatgtgtcagagtatagggcccaaagctggcatggctactgtcaattaggaggaaattctgagacacaaagaaacaacaaagaagatgagcatctgccaaatctttgggctaccacactgtgcatatacaagggggacctataggtgttcaggctaacaaagcagcagaggaaaggtgtaagctgaatacctc

SEQ ID NO: 202823 - DNA, 280 bp, Homo sapiens
tggttaggtgtcccatcagaacgtggtacccagaatgagggttggttacatgtctagtcagaatgtggtgcccagagtgaggactggttaggtgtccaatcaaaacatgatacccagggtgaggggctggttgggtgtggtgttgacagcctggctcctaagctagcccgagtgcaggtgtaacccttgtgaaggcctggtcaattgtcccatacatccctggagagaagatagtgcctttatcagctgtgcagggactgaaccagaggaaatggggaag

SEQ ID NO: 202824 - DNA, 430 bp, Homo sapiens
aaaattctggagatggataatagtgatggttgcacaaccattaagtatgaatgtacttaatgtcactcagttgtacacttaaaaatggttaaaatagcaaattttgttacatatattttaccacaataaaaataagtcattgaggccagctgtcgtggctcacgcctgtcatcccagtgctttggaaggacaaagcgagtggatcacttgaggtcaggagtctgagaccagactggccaacaaagcaaaacctcatctttactaaaaatacaaaagttatctgggttgattggcgcatgcctgtaatcccagctactcaggagactgagacatgagaatcacatgaacccaggaggtgtggaagttgcagtgagccgagatcgtgcccactgtactccagcctgggtgacagagactccatctcaaaaaa

SEQ ID NO: 202825 - DNA, 256 bp, Homo sapiens
catgacccttctagctgtggatagagactactgttggggcgacagtggaagcagtggatgagtgaggggaggaggctgcaatcgcagccgaggtgagagagacgggggcctggaccagctttgtccccaggcaggtgggcaggtgaagttgtaacagataagttgtggacccagaagctacagaggaccctgggtttctgtcctccatgtttgggtgaatggtgatgctttctgtgatggagggccagggtcggga

SEQ ID NO: 202826 - DNA, 537 bp, Homo sapiens
cttccttcgctaccaaaagggctgactatgggcttaggaaattttgttccctccaaagctttagcagcagctgtgtgtttgacctttttaataccagttcactcagctccccattgctgatttccaagtgtcagcagtactgtaaattcctagaaatgaaaagtgtgagctctcaaattcatgaaacctgacattgactgtaatatgtcacttgaaccttgaacactttctatggtcatggtttaagaggcctggtcttatcttgataattcatcctgtcatccccttcttatccttttttgttgttttttataaacaacaacaaaaaaaagagattgtgtgtgtatgcactgaaatttttttttttttttaagagacacagtctcactctgtccccaggttagagtgcagtggtgtgatcttggctcaatgcaacctccacctcctgggttcaagaaattctcctgcctcagtctcccgagtagctgggattacaggcacctgccaccatgcccggctaatttctgtacttttagt

SEQ ID NO: 202827 - DNA, 291 bp, Homo sapiens
tggctcaactcacatggtgaatatgaattgtccaaggtcacccaagaatgaatgagagagctgaaatctaaactcagagcctcggaattgtcagtccctctttggcaaagaaaggaaaatgaagagcaacctgcaacctatgcccctgtccatataagcaaatgcaccaacggccacggacaaggatgcccccattttcgggtgatggctcctgcctatttctaggcaacttcttcctaatctccttgtaattttgtattttcatagattaaatctctctctctgaacatg

SEQ ID NO: 202828 - DNA, 409 bp, Homo sapiens
cgagtgggtctgcaaggcagcagtgagctagatcatgccactgcactccagcctgggtgaggaatagagaccccgtctctgaaaattaataataatcatatagtaataataagacaattggggcagtacctcctttatattgatcagatactcgatttgtctataccctccagaggaagacaaagtattctactttgtttcctgagaaaatactgtgtatttatatatgaaaaaaatccattaaaatactgggcattctaaagcatctaaatgtcataagtaatatcatttaaagtggaaacagaggcagtggtgtctatcaaggatgcttatcagtgagggaaacaaaaggaatcattaagcacccttggatacctgaagggcccctctgccaaaaatctcagtaatt

SEQ ID NO: 202829 - DNA, 360 bp, Homo sapiens
ctagggagtgccagtgccaggatttgaaagcaggcagtctggtaccagagcttctgttcataacccccaggcaataatgccttcctatacattgcctctaaatccatcgcaaagatgcacacagaagagatgtttttctccttccttgtgtggctatatctagtttttaggtaatgttgagtaggataaacatatttgttaggactcctcacctccagtccatccctgcttttttactctctgccgcaggcccacccgagtctaattctcccacttttgctctcaggaaaagagctgataaattcagtcaaatgaccagtgaggcatagtgctctcttccaatgtcccttttacagcaga

SEQ ID NO: 202830 - DNA, 414 bp, Homo sapiens
ccatcgagagtttttctcaaaggttttcaatgactcctcttgtgttctctggcctatcctactccagctctcaattctgctaggcttgagttccagcgtcagagcctttctgagcctctcttctcagtcttagccttccctccttccctctctctccacccaccttctggccgtctgggaagcttcagcttcatcctgcttccccagcactgctcctccatccacctttttttcttccatagattcgttaaaaacatcttgtctgaaggcagttctcccctttctacatcaccatgggttttttttgcagaattttcttccattacaatcactgattgtaatcaattctctttcccccaggtctctgcctcctctctgtcaggaaggagagagagaagttaaccacacagaact

SEQ ID NO: 202831 - DNA, 338 bp, Homo sapiens
tgatatttacagtaattctttaatatcagtaaatatccagtgagggttcaaacttccaattgcctcataaatgctacttgttttattatttttaattagtagaatcccgtaaatctcctaagtgtcttcttaatccgtatgtttccctttcatctttctttttttccttgcgattttgtttatgaaatgaggttgtttcacatgtagcatttgccacaatttaagttttgctaattgcatccctatggtaatgtttgctttcctctatcctctgtttctttaatttgctagttatgtctagagacttgatgagattgaaacatggcttttggcatgaa

SEQ ID NO: 202832 - DNA, 2026 bp, Homo sapiens
ctaacatatgttatggttggagtgcatataacactgtgcagccgaataactagacctagaaaataaaactgatcacggtaaagttattttccaggcaggggatgcctcatgatactggctggggcccaaccacacccaaggcctcgtcggtttctgttctcatgctgttgtcatatacccagaagtaggggaagcccaggagccatggagcctcagtgtcagttccctgacaagccatcctccaaaaaagcctttcctttgcaaaatgaacaggtactccgtgaaaacagggagagaaatttctgtttttcaccgatgcatttctcacgttcatctgacaatgtgcaaaacaaaaagtctacattagaaatttatcatgaagttatactctacttcaactcacttcttttcagtccctgtgaaaacttaatactcttggtgttgtactgaaatacccagtggatttggggtgcacctgtacccttgatctccacttctgcgtgtttctaggccaaagggaaaaccaactctctacctaattggaacttctggttttattgcatatcctggaggtcttgcttcgtttttattttcccgggttgatggtctttcccatgtgcacctacgttagcccactatgtagaacgccttggcagttttcacagagtaagaggttgaaggaagccaccaatgtgaaaatcatatttgctgtaaagaaagaaccattgtgagttgttggaaaccagattaaaattccataattggagattgatgacttttatttcatgagttttacttagttaggtgttttatcttctgtgttttgtggctccaaattacgaagactgttggccttgcaagaaactgatcacggcaaagttattttccttactgaacacgtgtcctatatatttgcttggcctcgggttttgtttaatcccttcaaaggccctttgaactgatgtttcaacatgactccttctctgtgagctctccgctaggaagcggccatcatgtcaagccccttcacagctaaagtagtgagttcacatagtcgaagaatcttctgggttgcatcttatgaaaaaaagaaatccactgcctttttataagagaacagaacatttacaccgtcttgttgagcaaatgaacgttcaaatggccagcacaaaagaaatccccaatctctaacctcacaatgaaatcgccacggacaaaagatcacgggataccgggagcactaaactggaagtgacacaaaaccacagcagaatccgctcacacctgccgaggttcctgggggatgatctttgtgtaaaggatcctggtgccgcagtcagcctgaaacactccaaggagcagagacgctcccctctgcaacagtgacatttatactgatggcgtctttttaaataaattaatacatgtctgatgtggacagagtagtgctgtctgacaaggtgatcatttgacttttcttagaggtacaaatttacgctcccttctatgaatagagagggctatttgtttcattcaaagacaagacattgttagaaatgagtggcacacctcttcaacccatccccttcctccatggaggtaaaaagatcctattagttctcataattgattctgagggctgcagcgtgcctcatttagccgtccctgctcggttcacgccaaggatgtaattcatgcacacttggacgtccaacatggctgacgcgccttggacacacagcctcggcgctgcatcattttttaatcagctatctgaggaatatttatctgatcaacaaagagtgttgtcaggaggagaccagaggtgacattaataagcctgtggtttcctggtacaatgatggaggaagagtttggaataaaaccctgctcgtttgagcatgccagcagactaaagaatatttttattctgcttacaaagagccagtcaaaagagtctcagtttgaagtgttcagttaagtttaagtctcagtgataagttttcaggcattcacatgtgttagt

SEQ ID NO: 202833 - DNA, 2456 bp, Homo sapiens
  misc_feature (1035)..(1035): n is a, c, g, or t
  misc_feature (1174)..(1174): n is a, c, g, or t
  misc_feature (1350)..(1350): n is a, c, g, or t
  misc_feature (1495)..(1495): n is a, c, g, or t
  misc_feature (1523)..(1523): n is a, c, g, or t
aaattagagtaaatcactgtcctgaagaaggtacccttgggagagtgggttggcctgtctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccacgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagaattcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatgtgaaggaaacatggtaaccactgcagtaagaaaagcaactgctggagaaaatggcactttcttccccaaatttgtttttacactcatgtctaaggaacaccttagaaaccacattaacatctttcagcaaaaggaaattctgcctgttgatcttttgctgtgagacaaacttgaaaagttcacagacactgcctttctctgaaaactgcccttacctctttgttataattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcntgtgtccttcagtggtgatggctctgaaacccttgtgttttatgaacttcatgccctggtcttcaaacgaattcagtgcaggccaagaagcacagtttggcctgggttggatgctctatattttcaaagagtgaaatgncttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcgggtcaggcccttcancctggtggaagagcaggcagggagggtcctatggttcctgggaggacccgaagcatgatcgcctgtcaagagccaagagccctaatggccagcgccggggaaagggcccccgaggggcagtcagcagccctgcaggggcggcgtncacactcctgtgtggcacgggacactcntggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgcggaaccgtaaatgagggttcagcctgtctgcctgagggattgtgtttcctgccgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacatgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaattccaagaggtagatgttgcagtgagctgagattgtgccattgcactccagcctaggcagcaagagtgagactacgtcttaaaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagcagattagacactgcagaaaaaaagattatgaaacacaaagccgccgggcaccgtggctcaggcctgtaatcccagcactttgggaggcggaggcgggtggatcacgatgtccagagatagagcccatcctggctaaaacagtgagacccccgtctttacaaaaaaaaa

SEQ ID NO: 202834 - DNA, 574 bp, Homo sapiens
tctatactttgctacttccatgcctttgcctgtgttctctcttctggtaacataatttatcttattccatttcccacctgtctatggtttacttatccttggaattataaccaaaattcttcactctttccctaacttaagttttcttgtatttctgcatcttgaaagtatctttgccttcctggattccagtatgctttatacttctattatagtgcacaacagtctgcctggggttgattaattgtgtttacatggtttcttggaaaagtatacaaaaacaagaaatagaaaagagacctgtaaacaactaaaatacagagcaggatgaaagaaatgtcaaaccagtagcatgcaaggagtaattctgagtagcattggagaatacagaagacttttattaattagattacttttgatctgaatcttgagaagtgaaaataattcagctatatagaatttagggagaaggagcattagcatagacatgaaggagtggcctgtggggagagatgcattgggaatgagactaggaaggcagattgggaccagatctagagagcccatgctacag

SEQ ID NO: 202835 - DNA, 500 bp, Homo sapiens
atctgttgtatcaaggcctcactcagttctgagggatttgcagatgttactgcatttaatcctcacaatacagtgaggtagatgccactgtaatcccttttatacagatgtgaaaactaagaatcagagagggtcagtaacttgtctgtggtcaccaagctagtaagtggggggatcaccacttgaatccatcactgcctaactccagaaactgggtcttaaccatcacaatacactgtccctagagtctgtcccgctccaaaccctctgcttgttgaagggaaacaaacagaaatgaggcctgaactctgttgttttcacgcccctgtctcatgaccaagcggacctgccagtttcttgcagctagcgatcagatgtggaatcggttagagcctcctacctctgcccagccatcttgtcccctctcctgctcagtgctggggcttgacgatgggggctggctgacccactgacccactgcccgcctagctggttgacca

SEQ ID NO: 202836 - DNA, 206 bp, Homo sapiens
cttatatgctggcgacatttttaatattatgttgtaagacttcatcaaaatcctctgaaggatgttgatttttgtttatcaggcagtcagtttggttaacgtcaggatgcgagttctgtcttgcctttttgtggtggttccagtgtcagttcagttctcaaagcatttcttttgaggtgcgcacagcatactttccactccagtta

SEQ ID NO: 202837 - DNA, 400 bp, Homo sapiens
gtccacatctttcaaaaccaagcccttgcccattcccattaccatctcccatcccgactcaccccaactatttcctctccctgttcagaacttctagccacacaagccatttgatgatcctgaattcatccttccacttacttgcactcctctgcctatactttcctctgcctaaaacattcttttcattctaaccctcaaaagtttggatcaaaactgttttttgttttttttttttaaatcaagaaaccctgatttcaacaatgcacagagggaaagaaaagtaatctgctccagtgatgttcaaagaggagcaggtgccatttcacttaccaaagagaggatccattatgaactcatcagtcctcctgctttgttcattcccattgtggcctatttg

SEQ ID NO: 202838 - DNA, 361 bp, Homo sapiens
agtttgagaacatcctggccaaaatggtgaaaccccgtctctactaaaaattaaccgagagtggtggcgcatgcctgtaataccagctactcaggaagctgaggccggagaatcgctagaacctgggtggcggaggttgcagtgagccaagatcgcgccactgcactccagcctgggcgacagagcgagactccacctaaaaatataaagaaagaaagaaagaaagaaaataaaagcaaattagaccaatatccttatatccttgatgaacacagctgcaaaaacctcaccagaactagcaaaccaaattcagcacattaaaaggctcattcaccaggatcaagtgggatttatcccagtc

SEQ ID NO: 202839 - DNA, 566 bp, Homo sapiens
gtgaaaggtaaaggggacaataagtagtcaaggccggataaagtaattttataggggcttaagattagaaagaaaagttgtatagatagctgcgagtcttaaaatgtcaattcaaatgaagagatgagacttgatgcttcatctttaaaattctgttagatgaacaaataaattttctttttaaattaagagctggctctctgcaacttgcagaggcctaacacgctccaaaattcttaattgggtgttcttatttgcaaaatggacaaataatgccttcattgagcatttgagaacagtactgagagaatgcatgctttcaaataaacaaaatattgcaaaacaaaaagtatattaaaagattttaaaaggcaaaaaaagtattaaaacattattcatgctatttgatatattttagaatacaaatgcttgtaattaaaggaaaagccaagtcaaatattccaaatgaaacgcaaatctgtattgacgtaaactaaaattattcaaggtctatggttgatgattcatagtcatctttgcatttcacacagctttcacataaagcc

SEQ ID NO: 202840 - DNA, 375 bp, Homo sapiens
tcactctacaggatccgaaaatgacatagaggcaggtttggagcagcgggaaaactgtggttctgacatcagttggtaaagacgtgtcatgttggcctttaggccctggggacaatgaaatataaagatggggtgacatgcatcacactcagacctgccactagcaccgccatgtacagttgtggaggttcttcattgcacaaaggcactggctgaaagggtgagtggaggctgaaatgtagccgttgatctacatgccaagatctacattcttccacaaggctgagtgcctttctctaattcacagataggcattgtatgggcttgcgcagccctgcctctatgtcattttccgggatcctctagaacgctatc

SEQ ID NO: 202841 - DNA, 595 bp, Homo sapiens
agaatgttgcctatgttcttagatcaaagtcttaatgtccatttgacaccaccatagaaaagtaatttatctatgctggaaatttggcaaacacttactctcttgactgtcaatcagcattaccttttgaactgccctaaatacacatttagaaattctgggccccatccctagagattctgtgtcagtgggtatacagtacaataaattaagaagaaaataacctgcatgctcacctcccctattgtagacattatccatggtatgggagaaccagaaaagatatatctgaggaagattgcaatgttatgttccttgaaggttgctggttcagtcactgggtttactgaggcagccaggaatcatgaacaaataaggtgttgaacctcagttgtgctgccttagtcaggggctcagtcctgatcaaggtagcacgtcatccagttatattcttcactggttcatttttcttgaggctgtctttctgaaccattgagcatgtggtttcttagtactaaaccagttcagcaaagggtggaacttagtattgtcatcctattttatttataatgttttggaacaaaaatctttattt

SEQ ID NO: 202842 - DNA, 622 bp, Homo sapiens
acgtgctactggaatttttctaggcttgaagagaaaggctgatctgagaggattcgtggaaatatgacttaaaaggggagaaatgctgagagaaaaaagtttgttttagtctcatgggttgtataaggcatggtttgtgttaagtaattgcaagagcaaaatctaattagatgccgggcttctcgtaacacccactcctttttcttgacgtggctctcctgactttgcctgcggtggctttcatcatacaaaaatgggaggaaaacttctggtcccttttataaaaagtgaaaagaggggacttgattttcgttgaaaataagaaactttaaggccgggcgtggtggcttatgcctgtaatcccagcactttgggaggccgaggagggcggatcacctgaggtcaggagtttgagacctgcctgaccaatgtgatgaaaccccatctctactaaaaatacaaaaattagccagagctggtggcatgcgcctgtaatcccagctattcgggaggctgaggcaggagaatcgcttgaacctaggaggcggaggttgcagtgagccgagatcgcgccattgcactccagcctgggcaacaagagcgaaactccatcttaaaaaaa

SEQ ID NO: 202843 - DNA, 494 bp, Homo sapiens
  misc_feature (38)..(38): n is a, c, g, or t
caatatggtcagactccgtctctactaataacacaaanaattagccagccatggtggtgcttgccagtaattccagctgcttgggaggctgaggcactagaatcacttgaacccaggagacggaggtgcagtggcactatctcggctcactgcaacctccgccttccgggttcactctgggcctggggctgttgagaggttccttgctaagggggttctctctcctaagagctctaggaatccaaggtggaatcagaggtggaaaacagaaatggttgggatattctgagaagaggtcagaatgtggtcagaggggaaagaaccagaggattgaccgtacgtcagggttgtttagcatcttagaaatcatttagggcagggcacagtggctcacgcctgtaatcccagcactttgggaggcataggtgggaggatctcttgagcccaggagttcgagaccagcctgggcaatacaatgcgactcccatctctac

SEQ ID NO: 202844 - DNA, 112 bp, Homo sapiens
agggttctttgtgattcttcaatgccaaaaataaagttggaaacttggattcctgtttgactctactgtattaagtgatcagaataaaattatggtaaggctaatcttcaac

SEQ ID NO: 202845 - DNA, 606 bp, Homo sapiens
tagaacttcctttcttgagggccatgtgagtgagaaagctatagaggaccaactttcccagggcacatttttgtgatgtaatagggcaaattataaaagagaaggaagtaagagttgaagttgatgtatatgtgcttgagagagattgtcttacatgaaagtcgagatctggaacaggtgacatattgagagaaggatgttaggagtatgtggtacatctgggaagccctagagaagactggggctggccacaagtgtggccacctatgtgtactgggcattgggtgttggagggaacagggatgtcatgaaccatagcttatgttgcagctttggatggtagtaattttcactaggtattgtaaagagttttctttttaagactattatgcaaaagtggtaatgtatatactctaacctttcttttccaaaagttttttttttttaaattctgttagaaaactatttaatgtttgggaggaaagactatcttgaaactgctcttatgtaaaaagcttttactttggtattgctgtgtattttacaagtaaagatcttcaggcatattcctgttaaatccatacatcacaagaagaaatctcacaa

SEQ ID NO: 202846 - DNA, 409 bp, Homo sapiens
tgaagcatggcttaaatatcccaaacaaattaacagggaaagtctccatacgagcattgaaggtgcattaccaaaggaaaaccatagtgagtggcagcaccactgcacttcagcctgggcgagagagtgagaccctatttcaaaataaattcaaatttgaatattttacttgagtaacattttttttctcctgaaaataattttctacagtgttctactgtggttgaggttttcatgtttaaatcagatctctagcctcatgggactcatagtctctcatggaagacagataattgggcaactacaatggattatgccgagttcggtgctttgggagctcagagcacaagccccttcctcatctgccctgtagggctggggaggtgctgtcaaggaaggcttcccagcg

SEQ ID NO: 202847 - DNA, 389 bp, Homo sapiens
atatttgaaggtcttggcccaaaagttgaacggccatttgcagttttagaaagcaacagaatgcctaggaaatagatgaaaccaaagaaagctgacaactacagcagtctgctagtgtaactctccaagaaaggtattctaggcaatactgtgtacacaggagttatgattaggcctcatcagcacagtagctagttagattaagcaaactagtggaagagatcagcatgtaaatccttcattcttaaagatcactcatgcatacacatctaattaaatgtcactcaagaggtgcatgagtagaaaagtcattcagcaaagtcaatttctctgcattacttgaaaagcagagctccacatggagtgtgtaagtcccccaaagcaggagc

SEQ ID NO: 202848 - DNA, 484 bp, Homo sapiens
cacactggctatggtatgctcttccatgctcagagcctccaagggtcatctcaatgtcaaaaaggggcagacagctgagtgtctttctgcatgatgtgcctccatgggctataacatcttctgaagcaatgctccaggtgacaaagagtttaaacctcatttcttttacctttatatggcatacctagattttatccacctctatcccagaagacgccataatcatgagctctgaaatcacacagaactgggtgtaaatcctggctctgccactctctagctacatgcttcagggatgccgctcataacctctttaaaccaaagtttcttcatctataaactgaggctgttataaactccaactttagttgtgagaactgaagccaatacagataaaatcctgcaaagtacaattggtacttgttctttcaacaaatacttattgcatagattctctatgccttggggtacagagaggatggga

SEQ ID NO: 202849 - DNA, 663 bp, Homo sapiens
cgcctgtaatctcagctacttgggaggctgaggaaggagaatcgcctgaacccgggaagcggaggttgcagtgagccgagatcacggcattacactccaacctgggcagcaggagcaaaactgtgtcttaaaaacggaaaaaaaaaaactgaactataactgtggctggtggcaacttaagtattcatgacatcctcccactttgagcacatttgattgcttccccaaatcactagttcctggcagaaggaccaaagcagcagagtcaaggcaggcctgctgtcgtgagttgtcatatgcctcaagggaccctctttcccatccccatccattttatggcggcgcttcactttgttttccaacttattcaggtaagtaatttatttccctgtcttatatacccatctgattgggaagaggtgaataacctaaacctgtgaataagatagcaaacatttgcaattagggacatttatcatgcttttgcttgtttcacactttaagaaatttaaggctgggtgcagtggctcactcctgtaatcctttgggagcactttgggaggccgaggcaggcagatcacctgaggtcaggagttcgagaccagcctggccaatatggcgaaaccctgtctctactaaaaatacaaaaaaaaaaaaaaaaaa

SEQ ID NO: 202850 - DNA, 468 bp, Homo sapiens
agctcgtatcatagtacggcgcagtagtgctggaatatcggcttagcggcgccctttttttccagcagagtcaaggcaggcctgctgtcgtgagttgtcatatgcctcaagggaccctctttcccatccccatccattttatggcggcgcttcactttgttttccaacttattcaggtaagtaatttatttccctgtcttatatacccatctgattgggaagaggtgaataacctaaacctgtgaataagatagcaaacatttgcaattagggacatttatcatgcttttgcttgtttcacactttaagaaatttaaggctgggtgcagtggctcactcctgtaatcctttgggagcactttgggaggccgaggcaggcagatcacctgaggtcaggagttcgagaccagcctggccaatatggcgaaaccctgtctctactaaaaatacaaaaaaaaaaaaaaaaaa

SEQ ID NO: 202851 - DNA, 198 bp, Homo sapiens
agtgtacagatagcaaagactgggaccacagtggagggatacctaatccagacaagggcaggaataggcagggaaggcttcctagaggaagtgatttccaagctgaaacttgacagatggaacagaagttagccagagatgggaaaactatttttggtcaatggaagagcaggtggttgagatagaatctgacacatg

SEQ ID NO: 202852 - DNA, 421 bp, Homo sapiens
agagagaagtagctggacttcatgctgcctgcatatgcaccacctcggacagaccttgtacacacagttggggggctgaacaaacggccggggctgaggctgcctctctgttcttgcatccaggagagggatgtccgggagtccaattgccaagctcttacacagtgcgatggagaaaggcctgagctctcctccgtggccttttcacaggagagggaagagattcctacagtggaaaagcaggctggagcactgcgaatttctctggccatgccttgtttacccagctttaaaatgatgcagataaaaagcagagtcaataaggaaagtggtttatattcaaggatctgaattttattattggtaaattgtaatatatcttacatccttgcagggataaaacattcataaaccacatttc

SEQ ID NO: 202853 - DNA, 485 bp, Homo sapiens
gtgcatgcagtccgcgtgtaatcaatttgccgagactatatttcgtcattggacagggatcataataatactttgtaagatacgcaatcaacgggtcatcgtttgcgtgcgtcatgactgcgagaaacctaacagcatatgcattaaataaacaaaaagcaacttaggaagccctactgtaatgcaccttattctatcactgattctattagtgccacacattatagtatatcctgaagatcgtaaaatgatgagctcatcatttaaaataaactgatttttaaacgaaaattagaacatacaactttctactttgattccactcctactcactgttgtggctttttaaccaagagtttattgggaaaaaaaatgctaaatggctgctccacaggacatcaacaagtaccacaaagtagtaatgagcaactctattttttttttggagacagggtctcacttttgtcacctacgctgggatgcag

SEQ ID NO: 202854 - DNA, 517 bp, Homo sapiens
tctcggatcactgcaacctctgcctcccaggttcaagcgattctcctgtctcagcctcctgagtagctgggactacaggcccacacgatcacatctggcaaatttgtaaatttgtaaatttttagtaaagacggaatttcattatattggtcacagtgatctcaaactcttgacctcaggtgacccacctacctcgccctcccacagtgctgggattacaggtgtgagcgacctcgcccagccaaaagataacttttgaaataaaattcatcagtgcaataaatcaattttgttaaacacagattgacgtttacatatttaaacatgatgtaaaagcaatgctagcttattttatcagtaaatatgtataagtttaagaaaaaaatatacaagcagaataaaaatgtatgcttgcattatacaataatatgggtgtacatttccagagttcttgtattcatacactgtataagaagatgacaaacaattttgcaatgaaaaatcttgttcatacatt

SEQ ID NO: 202855 - DNA, 586 bp, Homo sapiens
aggaaatatacatggcctttaattctatcacataaagacaacgagcttctgccaaggttttctgtgtttgcatctcattgtgagtacactccatgcagtttgcatcctgctttcccacttagcacttaacttagggcgttaacaccgttcttcttaaacaacggccacagaatcttccactactacatagcttgttcccctgtttggagctctgagggtatttccatttttttctcattactcctaatgcttgtatgtgtattattattattttcttcaaacagaatatcattgtctgtggaatcatagattgaaatataatcaattttaggtaaatgatcactgaataccttctccagcagtgagcaagagtttccgtttcagggtacccttgacacttctaaaagtctgggggttttttgctttttgtttttttgagatggagtttcactcttgttgcccaggctggagtgcagtggctcgatctcggctcactgcaacctccgcctcccgagttcaagcgattctcttgcctcagcctcccgagcagctgggactacaggcttgtgccaccacgcccggctaa

SEQ ID NO: 202856 - DNA, 410 bp, Homo sapiens
agaccttgtctctactgaaaaaaaaaaattagctgggtgtgctggtgtgcacctgtagccccagctactgggggatttaaagtaggaggctcactttagcctgggatggggaggctgcagtcagctgtaatcatgccactgcactccagcctgtgtgacagaacaagactctgtctccaaaaaaaaatttttttaatttaaattttaaaaatgtgatggacctctgtaataaatggggcctttgtttctccactgactttctcactctaagagggtctgaaccacgtggacttgtgtttagagcttgcagcaggccaggaacaatgtacttgaatgaaccttgtgttaatctaatactggttgaggttcaccaagaggatacaagcgtatggcttcaagtcctcttgaat

SEQ ID NO: 202857 - DNA, 315 bp, Homo sapiens
tagatacagtagtattgagcaaaactaactaaattgactggattgcttttgtaattgcagattgatgacatatcagatccatttagagtggaaaaaatatgttggccatttaaaaatagtcattggaaggcctatgcacctaagagaacctcatgtatcttctgctactgaagtctaatattactaaattcaaaaaggctttaatgcattatgacaaagcatatgaagaaagccttaaggtgaagaaagccttaatagtctactgactgtggacagtaaaaccctttattatctagaacccagagattgagtctg

SEQ ID NO: 202858 - DNA, 590 bp, Homo sapiens
tctctgtatccttgacagcatctgttattttttctttttaataataaccattctaagtggggtaagatgatatctcactgtggttttgatttgcatttccctgatgattagcaatgttgagcattttttcatatgcctgttggtcattttatgttttcttttaagaaatgtctgtttagatcctttgctcactttttaatgggattatttgtttttatctggtaaatttaagtcccatgtaaattctggatcttagacctttgtccataggtaaattgcaaaaattttctctcattcaatatagtcctatttgtctatttctgttcttattatctgtacttctgaggtcttagctataaaatctttgtctaaaccaacattctgaagtgtttctcctatattttattctagtagttttctagtttcaggtctctgtttaagcctttaatccattttgagttgatttttgtatatggtaagacagaggggtccagtttcatttttcccagcaccatttattgaaaagggtgtccttttccccaatgtatattcttggcaccttttcaaaaatcaattggctgcaaacatat

SEQ ID NO: 202859 - DNA, 314 bp, Homo sapiens
gaaacctatgtctctctcacacacatgtcccccacctgcttcagtgagcatgatcttctaaaattggctccgtggaatcttccctaggtgacactggctggactctgacacattcaaattcattctttctacttatctcaactttcaagcactaattcagtctttaagattcccctaatctcaggttgtaattcatttctaacatgtttgtcatgacatcagtggttgcatgtcttcatatgtttatcactgccccctcttgggaatttatattaattaaacattttggaaaagctcagacttaaaatgactga

SEQ ID NO: 202860 - DNA, 534 bp, Homo sapiens
tcttaggacaagtttctgactttgctaaattaaaacattttcccagcatatttcatatatatttcaacctgctgcaccaaaatgaaaacactggcaaaaatttctccaaaaaagagatttcaccatcattctagtaaactttgggacagttaatcaaaacggaacaaaattcaggaccaagagccattcatttatttattcaataaatatttaccaaacaccaaataaccactgtccctgtctctccaagtgcttacagacttctggtaggagtattaagacttctattggccgggcgcggtggctcacccctgtaaatccagcactttgggaggctgggtgggtgcatcacctgaggtcaggagttcgagactagcctggccaacatagtgaaaccccatctctactaaaaatacaaaaattggcctggtgcagtggctcatgcctgtaatctagcttttctttctagccagtaaaagtattttattttgccttatctgaaaaataacaaaggaagaaaacaacagaattcta

SEQ ID NO: 202861 - DNA, 585 bp, Homo sapiens
tgtatatgttatgtttcacaattttattttctaaatactttcagattgcaactgcatttccatataatttattttataattcgttgtgtttcaagttatgcatttacacatgtaattctaaaaagaagtccatagacttgaccacatttccaaaagagttcacagtaaacaaattattaaaaatctctgttaattcatagatactcattccagaaaatacagcaatggctgcatatcaggaatatctttttccagaaaaaaaaatatccgaagttactagatattctgtagtttctgtatgtggagtttctggggtaaatcctttgagttcaatatgttgactatgtgctatgtcatctcaaatatttgaccttattctgtttttcttctctgggtcattgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattat

SEQ ID NO: 202862 - DNA, 643 bp, Homo sapiens
atcctgtcccagctatgtgttgctgaggctggattccaggcatgtgatgtccaagtaaagattcccttctggccaaccgcacttacgggatggagactttatcttgggtgtgatgccactgaaaatactggggccttgatcactcttgcccactcataatgtggaggtcttatgctgggagaggcaagctagagagacctgaggctactccttccctccaccaaatgcttatctcctaaagcagaagtgtcgctcaagagagaagcatgctatcgcccagaactctggctcagagattttgcccagtgggagaagcaaattattattaacaacaacaaaagctctgaatctcttcttcccagaggaactgatttatctgcaacggagtgtagacacattaaagcccaaaatgttcttgaaaacaatggaggacttgctgttttatgatagtgtcaaaaaaagaaaacaacataaatggtggaggttgtggtgcaaactaatgtttaggagactggtaggttcattaagctaaactgtaaactggctagatttttttcaggggaagaaagagcaaagagccttcctgggatcagaacaaatctcaaacacatcaaaagctattcctttcaaggagttcatgttt

SEQ ID NO: 202863 - DNA, 445 bp, Homo sapiens
aaaacagcataccatgattacggttcactggccgtcagttacatcatgaaacagctacaccgagagtaggtggggtgcccagaactttacatcaggaatcccgcttaaccgtggatgcaaattattattaacaacaacaaaagctctgaatctcttcttcccagaggaactgatttatctgcaacggagtgtagacacattaaagcccaaaatgttcttgaaaacaatggaggacttgctgttttatgatagtgtcaaaaaaagaaaacaacataaatggtggaggttgtggtgcaaactaatgtttaggagactggtaggttcattaagctaaactgtaaactggctagatttttttcaggggaagaaagagcaaagagccttcctgggatcagaacaaatctcaaacacatcaaaagctattcctttcaaggagttcatgttt

SEQ ID NO: 202864 - DNA, 138 bp, Homo sapiens
cttggaatggaatcctactccacactggcaatgatgctatggctgttgatgagatggggcactggggagtgtatttgtctggtggggctgtcataaacaaatacctaacgctaggtcatttatacacaacagaaatgt

SEQ ID NO: 202865 - DNA, 326 bp, Homo sapiens
tcaggcaaaattaaaaaaaaaaatgtttaaaaatcagaataatgtcctttaatttggtatccactataaatatttttagggctcccaaacaatccagtttaaaaaataggggataattaatcaaaatatctaaaaactcaatgtaagttttcttttagtgaacttaggtatgtattaccaagtggaattgctgaattaaaataccaggtgttaaaaaaatcaatcatctgtcgtaacgagtaattggcctggtttacacctgtgatggagactggtaaactgaggaagtcaaattcaatttttatttaaaacactatgtggatgac

SEQ ID NO: 202866 - DNA, 838 bp, Homo sapiens
tttttttggagacagagtcttgttctgtcgccaaggttggagtgcagtgatgtgatctcagctcactgcaacctctgcctcctgggttcaagcaattctcctgcctcagcctctcaagtagctgggtttacaggtgcgcaccacgacacctggctaatttttgtatttttaatagagataggggtttcaccatgttggttaggctggtatggaactcctgacctctaatgatcctcccacctcagcctcccaaagtgttgggattacaggtgtgagccaccatgcctggccacctcaactgcttttcgtttttgtttttgttttttttaatagtccacattgtgattggttgtcttcaaagtgttttaatgcattttaggtttccctccctccctctctttttcttggcaatttatttgttgaagatactgattgttggttatagggtttcccactctggatttgcagattacatcccgttggtgtagttttacatgttctgcattctgtgaatcttctgtaagttgttagttgaatctagagacttcatcagactcaagtttgacgctcttttggcaagagtacttcatagatgatgacgtattcttccattaggaagcacatactattttgtgatgtaacggtttttgaatctttactgaattcttggtattttgattactaagcatttagcaggcattatcttacttagtattcagaaataaccctgtgcagtgataattatatttcaacttggtagttgaagaaacgagactcaaagtaagtggcaagacttaaattcgagactaggcaatttgatgccagagcctttattcta

SEQ ID NO: 202867 - DNA, 534 bp, Homo sapiens
gaggtggctgcttcttgcaagatcaagaacccagggcaaggggaacttgactcttagggcacttccggttcagagggcgcataagttcaagtgagaggcactgcagtttccagcagccaccaggggccaaagaggcttggggcaggggggtggcccaggaggccttcgtttctcctgcccaggttccttgaagccccaaggaagggcttttgcctggtggtccagtgggcacctaatcagcctcgcgtgcctccccccggttgactccaacctcagagtggtggtcactttggattgctggggctgattttgacctgcttggaggcaggggcctggacaggatgaaaaggtcccgaccagcacacctgtccaatgctgtctcattacttttgccaaatgctggaaggaaacagtaaatctggacatacggtgattttcccccttccatccatctttaatatgtcttttttctctgatacaaatatcaagtaaacagggacaaccttagatttacggctccaaatgaaaacatag

SEQ ID NO: 202868 - DNA, 263 bp, Homo sapiens
aaaaccaggagtcctactcaagtaagccttcttatgcgagttggaagctcaggtttgtcagctgcaaaaagtacttactgctctgagcaaactgcatatcatttcctactgggcaactgttcttcacagagtctaacagaaggcaatatattgatatagcattaagataaccttccctacatttccctaccatatacttcatttctaggagctaaatttcaaatttctattggattttatagacttttcattgtttccattta

SEQ ID NO: 202869 - DNA, 703 bp, Homo sapiens
ggcgcctgagcccctgcaggtgggtttttagccagctctcagagagggtttggtatgcgctgggcagaccccagaatgtccattaaaccaaccgatgtgtagaggacacattaatattctctccatgtagggtgtgttgattagcttcctaaaaaataattagtaaagacttttttgacactttcgtagctcaaacattgcctgaaacatggccctgttttcattaagaccaaatatcaaaacaacagggacatacgattttatctttctgaaaaatctctcccttcggaatagaaagaccttgagcaatatctaattattcttgtgcctcttaatttgatagtttgaaaaatgttttgtaggctttaagaacatttatggaaatttcctgtccttgccacagatcaaattgtttaaatgatggacggcaattttatattgagctgtgataatagtatctcatttgctgctgcttaaatgatttcctttcctcttaacacatgtaggtcaagttactccttcagcctaaaaaaattgtgaacaaaaaaggatggcaaatggaagaaagccaattatacaacaattttagacttttgaagtaagaccgttgcatttcccatattgattacttttcacttgattatagtgactctcttcagctgtttattacaatatagaccataactcacagactgtacttgtt

SEQ ID NO: 202870 - DNA, 460 bp, Homo sapiens
aatgctacatcaaactggacttcattcttgtcaaaatgtggtaggctcccatttaccagcaccctgccacatgataatgcaacaaatccacaccctctaaacccatgaatctgaaagttggcatcataaaaaagtgctttcacacattgtggttttagaatcaatttattttaagaaaactttttttaaaatttttctttcatgaatatttcattattcatcactctattttctctgctgtagctaagcagaataatgctgagaaaacagttcaaaagttattgtagaagaatcaaatctccactgccagcttaaaatccataacattttcccttttgttgtttaaagtaaaggtaaatgttgactgcattctttggaatcatacccagaatatagctgctgaaggtgagaatacaaagtacaaatttctgctcagaaggtagagaaagccagcaaaaaa

SEQ ID NO: 202871 - DNA, 583 bp, Homo sapiens
gggggaaacattaccataaccttcctttggggaattcatgtgtgtattagcatattaaaggctctcataaggcctgcaatgcagaaatctatttaagttttatctgtttaacccaatgtttcccttaattccagaacattttctttgttcataacacctgttaacacctcctgaaagtgttcacgtagtagacttatctgagaaaagcaatttttgagccgttaaagcttctagattggacaaactaggcaattaatgatactagatcaattcagaatgcaatttgagcctcttccccctgggaaacaaagtgaaaagagtggatctcatggaattaggggagaagtagacccagaattcatggggggtgggtggctgtgaacaggacctgcagaagaggctcggctgtgaatatttccaaggccccttgacctgtgagattctgtagtgaacggttccagctttggccagcttaacaatgtgctgggccccaaggtcttgagagcattgccttttcttccattgaaataagttcgcttgtttgggaccattcaaaggatcaaaataaaatttacttaccaaa

SEQ ID NO: 202872 - DNA, 465 bp, Homo sapiens
agcttcacacattatctctcaccctcttgttctcctgtgattgctgagacaagaacattttttagctagtcagccaccgtgcgaaacagagctgtcctagacattgtggcttgaggcagagctgcctcacctgccctgcaaacttgtaagtgagaactaaatgcttacctttatatgctactgagatttgaagattgctgtacaagcaagagctgactgacacaaatgaaaagcaaggaagaaaggccgggaagaactcagggtgttctgaagagacgagagaagcctcagcttgttaaaatttatattcaaagcctatatctgtaactattttactattttgtctccaaagttttctactgtatgcatgtaccataatttatttcaccaacttctcttcatgaacatgtaggttatttctaattttttactgtgtgaccagtaaaaaagactgcttactaccaa

SEQ ID NO: 202873 - DNA, 531 bp, Homo sapiens
actgcttgaggccaggggtttgagaccagcctgggctgtcaacataacaagaccctctctggggttaaatctgtcagataagtcagtcaagaactagctgagaacaggaaggacagatgaattcacagaatgggaaaggggtgcttttgggcaacagaaaggagttaaaaaaaaaaaaaaaagaggacattgacaaggagaggcagcggcgtactcaaaaggaacgtgactcattctatttaggactggtgctgtgtaataagtgcctgtcccatcctgtgcttcagacgtgccgcctattcacatcccactctacatggtcatactctttgttttgtctggaatattcttccttcttatctcataattttagatccttttcattatttctgctcaaatgtcatcttcttaaagaagtcttcctagaccactctttctaaatcagggcaaccaactcctatcattcttttttttttttttttgggagatggagttttgctcttgttgcccaggctggagtgcaatggcatg

SEQ ID NO: 202874 - DNA, 467 bp, Homo sapiens
aggccacggctaagctcagtgcgtgattaagcctcataaccctccaaggcagttactagtgtgattcccattttacagatgaggaagatggggacagagaggtgaataactggccccaaatcacacaccatccataattcgggctcaggcacctggctccagtccccaaactcttgaacctggccctagtgtcactgtttctcttgggtctcaggcgctggatggggaacaggaaacctgggctggacttgaggcctctctgatgctcggtgacttcagacagttgctcaacctctctgttctcttgggcaaaacatgataacctttgacttctgtcccctcccctcaccccacccgaccttgatctctgaagtgttggaaggatttaatttttcctgcactgagttttggagacaggtcaaaaagatgaccaaggccaaggtggccagtttcctatagaacgcctc

SEQ ID NO: 202875 - DNA, 310 bp, Homo sapiens
ttggcccaaaatggaacaatccctttgtagaaattgttacctcttcacttcattgaaggtttgcaacagtttattcagactgtttctgtccagttttaaccatgtgttttatactaacattgtcctgtctactgcataataaaatccaagaataggtcaggcattctgttttctataggccaaaggccatcgtaagttcagatgtactactcaaaacaaattagcatgagtttttgtaccaaaaatatgtagcattttagaagttatctctttatacaataaaaagataataaacttttttatcaattta

SEQ ID NO: 202876 - DNA, 414 bp, Homo sapiens
ctgaatagcgtcaaactcagggatgtgagctgactgactgcctttttatgtaatggaggccatgtgatagggctttatgaggccacaaatagcactttctgggtcctttcacagtctagtcagtggcccaaccaacatatctggttgttctgcaatctcagtcatctgagaagataacctccaaaatacatgcagtggcatcaggtgtttccttggtaggtgtgcatcttttaatgatggaggacttaggatgaagaacaggtgtgtttaaaaacatcaaacccccacatcattactatttgctgtaaggatctatgcagtttgtattttaagtccttgacatatggaagagcatttgtgagagtaacaggtttgctttgtaatgccaactaaaaagtgtgtatttatactcga

SEQ ID NO: 202877 - DNA, 686 bp, Homo sapiens
tttacctaaggcagaggcctgggcaatggcgggcgcccctcccccagtctcgttgccgccttgcagttgatctcagactgctgtgctagcaatcagcgagactccctgggcgtaggaccctctgagccaggtgtgggatatagtctcgtggtgcgccgtttcttaagccggtctgaaaagcgcaatattcgggtgggagtgacccgattttccagcatcaccaaatgccccaaaacttggacccatggagctggccatcattattactgtgcctgtttgcctcctgtccatagctgcgatgctgacagtatgggcatgccagggtcgacagtgctcctacaggaagaaaaagagaccaaatgtggaggaaccactctctgagtgcaatctggtaaatgctggaaaaactctgaaagatctgatttatgatgtgaccgcctctggatctggctctggtctacctctgttggttcaaaggacaattgcaaggacgattgtgcttcaggaaatagtaggaaaaggtagatttggtgaggtgtggcatggaagatggtgtggggaagatgtggctgtgaaaatattctcctccagagatgaaagatcttggtttcgtgaggcagaaatttaccagacggtcatgctgcgacatgaaaacatccttggtttcattgctgctgacaacaaag

SEQ ID NO: 202878 - DNA, 507 bp, Homo sapiens
accaattctagatgaaaaagagagtccactttggctgggaggaggagaaactgcacagtgaatggaagccaacatcccagggattcaatatctttggtgtgtctaggtagccgtgataccagaggcagccttgccgaaaaatatccatcctccaagcatggcccagatgccagagagagcatcctgactggtgtgatgaacgtctccccgtaacccaacaggctgtacatccttccagagagctgccccctcttccctccaaacaccttgggctggagtactttctagatccctggctcaaccttagggaaagaggaccccgtaaaagattaaaattgaagccttctgtttgccctgatagaaatagaaattaacttgaagtctagaaaataaaagtggtcttatttgtagatctttcgtttttttgtcctaaaacatactcaactagatgctactgctgatgatgttgatgacaataatgtcatgatggttgttgatgatagagga

SEQ ID NO: 202879 - DNA, 218 bp, Homo sapiens
agaattactatataaaagacagggacagcaggaagtagcagtatacccctctgtgaaattttagggtgtatctcccattgaaactttaaacaggctattggaggagggctctgagaggcagactgaccagtcagtgctgggcacagagaggagcaaggcaacctccagtccccacagaatgtgacaaaatcccaagagaaagatcatcagcctggctg

SEQ ID NO: 202880 - DNA, 487 bp, Homo sapiens
gaaagacaaatgaattcccctttacaggagtattatgtggactacaagcctacaaactctgagaccatggatatatcggttaatggatctgggccctgcacatataccatctctggctccagggaatgtgagatgccacaccacatgaagcccttgccatattacagctatgaccagcctgtgatcgggtactgccaggcccaccagccactccatgtcaccaagggctatgagacagtgtctccagagcaggacgaaagccccggcctggagctgggccgagaccacagcttcatcgccaccatcgccaggtcggcagcaccggccatctacctagagagaattgcaaactaacgctgaagccaactcctcactggggagctccatgggggggagggagggccttcatcttaaaggagaatgggtgtccacaatcgcgcaatcgagcaagctcatcgttcctgttaaaacatttatggcatagaga

SEQ ID NO: 202881 - DNA, 496 bp, Homo sapiens
atatctgccaatgtctcatttattcagcaaacgttcatggtctgccatatggcagcattaatacagtgcataggaggcaaacatgaacagaatcaatctatatctggcattgtacatgccatttaaaatatctacatagctaccgatgaaatattgcatttccttatcttctgttgcagtgtttacagttttaacatatttatgtatactgtatacttccatggtgatatgtgattatttgcatctaatatttctctttattagtgctgtgactttttatctcatttccatttatttttctcagtcatcatttgacttcatccctgttatttcttataatttcattataggattatagtctcctttgtttcactgtcatttattttatgatttctcagtcttcatgttcagctggtttcttcttaaaacttttcaacctataagttaatctaaaaagataatttttttaaatgggcatcttcaagccttttgttgt

SEQ ID NO: 202882 - DNA, 499 bp, Homo sapiens
  misc_feature (20)..(21): n is a, c, g, or t
tctagagttaccccccgcannggcgtaacgcactacagtccagaactcccggactcaagcgatcctccagcctcagcctcccgagtagctgggattacaggtatgcaccaccacgcccggctaattgttgcatttttagtagagtcgggattttaccacgttggttagactggtcttgaactcctgacctcaagtgattgtcccgccttggcctcccaaagtgctgggattacaggagtgagccaccatgcttggctgcacactattttttgtgtcttgcttccttggctcagcattgtttgtgagattcatccatgttgtgggacccgtagttcatttttaggaactatatacttgtgtgattacgccacatttatccattctattcttgatggatattacattatttttagtttgggaccattgtaagtattactgctgagaacactcttgtggttttgttttgagacagcatatggggatcctgctagagtcgccc

SEQ ID NO: 202883 - DNA, 558 bp, Homo sapiens
aggggggaacaatcacttacaattttttttttttgaggtggagtttcgctctgtttcccaggctagagtgcagtggcatgatctcggctcagtgcaacttccacctcccggactcaagcgatcctccagcctcagcctcccgagtagctgggattacaggtatgcaccaccacgcccggctaattgttgcatttttagtagagtcgggattttaccacgttggttagactggtcttgaactcctgacctcaagtgattgtcccgccttggcctcccaaagtgctgggattacaggagtgagccaccatgcttggctgcacactattttttgtgtcttgcttccttggctcagcattgtttgtgagattcatccatgttgtgggacccgtagttcatttttaggaactatatacttgtgtgattacgccacatttatccattctattcttgatggatattacattatttttagtttgggaccattgtaagtattactgctgagaacactcttgtggttttgttttgagacagcatatggggatcctgctagagtcgccc

SEQ ID NO: 202884 - DNA, 490 bp, Homo sapiens
tatcctattcactgactttaatatctatccctaggtaagatagggataaatctcctatcctataaattcttacctgtaaattatttgagggaaggagaaataacaaggggtagtgactcttggcggtgttaaagatggcatagcaaaaggcagtgcagtggtaatttttgacagattaagatcagatgttttcggggcaaagcgctatttgttttttgacttccagtggtctgttttttgacatctgtttgtgctgtagtaaaattaatttatttacttttataatgttttaaacacttagccatagtttgggttgcttccagctctcataagtaaatcactttgatgagagtttatgagaatctttaaataatttagggaccaataaaatactgttcttgccagaagatagaaatgatacccatcaatggtactcatgctaaaacttagtgagttaaaagtatttgttttcagagttttaaaaaaaaaa

SEQ ID NO: 202885 - DNA, 586 bp, Homo sapiens
gaaggttgcactgaaagcattctcaattgaaattgtgccatttggctgtagtgtttctgatgctcatttagaactttggaagttgtgggatggtgggcaagtgtgtgacctgggatggagattctctacctctttaagagtgaaaccctggctgggcgccgtggctcactcctgtcatcccagcactttgggaggccaaggcgggtggatcacctgaggtcaggagtttgagaccatcctggccataatggtgaaaccccgtctctactaaaaatacaaaaaaatagctgggcgtggtggcaggtgcttgtaatcccagctacttgggaggctgacgtgagagaatcacttgaacccggcaggcggtggttgcagtgagctgagattgtgccactgcactccagcctgggtgacagagtgagactccacctcaaaaaaagaaaagaaaaagaaaaactttaaaaaatgccgggcacggtggctcccgcctgtaatcccagcactttgggaggctgaggtgggtggattgcctgagcttaggagtttgagaccagcctgggcaacatggtgaaaccccgtctctcct

SEQ ID NO: 202886 - DNA, 728 bp, Homo sapiens
gctgggattacaggcatgagccaccaggcccggcgacaaatactacttctaggccattttgcaagtgagaagggcattcgtgggcacatacgtagatgcagtagagcatatgaaatcagagtaaacaccttcttagatgtcttataattagtgcaaagaagtaacccttaggcaatgtggtatgggtttcaggaggctgcacgtaagtactagcctcattattattaaccagttttttctgtcatgtctctggtcctcagtttcattgtctgttagatgaggtggttggcccagatcacctaaagaacttggaacaaaaatcaatcccttagctccatgtcccagagtctgtaatctggggtgggaccgtgcattggaaattattttcaaattccccagagttcttaatggacagcctcagtggggacccaccagcctagcctagctctgagatttcagctccagcggcctagtgtatgtgtgtgagtgtgaggcatgtgtgctgcagtaaactgctgacatttggcttcttgatggtgtgtgacgagtaactctttgcagctttactgaaggagacccaagttgaaaggcaagcttggtgtgccttgcttagggggacagtcatctgcctggattttctgactttggtaacatgaaatggagccttaagcaggtcggggtcctgttgtgaaacagaaaccaccctagatgaacgtgaaaaagaaaaa

SEQ ID NO: 202887 - DNA, 356 bp, Homo sapiens
ttctttctcacactatctttagcctaatggcattgagtgccctctggaagtgagggttggtgtaaatagcgttcatatatctagttccagtgacttggctataaagttcaggttgaaataggggacagtgaaaaaggaggtgatatactccatctgtttgtttagtcttgtttagggacttctgataagtgcatactctggacacagaacatctagggattattctagccaccatgatctcaggttctgggctcaggaaatggacaatcattggatcagtgtggaaaggatagtgtacaacaggattgagttgggacaagatttgggttatatcataagggccatctctaagacct

SEQ ID NO: 202888 - DNA, 634 bp, Homo sapiens
aaagaacagaaattttactcaatgaaaagcatacgcaccaagccaaaatacaacagtgcttaggcatatagtccagggacccttctagtgctggatgggggaacccaggccctcggcgaggggttggtggggctcaggctggagggaggctgcctatgttcccagcatatgacttagctcaaagcacaagagcaaattctagaatacagaaaaaggcagatatataatgccatgccaatagtagtaagtgcttgaagagacttgaagcagaaccaggagctcaagcagtgggactcaacctggagccaatgctgtaaatacctgagagctttaaaacatcctgtcaccttggttctacttggagggattctattccagttggtttggaaaacagcttggaaatatggatttttaagcactttgggtggttctaatgtacagccagcattgagaaccactaggttggagaatgacaaaacacactattttaggtgggaaggtagactgggtaacatgaggagaggtatgaatgaagagagagaatgagctaagagcatatctcaagtgcattcagctaggtggaccgcacagacaagtcctggagtgagtggatgcttggcttgccctgggaaga

SEQ ID NO: 202889 - DNA, 441 bp, Homo sapiens
catgcagcgcttggtgcttttgagggcattggtgcaggaaggcttgatgcagaatctctgcttatcatttgctgtctgtgtgacctacatcagcggcgcctcagtctgtcttcctgcagaataagaatacagtcagccctctgcatctgtgggttgggcatccatggatccaaccaactgtggactgaaaatatttggaaaaatacaataaaaagagacaacccggcgtatggtggtggagcacctgggagacagaggcagagatctcgttcctcgatcccggcgcgttggttgtaaagtaggaacagtaatagcacctacctctagggccacggagaccgaatgaaataatgcctgtcaagtcacttagtacacagtaagcactcagtaatgctaggttgttgttattataataaatttttagcgaacgggaagaccaag

SEQ ID NO: 202890 - DNA, 239 bp, Homo sapiens
gaggcaaaatagacacacagagacatgaggggcgagtcctatgtgacaatggaggtagagtgtggaggtagactgaagtgctggcaacaatcagcagctaggaattcacaaggaatgattctcctcaacaggtttctgagggagtgtggcccagtcaacatcttgattatgaaattaaggacttcaagcctccagaaattgtgagacaatacatttctgttgttttaatccacactgct

SEQ ID NO: 202891 - DNA, 412 bp, Homo sapiens
tggattttagaatatctgcattatatcaattgatcatccccaaccccaaaattcaaaatcttaaatgctccagtgagcatttcctttgagcatcatgtcagcacagaaaaaatttcagattttggagcatttcagatttcaggttttcagattaaaaatactcagcctataatacatgaccaggtcagaacttccaagaaaattctggaaatactagttttcctagagatgttctatgagaaataaaaatgttcatgttcttctagagtttgaatctttaaaaggatgagtacaattgattgttctacatgacagtcaccctcaagaaatgtgtgctatgtcccagttggctccctaagaaatgatgaagcagaaagtgagaacagatccacagatggcatttaccaactac

SEQ ID NO: 202892 - DNA, 671 bp, Homo sapiens
cattcggtgtggtcaccgcccatggccatggtctctactggtgttttgatttcccgcctctttcagcagacactcggtgagctcctgacttccaactagatcaccagtactaattgcaacaaaccacctcctcctcccagtcagctagcctcatctctccctgcatgtggaaaagatacagaagccagggagaaaaaggagtttggtttgggggtggcttttttttaatatgtaaagtaaaattacattcagggaattaaaagtctgtgtgtggtttaacaggctcctaaagagctccacggggacaaacatgttatgcaaatgccatggaagcagaggtgctctgaattgcctaggccgttgatccaaaagtttccattctcctctgcaacccaatctttaaaatttcattttgcttcttccctcagccttgattccagcacccaccacagtgtcatgctcagtgtttattgatctgaaatgaagctgggctgaggcctggccaggagatgaaactctcttagaaagtttcctaggagcggagattctagcttcagtgtaaaggaggggtctcggttctctgtgtctagtctactgagtctcaggctagttattaccacaattacttttgcaccagcctaatagttttctctgggggcctggtgggttct

SEQ ID NO: 202893 - DNA, 778 bp, Homo sapiens
ctgagtctgaggcagcctctccagtcagagatttctaatcagcttatctagttcttttaaaaccccacagctgatctactttgcctgacttccccggggcctagaaaatgaccctggacacctttctctaactgattagctctggctgatttgtcttaatgctaaaccactgtgtaacagtactaaattatacttaatgacacagtctactgttttgaagagtgctgtgtatgactgactgagctaaaaggattgctggctatgagtgagttttagttttagaattcattttcaaagactcacaggctcaagaagcttgaaaaccacagatgatgtatacagtagctggagttccctggaggctcctttctagggtctctcatttgaattggtgcagaactgaaagcagagagtcagaaagtaactctgcttgtaaaaatggcttaggaaaaggaacttaagattgtgggttatatgtgtgtatgtgtgcacacacatgtatgtttcctgaattctaacctgaaaatatcacatttgtggatacttaaaatactcatatgcattttgatacacaaaagcaattcaaagtatgtaaaaggaggctggaaatgtaagcttaacagtgatattctggagaaaaatgttgtaactgtcactccaggcctcccttaggagaaaccaaacttgtcagatattttggaatggtagctctttttcaggaattagaataactgaagtatgatactgtgttccgtgtgctttaaaatctgtgaccctc

SEQ ID NO: 202894 - DNA, 457 bp, Homo sapiens
cacttgcccagtgctttctatgcctctcatggctcctcatccactaggcttccatctacccagccccaccactggctgctttcccagaactccctaaaactgggctccaccaactgatagccaaggtgcccagacatgcaaagtgcccgagccagggcaatcccagcagggtggggccgtggtactctctcctcacctgttcagggaggtggcaccgtggtggctgtcaaagctccgcccaagtggcataaccatccccagcggcctcaccctccacccttgccctcgagaggaacatttgtagtggtggggaacacagattgtggagaaacagtcagaattcaaatcctggctctcccaagcactcactccataaccttgggcaaatcacttaatccctctctatggctcagcttactcatctgtaaagtggatctattaataaattgttacaagg

SEQ ID NO: 202895 - DNA, 526 bp, Homo sapiens
ggtgggaaacagggcaggtcaaaactcctgtgctgatcagtagtgggatcacgcctgcgagtggccactgcactctagcctgagcaacatagtgagaaccccatctctaattttttaattaagaaaaaatgtaaagtaaaacaagactctccccacagattggggaaatataaaatacttcataataccaaatgttcagaacactgtaaactggtagacactctagaaatatgtctggccctacctggtagaactgaaaccctgcaaaactctcagtggggaaaccccactcgaagtatgtactttatggagactcttgctaatgcacacaaaaagaaacacaaaaatgttaccatgtgcctgtgtagaagaagaaaaaacttcagcgtccatcagcaaagtcagagtggtggaaagtaatgtcaaggagatagagcacagttataaggctgagaaaaactgtcaggtacagaatatacacagtataatacataggtagtttttttttttttttttttttttgaga

SEQ ID NO: 202896 - DNA, 166 bp, Homo sapiens
aagagcagaggtgtgctttgtgaggttctgggggtctgtgtgggtgggagtaacatcctagcctggagagggctggtttcttcttgttctttttgttttgttttgttttagagacaattgcagtgcagtggcacaattgtagctcactgtaacctttaattcctgg

SEQ ID NO: 202897 - DNA, 507 bp, Homo sapiens
aatagcctatagtgcatccacctaaaaatatggcagagtggctccaatatctattaatgataaaaaactttcagtaagctagtaatagaggatatcttgataaagaatatctacaaaaagcctacaactaacatcatacttaatggtgagaaatttgaagcttccccagtaagatcaggaacaagacaaggttgtccccttttaccacttcttttcaacatcatactgaaagttctagctgcatgcaaaaagacaagaaaaggaagtaaaaggcagaaagactgggaagaaggaacaactgcttttcttggtaggtgacccaattcagaaatccagatattttcccaaagtcctacttctctcttaccacccaaatcttccataactagccaattcccctatcttctaccctttctctcactatatgtatttctgctgcgacaacccaaaaccattttttttctgcccaaccaaagtgaactgtcttactatcttcctcccccactt

SEQ ID NO: 202898 - DNA, 255 bp, Homo sapiens
caagtgtatgtgtaaaatggtctttatggtctttttgtgcacaattacgtcaaggaaatttcagagcccaaaggtcaacctgcaactataaggttcctaagttatctatctctttcttttctgcctgctttaagtctgctgttacttttttgctgagatagaatccactgtttgtattcaaccatttcgtttttgttattgttaattgtttttgcaaaccaatgagtttgtattaatatctcctgactagagtgg

SEQ ID NO: 202899 - DNA, 312 bp, Homo sapiens
gcgtcctttgcccactcctgttggccgcggcggctccaaagcgaggtaagctggtcctctacccctcaaactcttcacaaccttcaccccgtttactagcacctgcaaaccacagcctcccttcctgtcccattagtgaatttaaatcggattttgtttttcctcttagttgaaagaaaaaaatctttttgtattcttttgtgtaacctatctcggatttggagaaaattttaattcaaattaatacacttatattggggggggtgagtggtactttcctccttttcaataaatttctatacttgctacttt

SEQ ID NO: 202900 - DNA, 604 bp, Homo sapiens
ctgcttcctgggttcaagcaattcttctgcctcatcctcccaagtagctaggattgcaggcatgcaccaccacagctggctaatagttagtagagacggggtttcaccgtgttggccaggctagccgtgttcttttttaacagtctttgaaggcttcggaaataggtgctttgggagggagagcagttatgggggattgtgagacggccttcagctcagttgagggcaggtccctatctggatttataacttagtttggttgaagtgtcaaggcttttgggtaagagttgaagcctttgtgagaactctctgaaggcaggaactttagcatacattcatcttagtaagccagtgcctggcatactacctgacacacagttaagtttttgtatcagtaaatcaatggataaattgatccttcaaaaaagaaatcaaaggctttaaatcaagatggctgagaattttgtccagagaatttcaagaatagtcagatgcttctgataagtacttttagaatgttaagattgaaagctgagagactttattcctataactccactcctagatggaaaaaactcaccatgtcgtcctcctcatgtttgac

SEQ ID NO: 202901 - DNA, 561 bp, Homo sapiens
  misc_feature (419)..(419): n is a, c, g, or t
gccttggcctcccaaagtgctgggattgcaggcgtgaaccaccacacctggcctatgaacattttaaaatgtcaaagatgacttccaggtttctggaatgagcttgcttatttatttatttatttatttatttatttatttatttatttatttatttattttgagacaggttctctgttgccaaggctggagtgcagtggtgtgatcttggctcactgcaatctggacttcccaggctcaagcaatcctcccacctcagccttgagagtagctgggactacaggcatgtgccaccatgcccagctaatttttgcattttgtggttttgccgtgttgcccaggctggtcttgaattcctgggctcaagcgatcccacccgtcttggcctcccaaagtgctgctattataggcgtgaaccnacacacctggcctatgaacattttaaaatgtcaaagatgacttccaggtttctggaatgagcttgcttatttatttatttatttatttatttatttatttatttattttgagacaggttctctgttgccaaggcttggagtg

SEQ ID NO: 202902 - DNA, 702 bp, Homo sapiens
gccttggcctcccaaagtgctgggattgcaggcgtgaaccaccacacctggcctatgaacattttaaaatgtcaaagatgacttccaggtttctggaatgagcttgcttatttatttatttatttatttatttatttatttatttatttatttatttattttgagacaggttctctgttgccaaggctggagtgcagtggtgtgatcttggctcactgcaatctggacttcccaggctcaagcaatcctcccacctcagccttgagagtagctgggactacaggcatgtgccaccatgcccagctaatttttgcattttgtggttttgccgtgttgcccaggctggtcttgaattcctgggctcaagcgatcccacccgtcttggcctcccaaagtgctgctattataggcgtgagccaccgtgcccggcgctttgtttaggttttggaggaccctccattactgttttccactgccgtgcaccgtttcacattcccaccagtggtgcacagggctccattttccccgcttcctcgccagcacttgttttctgtttcataatcagtgtgtggtagaatctcattgtggttttgattttcatttctcttatgattagtgacatggagcatcttttcctgtgctttttgatcatttgtatatcttctttgaagaaatgtctatttaggctgggcgctgtgtctc

SEQ ID NO: 202903 - DNA, 251 bp, Homo sapiens
aaaaaaaaaaccaccaccaccaccaacagaaaacatcagtcattggatttcaggtctgtcttcaatccaagattatctcatcttcaaagactctcgatccaaataaggtcacattcctaagtaccaggggttacttgagggccaatattcaacccactacaccaattaatatccatcaggttgggctcctaaaataatgtgtgtttgcctctcatggcaatcatcacattcctcctggaatccaacctgac

SEQ ID NO: 202904 - DNA, 445 bp, Homo sapiens
gaggttgattctgtggctccaggctgcagcatcagtggaagtgaaaagctgtttggctttaaaattgtcaacattttgaaaataatattttgggaataaaatctggaatttaaacaaccttcaattcacaaaatcataaaaatcagagatcctggttcactttcttagcaactgcaaatctgtagtatcagactactgtgatataagtatcaggggaagacaagagaggtagttagtgaagtgggtgggccttgggccaacagatcaaagtttgaatcctacttttcacttcctagtaggagtaaaacacattttctgagcctcagtctcctctgtaaaatgaggacaataatacctaccttcctgctagaactgctgtgaaaattaaaatgtgacaagtcttgttgaacacttatcctagcatacagtaatgatcatgacctag

SEQ ID NO: 202905 - DNA, 486 bp, Homo sapiens
aataaagatgctgtgaacattatacctgagcacctattttgagtatatatccagggatagagttactggataatggagccacatgtatatttagtttttcctgcagcattttactacagaaattttcaaaaataaacaagagttgacagaattgtttgaatacccatattcattcctaccacctagattctgcagtaaacgttttgctgtatttgctttcacacatacctattcgtcgttcttctgtcaatctatcctgttgatgtgtttcaaaaataagttgccaaatagttttccaagtggttgcactaattttctgcttgtactgacaatatgagagtttcatttgtgccacgtcttcaccagtatctggtattgtcaatctttatttttgaaactttttttagctttgaagtataattgatataattatatatacttatgatgtacaccatggtgttttaatatatgtatacatcatgaaat

SEQ ID NO: 202906 - DNA, 164 bp, Homo sapiens
tgaattcacttcttcacatcgattcacactgagtagctattatggcgcaggttgtaaactgggtctatttgttcaagtacagagaaatggaaatacagcagaaaacacgtaaacaatatgggactctcaatcttcttgctataaatggaggtacatcatcttat

SEQ ID NO: 202907 - DNA, 937 bp, Homo sapiens
gacattcaattttggacactggataaataagcctactccaccagaccagagttttccttcttttctgggaggaaggcaaagagcaggcaggggagacatataaataataagtagcaaatgaaaaaccctacaaacaaaacgaaacaaagaaaaaccctacaaacatttaaactcaaagacaaggatatggaagtccaatccagatcatggaaacaggtatgcaagtatacaggtataagaaagtgtatctaaagaagattaaggaccaggcatggtggctcacggctgtaatccctgcactttaggaggatgaggtgggaggatcacctgaggttgggcgttagaaaccagcctaaccaatatggtgaaaccctgtctctactaaaaatacaaaaattagctggggtgtggtggtgcatgcctataatcgcagctactcaggaggctgaggcgagagaattgcctgaacgcaggaggaggaggttgaacccaggaggcggaggttgtggtgagccgagatcgtgccactgcgctccagcctgggcaacagagggagaccctgtctcagacaaaaaaaaaaaagaagaagattaagaagtgtaatgtggtagctcatgctgaaattctgtagggacaggaaagagccaataaaataaaataaaataaaataacatgtatggtctcttctttttaaaaaaaagttaaattttttgttggtgaaaaattctaattatatatatttatgaggtataaagggatgctatgatatagtatacaatgtggaatgatttaatgaagctaggtaacatatccataacctcaaatagttatcacttattcctcctaactaaaacactgtaccttttgttcaatatctccctcaccaaagcccataataataataaattattactacacatttcaattacgcgcgcga

SEQ ID NO: 202908 - DNA, 230 bp, Homo sapiens
aaaaatggattgcaccacatattacaccgcctgcctttctcagaccgtcctggtgcaactttatcaagtaagaggccacaaggacattatttttgtttttaacgtgtggcaagatagaccctctttttcaggagttattttcttttcgtcaagatttcatatccaaatatatttaacaagatgactaaatctagggcataagacactacaaaagaaaaaacatcagacaa

SEQ ID NO: 202909 - DNA, 300 bp, Homo sapiens
gaagagacccgcgcttctgtgactcctgcaactcacatactgcacacatgtaaggttagcgataaaattaatgagaagactaaagtctctgaaatgaaacatttttggcatgtgataacctgatatgctcccctcaaaagtcccttggaattagcctagctatctcagcatagcttttcttacatcatgggtattacattagccaagccaacttgtctatttgtccttgtctcacatcacttttcaccctcaacttttactccatttatgccaatctccttatccacagcaagatgctac

SEQ ID NO: 202910 - DNA, 442 bp, Homo sapiens
ctataaagtatgaatcagtatgtgcatcataaatggtaattattgatattgcatgaggtcagaccagcttcctctaatcactcttcccatgacttgatctctttggattatctcctcaaagttttttggttcctgtatttaaaattaaaagtcagctggggtcgagagtaggggctcacacctgtaatcccagcactttgggaagccaaggcaggcagatcacctgaaggtcaggagttcgagaccagcctggccaacatggcgaaaccctgtctctcctaaaaatacaaaaattagccaggtatcatggtgggtgcctataatcccagctacttcagaggctgaggcaggagaatcacttgaacctgggaggcggaagttgcagtgagctgaatcatgccactgaactccagcctggttaacagagcatgactccgtctca

SEQ ID NO: 202911 - DNA, 544 bp, Homo sapiens
tgcagtataatgtagtggtaattttaaaatacatgttgaggttaatatgagcgaaatgatggagcagcagctccaagctttcatcctcctaaagaagcattaaaaaaaaagcagaaactgtcaaaagtaattttgtcaaaactcagaaaaagagtcaaaggtttacagcaaccaagtaaacactgattaaaaaaaatagtaaaaaagtgacttcaaaatggtaaaaatctttgaggagttttttacttgtcctacccaatcctgttcctggctctatggcagtcttcagacaccaacaattagtgttcttagaacagagtcctggcccctggttccagaggaagcagagaagaccttatgcacaaattattgtatgtgtctcttgtaacctgtctggagactacgtgaaagaaaagatgctcttctctgtttcatctgtctcagaactctagccataaaatcttcctggaaaatggaatggaattgctcaaaaaacaatgcaagctgaattaatgacagacagatgttaggttaaaagattaaa

SEQ ID NO: 202912 - DNA, 457 bp, Homo sapiens
  misc_feature (27)..(27): n is a, c, g, or t
ggagcttcaaagtgcactcttctatanctacacacacacacacacacacacaaaacaaaagaataaaagaataaacttgatgagcatgttggcaagccaccaagtgcctgctccctctaaagagaggtccagcttacacatggagtgtaggctttaaagcgtacctgcccagtgctgctatgactctgtcccatttgcctaactgctcggtgctacggtttcctcatctgtgaaatagggataacaacactatctacctcatggggtggttattaggattaaatgagtagaaacgtataaagcatttagcacggcacctggctccaagtgagcaagacattccaagccacattttaaaaatatgtgatgcaaaccttgaaaggcatcatttatacaaaatgtccagagttggcaaatccatagagacagaaagtagatatagaagagtgcacttggg

SEQ ID NO: 202913 - DNA, 672 bp, Homo sapiens
ttgtcttgtgctggaataagggttaaagaatgatgtagaaagagaagccaactcaggttagaatacagacaattccaaattcatttgcatattccaaaggtgtatctagaggcaagaaatggatagtacaaatgaatcaggaaagaagcacagctagcaaggagcttaaggacatctcagactaacatttcattttgtggttgaggagacaaagaagttaagtgacttgtcaaaggtccaccaacaagttagcagaagagttgagtttagaaatcagtaactaccaacatttagtgggtaaaatcagtacttgtactgaaaactaacattttcagaaaaggttggcatggagaaacagagaccttccctcgaaaccctagtaaattatccataaaaccctctgaaaagaaaatttctcagtgatactcatgagtgttaaaaattgagcatatcccagattctggtagaagtttctataatcacctatattaatgagtggaattaagaaatattcactcatctttcctctcttgtcccatcaaatataataggtataattcaaaagtacaacattataaagtgaaacagattagatattcacagtagtttccacaattcacaattcactgtataaaatcccagggttacttacaaataagtaataagagatca

SEQ ID NO: 202914 - DNA, 508 bp, Homo sapiens
ctgtgatactgaaagtaatatcatcctcttccctccaggatcgtgggaacaatatccttgggggtgtccactttctgccatatgtgtagtcatatcaccccctccgccttggaatattattaagaaccatgtcacacgggggtgtacacttcctacgatgttgggagtaatagcattctcttcttccatgaatattaggaacaaaatcaccgggtggatgcacacccagtgctatattgggagtaatgtcatactccaccccctggagattatattcggatcaatatcaccggctgggtgtgcacctgctgcgatattgaacgtaatatcatgctctctccctccctgaacattaggaacaatatcacaggtgggtgtacacccactgaggtattagggcatactattagtatgaattattccttgttttttattaacatgaatatgaatggccgatattaatattaatattaagaagtaattgctaataaaaagttctcagattatt

SEQ ID NO: 202915 - DNA, 340 bp, Homo sapiens
tacaaatttaaaaaacatattccctgctattacagaactcaaaatctattttaggagacaaaaaaaagtaaggagatattacaatgtgatgtatgctatgatgggttggatggtatgaccatataaagaggacaaattaacccagcctgtaggcaatgataactggtcttgaaagaaatgtaggtgttaaatagataaaagagttagattagagaaggatgggtaggtgggaagagtattttaggcaaaggtaaaaagtacaaagacatggagccatgagcaggtatggcacattctggatttgtaagcaagatggtacagataaaacaggttgcagatg

SEQ ID NO: 202916 - DNA, 405 bp, Homo sapiens
attgttgaaaacattatttttaagaataacaattttagggaaaattgtattttcagagagcctacaggtctaattaattactgccaatgaaaatcaatgtaactgcctataaaattattgattggcacttcctctgttctcatgcagctctaaatcacaaatctgctattttcacataataaaattgaaataaatgggggaagggaaattacagggatgtggctcttacctaacagccaggagactaacttgctcaaggcattaagcccttacttaacctatggtaaataaaccttattaatcaatcagaaaaatattattaagctaagaaaataatattgaggccggggacagtggctcatgcctgtaatctcagcactttgtgaggccaaggcaggcggatca

SEQ ID NO: 202917 - DNA, 544 bp, Homo sapiens
tactgtgccacacttcatttaacataatgtttttggagttcatggatgttacagcatgtgtcagtggtttgttccgttttattatagagtagtattcattgtatggattcactgctatttgtttatccattcaccaattgatagacatttgaattttctccagtttttggctgttatgaagaaagctgttataagcttacatgtacagtctttgtgtaggtatgtgtttacatttctttagtataaataccttggaataagattggcaattgtggattatggaaatataaaattttatggtaactttataagaaactgcaaaatttttctaaaattttctaaaacgcatcattttgcctttttacttgccatgtagaagagttccaggtgctcttcaccatcactttattttttaatgttcgtcctcttgtaggtgtgtatggagtgatactcattgtggttttaagttacataattacagatatgttaagcatcttttcatgtgcttgtttgccattcatatctttggtaaagtgtctgctca

SEQ ID NO: 202918 - DNA, 544 bp, Homo sapiens
aataatatgagcatttaattatatgtttaaaaaaatagataaaacagttacaccaacaaactcaaatctgttcaaaagcaaaaaaatcagggaggaatatggaacctttgaaatggtggagtaaggacttctgaaaatcttctccataaaagcaatgagaacacttgcaaaaaaactgtcacaataaactttttcagaattctgggaattaatcaaaggcttttcacaatccaagagtgcttttcccaagcactctttgcttgactgaacttcagtcaggctcctaaacctgactaaacctcctaaaaatgactgaattttgctaagaacagtgaccttttttcttgccctaattccatctccatctcttatactctacaaaagatgtgaaagccaagagctttataactatctgttttaaaaagcagtagcttagcagccagtgcaagatacagaacagatttggagctccctaaaagccccatctctagagaactggcattatttaacctgtttagcagcttctgaaaagcttcattctcag

SEQ ID NO: 202919 - DNA, 546 bp, Homo sapiens
caggacagtccgttcagaggggggtaagcaaaagaacttcactaattcccatctcccagcagtgccacctccctaccctcctggttgcacatggctgagcatccatggggtcctgggagtcttgcccctcagagtcaacagggagccccagggtggcagacatgaggctaggagctgtggcatttgtccacatgaggacagttttcacagggactgagccaagactcctgagttgattacagtcaagaggacctgaggcagcacaggaaagatgtctcatacagtgtctagctcgtaattaaaactctcattccaacttccagcaacatttagctatcttcctaaaagatagagttgattttatattcaaaaagcagtactaataaacagagacctcttccagctggggatttgtccatcgagtgttatatttccttctgcagaaatcccccatgcagaagaccgtggatccccggaaggtcttggtattgttgtcagagaagcctgaacccatacactgcacaaactctacaagcttgttatgta

SEQ ID NO: 202920 - DNA, 762 bp, Homo sapiens
cgttttgagtctttgttgcttgatgttttgtttttttgcttttggttttggtttggtagtgttggtcttctcttttcggtagcagcactcttgatatgctgtaggttgtcttctgcctgatttttggtcctgcagcccatccgatgttctgtggtgcgtccgacatttactacactggtttcatttcgggtgtgataggcgtttctggatcagagctggttgtgtcattgtgctaggcgagggttggttagattttcgtcagttagttctgttggtgggctgttgagcagacaaggggcttgcagggtcatgaggtgcgatcatgcactgtagatatcaacatttcaagaagcggcactgaaatcccttgaaattgaaaagtcagcctacatgaatgcttaggagcaaaggtttgaaacataataagtctgtatatattcagctgagagaattttcagaaacatttgcagtccattgctaccatttatggatacctatagattcatttgcatacttctcacgagttcttatttaggtggtcaatttgagttatctaaaatggtaacaaaactccccaaggttacttaaaatattttatgtcttttgaaaacacagtcattcgtacaataacctttccttaaaaataaagccaattaaaatgaagaaatatcttttgatttccccctatttccgtctatacgaagacaaacgacatctctttcgaccctggcctccatgaccctctgtgctgcttggtcataa

SEQ ID NO: 202921 - DNA, 442 bp, Homo sapiens
tgtgagccactgcacctggcccaaataagcatttattaagtgttttactttttcttgtcattaatacataattgagtggataagttctagaattttcagatctaacagggacatgaattgtatatagttgataaacagtgggaatgattttgaaagtgcagtttattagctaacgtgaagcatgtgctagttcttctgtgttagatttagtggtaaatataagaaatctgtctttgacagtcaaataactaatcaagaatagttcaccatttaatgttgtttgtttgttttttaacattgaagaacctcagtatcaacaagtatctttggttcagaaggtcactgagcttgttgaattctttttattttctgctggagggcgttttttgaatggaagcatggtgctatacgtgaaggggcagaagtcttacatgattgaata

SEQ ID NO: 202922 - DNA, 468 bp, Homo sapiens
gatgttttgaaacgtatcagaccaattaatataccttagttcatacagtcatcatttttttggtgaaaacccatttaattaagttttaatcttttagcagctttcaagtgtatttatcattaactgtagtcaccatgctgtacagatctacagaatgtattcattctatgtaaactttgtaccctttaaccagcatctatccatttcccctcagtcctctcccttccacgcactaagcacctagtaaccactattctactctgcttccatgagtttgacattttagatttccacatataagtgagatcacatatttgtctttctgtgcctggctggtttcctttagcataatgtcatccaggtttattcatgttgtcacaaatgacaaaattaccttcttagaggctgaatagtatccagttatatatagatacactacagtttctttatccattcatcacatagacg

SEQ ID NO: 202923 - DNA, 707 bp, Homo sapiens
gagccggacgtcccctgcagaagtagaggacgcctaacgagatcgaatgtgtcggagctttcggacatgtctatgcggacgccctcatcgctgggtggaataagagggactcttcctcctcttcctcctctttggaaatatagaatctgtgaataatgaagactgaatattgaaagtctttaaaatgtttgttactaactttatagtaattttggtgtttatttctcatttaacgaagacagtattcaaggtaagattttgtatcttttcaaatgtttggcaatttaagaaatagaatttgggggaatagtctaaaattttgtggcttaggatgtagtttaatatctaacagataattttggaaatagaaaatgtgaattttgattgcaattattttgaaatctttaccagattgtcccagaagaggttcaaacaattggtagagagattgctgcaatttatttctttacgcctgtttcctgcaaagcctgaagaatttccacctataacaaagtgttcctggtggattccatcagccgctaaagtgttggctttacttaatactgcaaacaatttagttcaccctccccttattccttatactgatttctataattctacattggatcacattgatctcatggaagaatatcatacttggcaaaactttggaaactctcacaggttttccttctgtcaagtacccc

SEQ ID NO: 202924 - DNA, 636 bp, Homo sapiens
ttttgttacattttagggatatttcttaaggatttcaaaagactatagaggcattcttaaattttaaaccatttctgtgaaggaaagagttgtaatttattttctactttgataatagatttcataatttataagcatgaaaaaagctttatgtcttttagtggacagtgttctgtattatggcaattaagtgcatatgagctaggacccctaagagagaacacacagaaataggagtaaatggccatctgcatattccctttaatactattataatcctcaccacaagttttcttttttaagcaagaaactattggctgcattttaaccacaatttttaaattacccctttcatttggagctacatttatttaaaataggagtttctaggtcaaggctgtcttgtagacattaaaatgatgtttttattattagaatgaatcttgtacatgttggaaaaagtctttatgttagaatttatctttacagatactgcaaacaatttagttcaccctccccttattccttatactgatttctataattctacattggatcacattgatctcatggaagaatatcatacttggcaaaactttggaaactctcacaggttttccttctgtcaagtacccc

SEQ ID NO: 202925 - DNA, 609 bp, Homo sapiens
ggggtttcaccgttaaccaggatggtctcgatctcctgacctcgtgatctgcctgcctcggcctcccaaagtgctgggattgcaggcagtgagccaccgtgcctggcctcaagctttctttttctctcttgtttgtttcaaatttggtgaataggtcccattcacagggtcaaaatagaaagcacccaagaccacacatgaaggttctccctcctctgcctggtcacccagttcccctttttggcgacatcactgttaccaactttccagggacattctgttcataaacatacacgccaaaccacaccgcttaggagttggcaaactgcagtccacaggcctgctgtggtccgctgccggctttgactaatagttttattgggacgtggtcacacccatttttatcttattacctgtggttgcttttgtgttataagagcagagttgtgtagttgcaacagagactatgcggcctacaaagctgaaaatccttcctatttggccatttgcagaatcattttgcaaagcctgttctttctcccttgcctctttgtgtgtgtgtgtgcgtgtgtgtgtgtgtgtgtgtgtgtgataaaatgtatgtaacag

SEQ ID NO: 202926 - DNA, 604 bp, Homo sapiens
ctagcagtggacctttaggctggttgtttaactcaccaggaaaaatgacaggactcacttccctaccccatcaggttttgtgatggttgaaagggggttaccacacataaacatatgaaaaagcacttggcaaataatcttctttcagtaagtgttagagatgctgctgttacattactggcctacacagtgctgagaaaaaatatgtcttttcgtctatacttagtggcagcaaagagttgcatggaaattaattcatgggagaagtgaggctgaatgcaggacttggattgagggcagaaacaatggaaggcataggtcagttaccaaagccaggcctgggcttgcaggaaacagcagagatctgagttacttggtgcttatcagtgagctgacacaaaaagaatatttttgaaaaaaaaggtaacatggttgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataa

SEQ ID NO: 202927 - DNA, 405 bp, Homo sapiens
tgggaatgatgatggtgagcttcttcctcacagagttgttctgaataataaatgtgtgtgtgtgtgtgtgtgtgtgtgtgtgtacatgtgtattacaaatgatgcagcagggtgtggtagctcacgcctataatctcagcactttgggaggctgatgtgggaggaacatttgagcccaggagttcgagaccagcctggggaaacaaagcaagacctcatctccactaaaaaacaaaaacattagctaggcgtgatggtgtgcacctgtagccccagctacttgggaagctgaggtgggaggctctcttgagtcccaggaggtcaaggctgcggtgagctgtgattgcgccactacactccagcctgggtgacagagtaagaccctgtctcaaacaacaacaacaa

SEQ ID NO: 202928 - DNA, 617 bp, Homo sapiens
tggcactggagttgaacctgggacttctctggaagggagaagtgaggagaaggcagcttttcttgggtagagcaaacaacacgtgcaaagggacatcagacagcaagtaagagcaggagactttgctttggagaaagaaccgaattcgatcacaactcactctccctagctaggtaaccctgggcaagccaaagaatcttttctcatcgacaaaatggaaatcacaatgtctacttcacaggaaggattaaacatgatcatgcatataaagcacgaagtaaaagctggaaaaatagtagctactgtgattaggtgcaagaactgtgggaaaccaaagggcaggaggtgaggctcaagggattgctttcagccagtctcagaaaggtcctgcatgccaagtaagaggttaggattaactgctgaggacaataacaccatagaggtttttaacaggagtgaaagaattgagttatctgctttaaaagaactctggtgtccgtcaggggtagtctggggaggagagcacttgggagggcacctgagagatgaggatatagattcagagtaatttcagtaacattagaaagcaaggcatgcactccagaaatctttttttt

SEQ ID NO: 202929 - DNA, 460 bp, Homo sapiens
ggaatcccaggctgatgcctagggaagtagccaaaacagggtggcacagaggaagtggctgatcacccatcttgattccacaaggctacccagagccttctctggcccaggaaggtccagggaagaggcccgtctagtgggcatgggagccatgtggataccttggagcttccaggtcaagaacagagatgggctatgttgatggaggtttgttttgtagcagttagaagtgagttggacctcacttttggcacagaatttccagtaaacctgcatttgtagtccttgggtatggacagaaactcacgccatcccaaagctcttagggggtaggttcatcttgaggcccagccagtaccccaatcctccttcctctgagaggcctggcctcctagagcagagcctctcaacctcagtactactgacattttgggctgggtaactggttgtgatgggggct

SEQ ID NO: 202930 - DNA, 1315 bp, Homo sapiens
ccgcttctgtggtcaggaatctggtgcagctcagctgggtcacaggcctctcacaggctgcagtcaaggtgtcagtcgaggccgcactgtcatcttaaggcccagcagggaaagcgtttgcttccaagctcgctcacgtggttttgggcatgattctgttcctcgtggctgttggacagaggtcactctcattttctttccacgtaggcctctgcatagttcacatctttgcagttgcttcattgaagccagcaaacgtgattgtggcaagatagcagtcatagttttaattccagaaatgatcccatcccttggctgggtcttcagagtagaagtcacaagtcctgtccgcactaagtggagggtgtggataccaggaggcaaggatcattgagagccatcttagaagtctacctggccggggtgcagtggctcacgcctgtaatcccagcactctgagaggctgaggtgggccgatcacgaggccaacagatgaagaccatccgggccaacaaggtgaaaccccgcctcttctaaaaattagctgggtgtggtggtgggcacctgtagtcccagctactcgggaggctgaggcaggagaatcgcttgaacccaggaggcagaggttgcagtgagccgagattgtgccactgcactccagcctggcaacaaagcaagacttcgtctcaaaacaagtctacctgtgtattagcttgctagggctgctgtaacaagtgaccacacactgggtgctttaaaccacctgaatgtatttattctctcccagttctagaggctggacatctgaaatcaagatgccagtagggccatgctccttccagagggtctaggccagaatccttgccacttcaggcttctggtggccccgagcattccttggtgtgtggcagcatcacgccaatctctgcctcctccctgtgtttccatgtgtgtcctctcctttccttattaggatgcccatcattggatttaggccccaccctaaatccaggaggatattatctgcaaatgccctatttccaaataagatcacattcacaggtgtcgggggttaggacttgaacatacttttttgggagacacagttcacccactatgtctacctgctacaaggcccatcagtaagggatggattatataaatttaggcatatctggtggaatactagatctctggggaaaacaatgaaaaagaagctctttatatattgataagggataagggatggtccccaaactatcaaggacaggtagcaaggtacagaacaaagtgtatatataatatgttctctttg

SEQ ID NO: 202931 - DNA, 517 bp, Homo sapiens
cattaacactttaccccacaaacatattctagccaccaatatcagatatactttctttaaactctaccttacaaagggcattccttttctcataagcatcactcatgtttcattaacaaaagcaaggtcagttaagtacattagcacattctctggcctctacctacctatttgactttctctctcacagttatcattcttcaaagactcttctttccaaccaaattgctaagagcactgatcctcatacctagagcagaagttcccaaagggaacttcgaggagtctcagagattgaagctattttcataacactcagatgttatttacaacccttttcactgtgttgacatttaagtgatagggcacaaaaaataaatgataacattgctggcatctcagcatgaagcaagacagtagcataagctatattagtggttattgtgttccccaatgtaataacgtccttgaagcggtaaaaattattaattttattaaatctcaaccccaaagtatt

SEQ ID NO: 202932 - DNA, 540 bp, Homo sapiens
cattaacactttaccccacaaacatattctagccaccaatatcagatatactttctttaaactctaccttacaaagggcattccttttctcataagcatcactcatgtttcattaacaaaagcaaggtcagttaagtacattagcacattctctggcctctacctacctatttgactttctctctcacagttatcattcttcaaagactcttctttccaaccaaattgctaagagcactgatcctcatacctagagcagaagttcccaaagggaacttcgaggagtctcagagattgaagctattttcataacactcagatgttatttacaacccttttcactgtgttgacatttaagtgatagggcacaaaaaataaatgataacattgctggcatttgatcattgccaacaaatagtgtcagttgttttccttgaagtgacaggtccacctcatttatttttgtgaaaatgtctacccatacccaaatttgaataaccatagtttgtctgtcagtgttctttgcacgtaaatgaggca

SEQ ID NO: 202933 - DNA, 599 bp, Homo sapiens
tttgtgacagaaatgtttggatgctacattatagaatggcttttgaagaccattttaaaatttgaataatctgagaatattcagagtatttggcattaacaaatatttctactttcagacatgttttccaaaacttccatttatataagcaaatttttaaagagtctctgtacttattagtctaattctactcctgcttatttaggatgtttatccagccagaggaccacgaaacaaaaatattgcatttttctggaataataggaattaggaagccagaacaaaccctaagtggtggcagctttttaaaatgagggaatagcaggcccagtttttttaacctgtgagaaaacaggtgaaattagagaactggcctggtactgaaaagagacctggaggaggagagggtaaaggtgttgatttgacatgggggggtttctcatataacctgtgctagcatataggttccctggccagtctacaaaaacccgtgtaatagctgaaagaagtggtggttctgttgttttaaaaatgtaggcaacaagatcactgcacacaagtgcaatagtaattgaataaaacaggattcctgcactgag

SEQ ID NO: 202934 - DNA, 433 bp, Homo sapiens
cttccttttcttctgccctgtggtctgattggaggaacggggagggcacatgagagggcggtgcacagtgtaggataggaaataagtcagtgctaaattgcatcataggaatttgtataaattctgtcatgcggagaaagaagaaacattagggtatgcttagttggagaggccttgacagagaagtgggattaaagagggttatgaagaaccaaaaggtgtaagctgcagagggttctgagaaagtctctcttcctttcctgtttctccctttctggttagcacttccttggtagactgtaaaagatgtagtctctcctaagctgctttacagagcacatgttaccgctagatcaagtgtgtttatgggcaggaggagactgtgttgacagataagggaggttcctctcatttcctttgcctatctccaaaa

SEQ ID NO: 202935 - DNA, 375 bp, Homo sapiens
ggccaagatcaacccattcttcttcacattcctatcatctattcagaagtgcagatattcacatggaaatgaggttggttgaactgtttagcttatattgggaaacatatctgctaagcagctgagaaatgtattcatttcagtctttccatttgacaaggctcattctcccaagtaaaatactaagaatgcaatgacagcaactgaagccgttccatttcctctcctgactttaatctctccctaagaaaaatatttcttgaaatgctataatgtgtgtgcattgacactcttacttagatatttaaataggcttgtcctatttattctctatgtctggccttggccttgccatatgcaagggtaccgagctcg

SEQ ID NO: 202936 - DNA, 410 bp, Homo sapiens
ctcccctggctgcggtgagcgctgggcccaacccccggcctggagcagcgccccaactccgagcaccgtggagcaccggctgccagctgagaccccagaggggtaactaacggcctgaggaaggcatttcttcggggaacatggcgtgcccgtcgtggctacgttctgccaagccctgtgacgttggaggggagccgcctgcatcccccgctcagccagtgtttctagactccgagacatctggaactcggaagtgaggccagggctccaggaagactccctgatgacgcactggcccgcagcccaggctcaggtagtgggggctgtcaggatgatctgtgggatcccccagtgtccgaagaaagaagccacaattgtgtttttttttctttctttctttttcttttttt

SEQ ID NO: 202937 - DNA, 219 bp, Homo sapiens
ggggggcaggagtgtgtggattgtttacggccttcatacatttcgtgtcgaatttattttctgaagtttctcaagataatccaatttattaaagtttatcccacttgatcatgaggctcagaaatgcatttaggcaccatttggaagttaaatattattaacttgggacttaagaattagtacttaggttggaacgaaggtcaacgcagcatatttgca

SEQ ID NO: 202938 - DNA, 1253 bp, Homo sapiens
acggcctatgggaagtatgaataacaggggctccgcaatctcacacggcgacagagggccagaggtgaggtcggacgggcccagctcaccactctcgcacaagtgtcctaagctttctggcctcagcagtgcgtctgtgtacaggatcgctgcaggacgaactgagatgatgcacctcagacactccgcactctgtgggacacacatgctcaacagagcagctgtatcatgggacaaagtggggaaccctgacccatcttcccaggtcccccaaacactggggctgagatactactaaggggtcctggaatctccctgtggaaatgcccttaagaagtgcagggcagggttctcctgccaagtgccaggccagtggagagcctgggtttcctctcatcggccacctggtggggatggaggcttgtgggctggctgagggctcaacctcagaggaaggccaaccttcccggcgatgcgtgggaacctgggaatcgggccgcctggctgaatgagctggctgggctatcactcacatcacggtcctgctgctggcaagctgaattacgatgtgtgactgctaagagaggctttatccttgaaagaagaacaagctttattgaacaagaaaggcagttaattcatctacctcaatgccatcaacccccgatggacttttctaaggagaaccagaggggaaactaacacacgctgttcagactggaggcgagatggctctcaggctcatttctgggcatggtggctgcggaggctccagagacgacacagctgtgtggctacatttcacagcatgccatgccccataggacatcccagaaacctgatcagataaatctggaacaatcagcaatgcttccttaaactctagtgatttgggggtgaagggaggggggaataaacctctcaatgtacaaaacaaaaattggggaaaaaaaaactgttctcttctgacaagctagtgttttaaaacaagactgagggcaaaatcacctgtatcccatgcctacaaacaggattacggatctgtttttatttgggagccttggtgggcctttcaactaaaatatgtttagtccatcgttaagagattttacaacccagacccacctccacgcgctctgaaataagcattagccaaaacatccttcccctggacaggctgcacctcactccaacagcaaaaattcctgagattgccagaaaacagtgaagttttgagtagggtgcagccaaat

SEQ ID NO: 202939 - DNA, 655 bp, Homo sapiens
tcatgggtcagggtccctacggtgatagctgttacggctgctctgttgagcatgtgtgtcccacagagtgcggagtgtctgaggagaaccagaggggaaactaacacacgctgttcagactggaggcgagatggctctcaggctcatttctgggcatggtggctgcggaggctccagagacgacacagctgtgtggctacatttcacagcatgccatgccccataggacatcccagaaacctgatcagataaatctggaacaatcagcaatgcttccttaaactctagtgatttgggggtgaagggaggggggaataaacctctcaatgtacaaaacaaaaattggggaaaaaaaaactgttctcttctgacaagctagtgttttaaaacaagactgagggcaaaatcacctgtatcccatgcctacaaacaggattacggatctgtttttatttgggagccttggtgggcctttcaactaaaatatgtttagtccatcgttaagagattttacaacccagacccacctccacgcgctctgaaataagcattagccaaaacatccttcccctggacaggctgcacctcactccaacagcaaaaattcctgagattgccagaaaacagtgaagttttgagtagggtgcagccaaat

SEQ ID NO: 202940 - DNA, 335 bp, Homo sapiens
cctcctgggttcaagcaattctcctgcttcagcctcccaagcagctgggactacagacatgcgccactatgcccagctaatttttgtatttttatgagagacggggtttcaccatgttggccaggctggtctcgaactcttgacctcaggtgatctgcccgccttggcctcccagagtgctgggattacaggtatgagccacggtgcccggcctaggagactttttgaaatgcaaaaaaacaaaaacacaattacaacagctctaccctgtgtacgtgctttagaaaataatgctatttaccttaattttcacattttcaacaaagagcaggcac

SEQ ID NO: 202941 - DNA, 439 bp, Homo sapiens
tgagaactggggggatatatggttcgatactttacctggattactgcccttcacctggctgaatgccacctccttaagtctcagcttaactttcacttcctctgggaaagtagttctgattttcccccacaaaactagaaaacataagtccacaggaatcccactgttgaatgaactaaggaaaatgggtgatttttagtagagacggggtttcaccatgttggccaggctggtctcgaactcttgacctcaggtgatctgcccgccttggcctcccagagtgctgggattacaggtatgagccacggtgcccggcctaggagactttttgaaatgcaaaaaaacaaaaacacaattacaacagctctaccctgtgtacgtgctttagaaaataatgctatttaccttaattttcacattttcaacaaagagcaggcac

SEQ ID NO: 202942 - DNA, 550 bp, Homo sapiens
gtcaactgctactagatggagggccaaggacaggaggagggatcagctctgtgtagggagggagacagggagggcgggcagggtgcatgcagagaatcctggaatctttgccctggaagggacaccaggaagcaaaagccaaccctctcattttgtggatggagaaactgaggcccagactggggaagtgacgtggccagggtcactcggtgagatagaggcaggctctcagactcctgaatcccaaccagggcccttttgatggtgccagatgcccttcctggttttctgtgtcccaatccttgtgtcctaactccacttttggaaaaacatttgccacctctatccagcggtcacctaagagttgcccactcaggagccgggcgctgccagcccttcctccagaggcggcgtggcctcttctcaggcctagaatggggtggttgcgtttctctctctctctctctgtctctccctctttcctctttctgtctctgtctctgtctctttctttcaatctctctctcccgtctgtctcctctcttctctc

SEQ ID NO: 202943 - DNA, 613 bp, Homo sapiens
gtcaactgctactagatggagggccaaggacaggaggagggatcagctctgtgtagggagggagacagggagggcgggcagggtgcatgcagagaatcctggaatctttgccctggaagggacaccaggaagcaaaagccaaccctctcattttgtggatggagaaactgaggcccagactggggaagtgacgtggccagggtcactcggtgagatagaggcaggctctcagactcctgaatcccaaccagggcccttttgatggtgccagatgcccttcctggttttctgtgtcccaatccttgtgtcctaactccacttttggaaaaacatttgccacctctatccagcggtcacctaagagttgcccactcaggagccgggcgctgccagcccttcctccagaggcggcgtggcctcttctcaggcctagaatggggtggttgcgtttctctctctctctctctatctctcttgcatttttgtgaatctaatgatgaacttatactaccacacttttcccttctcttacacaccttacctactaaaggaggaagtgccactttattggtaagtggacgttaaccaagagggacttaaaaatcagaactta

SEQ ID NO: 202944 - DNA, 442 bp, Homo sapiens
ctacaaatcccgacacccccaccctcttttttttggagacggagcctcactctgtcacccaggatggagtacaatggtgcgatcttggctcgctgcaacctctgcctcctgggttcaagcgattctgcctgcttcagcctccttaagtattgggattacaggcatgagccaccatgcttagcttgtgatggctcttagtgtacatacctgggacatataactgtgccttcttaaaagtagttatctcagaatgcttagcaagcctctctttgacttgactttaaaagctttgaacactagatcctaactttttgaagtaaacttttgattttgaaatggttgaaagtcatttgaagccaagtctttggaaataataattgatatgagttgtgtgtttggtcacagtgccaatttaaactgggttgatctgtcttacatggct

SEQ ID NO: 202945 - DNA, 465 bp, Homo sapiens
gaaacgttctcgccagaaagttaaatctaaatgtggtggaacctctacatctaactacaaaattacaggaaacataggggttagaagtacatctttaacaacaccatgagggtgcaattagcaaaatctagattatgggaaattttacaggatgaaagtttcttcattaaaaattgcaagggtggctgggcacggaggctcacatctgtaatcccagcactttgggagaccgaagtatgtggatcacctgaggtcagttcgagaccaccctggccaacatggtgaaaccccatctctgctaaaaatacaaaagttagccaggcatagtggcatgtgcctgtaatcccagctacttgggagcctgaggcaggagaatcccttgaacctgggaggcagaggttgcagtgagccaagatcaggccactgcactttatcctgggtaacagagtgaatgagactccatct

SEQ ID NO: 202946 - DNA, 522 bp, Homo sapiens
ggttaaaaggcccaccccttcccgggtctcaattctgggctgatttccccaggacagcattcttgtgtcaactcgctgttaccccagctgacggcctcacatctgctgaggcaatgccacctctccagagtgaaaagctcctaagacagagccattctccccgagttgattattcccttgaattgttataaatctccccttgctatttctctctgaacatcatttatgagcaccttgcgtctccgtcgatgagaaagtgcattaaccctgcaggctgtgtctgggaaggctctgccctaatccgttcagaaccaaggcctcggcacctacagcttcgtttctggtcctttttcagaccattcccagtgccttcctctccctcccagccctgggccctcccagccgccctccgcgcaggcagcctggagccacctccaggagggctggccgccactgtaattacaggcgcctctccgcgccctggggctcggctctgcaaattaaactgttttctgcttttta

SEQ ID NO: 202947 - DNA, 260 bp, Homo sapiens
gctctagaggttccccccgcatggcgtacaagacagctctcaaaaaaaagtaaaataaaataaaataaggtaattaagaaacaaaactaaaattaagacaatatgagggatatgaagctgatgagaaaatgtaagttggtttttatcccctcagaaaccaggcaacatatatatttaaattatcaccccagttattttattggtcatttataacgattcttatggcttgtacttaaatgctgccattacgccgatgcggg

SEQ ID NO: 202948 - DNA, 301 bp, Homo sapiens
ccacccccataatccaaacacctcctaccaagtaccacctccaacattggggatcaaatctcagcatgaggtttaggaggacaaacacccaaaccatagcgaagcttaacacgccaaaatgatagagctcaaagaatctatagacccagatctctatgtttaatattgaaaaacaaattataaataagacagtagcaaatagaatcaagcagcatatcaaaaaaataatatgccatggccaagtatggtttatttcaggaatacaaggatacctacataccattgcaattcattagctcaa

SEQ ID NO: 202949 - DNA, 232 bp, Homo sapiens
ctctttttcatggaactctacttaaagctgttaaaggctaccaggtgccaattattaaaataaacctctgaatcctgacatgatagggtgtgggcaagcctaactttcctgctttaccttccactttgcctatgtcctgcaccctgaggttactctcaaccacctgacatgacttggctgtcccccacatccttgcattctaggggcccatcccctctgtatgagtactcta

SEQ ID NO: 202950 - DNA, 556 bp, Homo sapiens
ttttaaggtgctttttatttaattttaatgagtgtaataggcactaaaatgaaactcgactgggtactattactgaaaaaatttgactcaaaccaatagttttgcatgctctttagttctttttctgtcttacttctttcaccagttcagtactgtttgggtagctctgaattctggcttttccaggcagctgcttgatgatacaaatgaggtggaccatcagcagttttgcctggacactaatgactctaaaagggtgtgtatttaactcttctttttcatactagatctctaccttgtattccccccttgcaaaccagaaactacactttttttctctggaaagacttctcactgtgctatgcgcttaggaactgcacggtcccgttgccatgctgtggcattcgaggctcgtcacctaggggctggtttcccatgttgtcatccttgctaacactgggatctcagatgtttgcagaacatttctattcatgacggttcttcaaagaagggctagaatatttgccttctacctagagcaaagtaaacctaattg

SEQ ID NO: 202951 - DNA, 441 bp, Homo sapiens
agacaggaggacagtcagagagcgtcagggagttttgcctaggtttcagatcattctgtatcgccagctagcttgcctccttggacttacccaccagtctaacagcaggtgtatgtttagaatatttgtgctcggcacagtgtagggacacgggcaggtgtgatatggtttctgctcagaagcttcttatagtccaattgggtaaacgagactagaacacataaaacgaccatggcaacatgaaaatagggttgaagttttatggtgtcagctgtgccagccatagaactaaggagcaagagtagattcagggatggggtagtttaggaaggcttcccggaatgtgattatctcctgatatttattgagtacctggggtgtgcaaagctctgtgctgaatctgagaatgagaagtgaataagtgatggccactgtcctgag

SEQ ID NO: 202952 - DNA, 323 bp, Homo sapiens
aaaagtgtagtagagttcatgtaatgtttttattttgaaaattatcaaataactgcaattcaatgtatgtaatactccttctaaattagtaaaaaatttttctttattttatcatgtggacattattccagtgagctggttaacagataattaccattgaagagcattcatattatctatcaagagcattcagaatttgagcaaagatctcttgacttctaagtactttacaaattgtgagcccctaaaaccttaataccgtaaaatgatttctaaaaaggtaccttaagtcttcaggatgaataaaccatataaaacattta

SEQ ID NO: 202953 - DNA, 226 bp, Homo sapiens
aaaaaggtcagaaaaataatagtggaaatgaaagacagaaaaatatttgtatcattgcacatcttatcaaaaacaaaactgggccaggtgcggtggctcatgcctataatcccagcactttgggaggctggggccaggagttcgagaccagcctagaaaacatgacaaaagctcatttctaataaaaattagccaggtgtggtggcacaggcctgtagttccagct

SEQ ID NO: 202954 - DNA, 796 bp, Homo sapiens
tcccagaacttccttggcaccttgctcattggtttataatagtgtttggagaaggcaagatatggagaggatcatcttggggcttagagaaacaaggacaagtttagaagcaaggacagtgtcagatatatgaaaccaaatatgagactgaatatttgtaaatactagaatatgtggctaaaacagtatttgtagaatggaagctgagttggaattgttctctgctgcctgctgagtccaggaaggtactggcccatggggtggctacttagttatttgcttccaactgagaattaaatctacaatagctatgagccaaccccctgcttttgcctgtttcaggggcctggtacccttcctaacttctgaccctcagcctctttctttctaggtcctatggtggtctccttttccattcatgactcttcccctttggctagcagacgtttaaacatttcccttaggtctctcctctgcttttgctgaggttctcaggcctctaggaaggcagaaggaggattcaggattggcagagagagcacctccatatctacctttttgtctgtagagcaggaggagtggcatctggaattgattcatggtcttagcaaccaccagctccttaaagggtctcaagttcctagactagcctgtgtgtgtgcatgtccagtgtgcggtggcatgtctccataactcagccttgcaaagaagcctcttgcgaccggcccgtacataggcctttcagcttggcaggcctcatcatcttcattcccacaataatttctacatttccaag

SEQ ID NO: 202955 - DNA, 394 bp, Homo sapiens
atgaccctggagagcttgagttccatagttgtctcagacaggcaagctaccttggtctccatgtttcatctcatcggtgggtggattgcctagaatgagcagtaggccactgtgatgggcctagtcttctaagacaggtggtgtcacatttcctctgcacttcctgtctcattcttgagaaatattctctcctctgctcccgggtggactgactccctgaatcttttagccccctcctggatcctggtgttctttgattttccttgacattgatggaaaggtcacttgtgccccccttccatctggcacatgcctgaacaccatcttgtgtttcgccattgccccatatgcctttggtaacaaacattcacaccatctgctctgggatatgcca

SEQ ID NO: 202956 - DNA, 326 bp, Homo sapiens
ctaaagtttgtttagcatttaaggggaaaaatttacgtttttgcttcacacttcatactaaaatatgtttaaatgcaaaggttaaaacataaaagcctgagaataaagtacaagcaattaagtagagatggcctttgttagctatgacattagagctagaaaaattagaacatattgggacccagactacatactcgtttttcaaaacattacccagctgggcgtagtagctcatgcctgtaatctcagcactttgggaggccgaggcaggtggatcatttgaggttaggagttgaagaccatcctggccaacacggcgaaacccc

SEQ ID NO: 202957 - DNA, 370 bp, Homo sapiens
tctgactctggccacaagatcaagactgacaaatttcctttctctgtttatggagggagacttcacaacattcactgaaagaggagcaaaggacctggtttttgccatgactggctttggccccgtgaatgaatgtttttctggcattggaaagcggatagcaaagagagcagaaccacaaatgggctatgaggaaatgtgttcaatgaagaaaacaaaatctctgacaagatccaacataggacaacatctcagcatcttctgtgatttgtgaacccaagtaaagcacttcttagagttatctggcacattcgcaactaatagctttctgtgaataaatactgtggcaaccacgttaactgtacaaaaa

SEQ ID NO: 202958 - DNA, 851 bp, Homo sapiens
ggtcccagctatttgggaagctgaggtgggaggattgcttgagcccaggagtttgaggctgaagtgagctatgatggtgccactgtactccagcctgggtgacagagcaaggccctgtctccaaaagcaaaagagtagagaaagggctttatgtgaccagggagagtatgaagagctatggctgtcccattcccattctagtaggtccgagagcaagcagggccagactgccaggggccccaataaagcattgtaggggcccaggcagtgtcacttggggccaaggtagtacaaagtggttttgaaggagttgaagatgaatccaaggatctgaatgaggagggccagagctggtgaagctacggcattcacaggttttgggaaggactggagccaggtcctgaaattgttgagtggaggtgtctggggtgtgtgcgagtctggcattcacagggaagtccgggccaaagactccagtgggggaggcatcagtgaatagatggtgcttcaggcctgtcttagtcagctcaagctgccacacaacaaaatatcacagactgggtggcttaaacaacagacatttatatttcagagtgctgggggctggcagtctagatgagagtgccagcgtggtcaggttctggtgagggctctcttcatggcttgcagacagctgccttcttaataccaccgttatgacctcaattaaccttaattagctcccaaaggttttatctccagatacaggcacattggggctcagagtttcaatctgtgaatttggagggacatactttgtccatagcagagccctgagactgagcccagtcccctggaggtgaaaacccttt

SEQ ID NO: 202959 - DNA, 241 bp, Homo sapiens
tctttgcactgttcagaaaagcaccccctccttcccgcccctccccctcctcactggtagggcccgcacaaagtccacagggctgaggctggcttcttgaactgagctctttgtgaggagccttcctttctggggctctgctgccatctagtggaagacatgcacaaggttgggggaggaattgccgagaatgtggagaggggcctgaatgacttcacctttgaaccgctgccaggtttta

SEQ ID NO: 202960 - DNA, 364 bp, Homo sapiens
ggtggatgtagaggctgctagggagcccctcgagcttcaggaatcatttctcaagtccccaaattgataatgaccttcttttcagtgtccactgcttggggaaatgcatcatgtctaacgcagagttcaaaaccaagtaaaaccaaacactatatcttttagatgtacatacctgtgagaaaactgaaaaaaaatatgagccagagaatgacaaatgcaatagtcaagggaatgttccctctggggaaggagaatagaaataaatagataagtgactggtaatgatgtagtttccaattgggtggtaggcttattatattgtctactacatacaataaaaagactaaataaaataaagactaaa

SEQ ID NO: 202961 - DNA, 166 bp, Homo sapiens
gcagggttccccattgattttctaaatgtttgtagtccttttgtaaagtggacccttgccttctaaggtaatggtgaatgatacatattcccttcatttttctgctttgaagcttcaatcttcttcattttctcttttgatctgtcaacacaatcagaacatttag

SEQ ID NO: 202962 - DNA, 666 bp, Homo sapiens
gattctgatgtgcaactggtttgaaaatacaaaggaaagtcgaccgtctcatgctgaggaactatgaaatcagaatattccaatggtgctggagacactgaaaatgatagcaagaaaaaaaggagagaaaaaaatatgatgcaataggtctgggtccctgtgggcagtaaatgatgacactaaagttttacagaaactgctataattgcatggcaataccttccatgaggattagagtgacagtggtagatcaatgatctggacatagtaaaggaaaacaaaaaagcagtttattcctttttctcttccacatagtcacggaaaacagaaaacagcttttagtgacaaggtaaggtaagatgtgatacctggattttcacggagtcagggtaaagaaaatgattaagagtaaagagaagtatactggataagtagtattttcaaaacacacattaaaagttggtaattcatgaaggagctactgggtagagaacagaaggaaagaggtagtaccactttaaattgtgaggttggggagaagtagcagcaacctgggttgtcatcagataccataaaataggtgggctgaggtgtaaggaacatggaaagcagcagagcaagaagcaaaatggcacattttaaaacaccgtgtgtaccaaggcacag

SEQ ID NO: 202963 - DNA, 224 bp, Homo sapiens
cccacatgatgaagacccccaggcagtgacatatgccccggtgaaacactccagacctaggagagaaatggcctctcctccctccccactgtccggggaattcctggacacaaaggacagacaggcagaagaggacagacagatggacactgagagagtcctttcctctccaggcccccaggcctcccccacccccaccacgttccttacctctcactctcccc

SEQ ID NO: 202964 - DNA, 321 bp, Homo sapiens
attactggccttggccaaccccatcccagtcaaactggaatctttggaacctgaacatgggtatatttgaaagcttatattagtgaggatggagaagaactatagcagataggaaacattcatacaacttctgaagacatccgaaactacagactggtaaccactggtgtcactggtttgctttattgctttgctttacttccaagatttacttaacaaatatttcagtgctttcctttgccaagcactgtgctaagaagagcaaagacagacttggtatctgcttcataaaatttacagtagaggaagagacaaatatta

SEQ ID NO: 202965 - DNA, 479 bp, Homo sapiens
aacgtgcatatttttatcattttacaaatcaagagttaatggatcaaaatgtaaaatatcttttcctaaattactcaattatatttgaaaagttcctggaatttactactcttctttacattctaaccatgtcctcccttttgctttctttactgtatcatatttctccataactgattaaaacaaaacaaaacaaactttggaatacaatattttataaattgtctatgtataaactaacagttttatacttagtgacaaatatgtatctatgttaccaataaaacttcacttaataaatgtcagggtgattcttatagtcagctgtgatagatgatgctgctactattgcatgcaaattatttagtgagatcactgccaaatcaacgttctttccaatgtatcatttaggaagtctgaaacagattacaaaataaagtatctatgcttttagagtgttatcattatgatacttgtgt

SEQ ID NO: 202966 - DNA, 342 bp, Homo sapiens
catcaccagcctgagttcattgtcatatgcacacatcatggcctaatcctgcctacaactttacaaagagcatttccttcttttaactctaaattactcctttgggtgcatcatctgcttcctctgaagttctgatgaatacacagaacaaacatttagacctgccaatgttataatgttttcaagaatttaaaaccttcaagatcctgatagtatctaatattcatgtgattcatgccttccttaaaaacgagaatgagttactattaatatgattcatcaaaatcattttacctctaaaaaaccctaaataaacacagcaactcaactgtatctatgcat

SEQ ID NO: 202967 - DNA, 377 bp, Homo sapiens
ttcaagagggctgcctagagataagaatttaagggccatgtgttgtatttttgctagtaccttgaaagaagtttttgctttgtttttaatggcaatacaaataaaatccaaaaatcctggacacatatgataagttcagttgtttatttgaaaagtaaatgcctcacatgccttgctcataccactttaaaatgggattgattgataaacacaaactctaactctcttacattaaagagtatcaacactctgaatttttaattatctttgataatccccatgaacatttttaggactcacacgtaaaatagtcaagtctatttcaagttatgtcagacaatgctttttaatatactgttcagtgcagcaccctacca

SEQ ID NO: 202968 - DNA, 384 bp, Homo sapiens
taagtgtgcgggctcccggggcctgtcccccagagcctacagggggcacgcatggcccttaccagtcactctgaggtctaacctgcaacccagtgaaaacaggcaggcagtgtcctgaacagtgccgccatagggagtgtggcccaatagcagcgatcacatgagaaggggctcaagacattggtcattaggcgatgccaattaaaggtaacgtgaacatacttaacactgctgaattgtacccttaaaaatggtttagccaggctccacgtggctcactcacgcctgtaatcccagcactttgggaggccaaggtggaggattgcatgggcccaagagttcaagaccagcctgggcagcatagtgagacctcatctctacaaa

SEQ ID NO: 202969 - DNA, 627 bp, Homo sapiens
tcctgcggtgactctagaggaccccgtcaatttctacacactgatacgttttctgaccctagttttggcctttcctggagtatcctataaatggaattattcggtatgtagttttttgtgtttggcttgttttacttagcataatacttttgacagtcatcgagttgtgcatttatcaatagcacattcctttttattgcaagtagtattcctaatatgttttacccttttacattgaacaatatttggggtgtttacagttttggtctgttgtgaacgaagttactatgaacatttgcatatgggtctatgtgtagatatgttttcatttctcttgagtaaataggactgggttgcctgtcatatggtaagtatgtgtttaaactcctaagaagctgtctggtttccaaagtggctatgctgttttgcattcctcttagcaatggttgagagtttcaggttgttcgtatccttgtaaggacttggtatttgttttaaactaatgccaacttgacactgactgcataaacaacaagcaaaaagaaaattaataacaactctacatattaacttaatccccctgctttttaactttttattctttctatttatatcttatcgtactgt

SEQ ID NO: 202970 - DNA, 590 bp, Homo sapiens
tgagacggagtctcactctgttgcccaggctggagtgcagtggcgcgatctcagctcactgcaagctccgcctcccaggttcacgccattctcctgcctcagcctcccgagtagctgggactacaggcacctgccaccacgcccggctactttttttgtatttttagtagagacggggtttcaccgtgttagccaggatggtctcgatctcctgacctcgtgatctgcccgcctcggcctcccaaagtgctgggattacaggcttaagccactgtgcctggcctataagtttttacataaattatctcattttatcctcacaactctccaagaaggtggtagtgcctgattttacagatcaggctcagagaggtttggaaatagggcagctctgtttccaacccaggcctgtctgcatatggagcttaggctgggcctcaccaccctgcttctcccagggatgtttgccctcagccttgaccaaatgggagcccagggcagccaagagaggccaggggccactgtgcctgggacacagaggccaggccacacatggcagactgctgaccccagccagttggcagtgatgg

SEQ ID NO: 202971 - DNA, 443 bp, Homo sapiens
tggaatagagaacccagaaataaagccgtgcacctacagccatctaatctttgacaaagttgacaaaaataagcaatgggaataaactccctattcaatcaatgtgaaactgaacccctacctttcaccatattcaaaaactaactcaaggtggattacagattttttttttttgatatggggtcttattctgtcacccaggccagactgcagtggtgtgatcatagctcactaaagcctcaaccagctgtgttcaagtgactctctcacctcagcatcccgagtagctgggaccacaggtggaagcaacattcccagctattttttttattattatttatagagacaaggtcttactctgttgcccaggttggtcttgaatcactgggctcaagtgatcctccagccttggcctcataagtggtggaatcacaggtatcagc

SEQ ID NO: 202972 - DNA, 640 bp, Homo sapiens
ttcctcttattgagggaatggcaaggtcacattgcagaagagcatgtgggatgagcgataactgttgtggccatctttggaaaatacagttggctgcagcatgactatctggttccccatcggacatttacctaagagctttaattacagttgatgatccttgccagaatcattcattatgatttgcaaagtgattttttttataattctaccttttaggggcattattaaatgatattttataaagtagagctaggccaggcatggtggctcaaacctgtaatcccagtgggaggatgacttgagcctaggagtttgagaccaacatgggcaacacagggagaccctgtctctacaaaaattaaaaagaaattttaaacagacttgtttaatcgtgttctcaaagcatacagtcaagaggtgggactgactgatgctttataggtgtgtgtagggtggtagaggccaaggtgctgccagcaatcctttccatactaggtactggtgaaaattgtttttgtttatgctgtcggcacatttgtgtgggtctctcattgtcccttaacagtgccgcatctcagcctggaagtcagctttaagtcattcaagagaacctcaggctgttttctgacagtgatga

SEQ ID NO: 202973 - DNA, 455 bp, Homo sapiens
aattcatccctaacattttgcagaaactgaccagctgctcttaaaattcatgtggaaatgcacaggacccagaatagaaaaaaaaaaaatcctgagaaagaagaacaaagttggaagactgaaactttcccaatttcaaaacttactccaaagcgaaggtaatcaagacagtgtggtactgccataaggatagagatatatacatcaatggaaaagaatgggaagttcagaaataaactctcacaatttttccttttttttttgagacgaagtctcactcttgcactccagcctgggcaacaagagtgaaactccgtctcaaaaacaaacaaacaaacaaaaaaacccagaaaacaaacaaaaaacccaggaagcggaggttgcagtgagacaagatggcatcattgcacttcagcctgggcgagagtgagactccatttcaaaaacaaacaaac

SEQ ID NO: 202974 - DNA, 454 bp, Homo sapiens
gtatttagctcccttgtctgttcagtcggtcttttccaattctcattctctcttaggtatctgttatccacactccttctgttatatgcattcatctctctcatatctttgatgagcattggagaggagctggaatctctctgacagcagtgatgcatggaggacctgaggaggtgggatgaatggctctcagtccctgcatttggataagagacgctgcatgctattgggagacttggcataggtagtctttttttttcactcctagcagtgtctgagttcattggtttatttactaccccccacagtattaaacatgctctccaccactgtacgatttttcagtactcaggaaacactacaacatgtgtgacagctaagaattcaccaaatattagcactttttgaatagtctattaaatcaccaggtaaaatgcacatacattttaattaa

SEQ ID NO: 202975 - DNA, 365 bp, Homo sapiens
gagtggactgggatatggtgtagaccaagagtcacaagaatgattttgttcccaactatgtgatctgtgtgacctgtggaaagccctttaaccccccaggggtcaggctcaatatctgtaaatttatgtggttagaagacataaactctatggttcttttaggtatagtatgattaatagggatccaacctccagtaatgagcagtaaaaagttgaattctggctggaagcaaaatttccccagaaaacataggttgctatgtataaaaaatatacatatggcaaatcaacttcacagtaatgaattaagcatattctgatgagaaaaatgaaccatctgtgtatttcttcaatgagagtttgga

SEQ ID NO: 202976 - DNA, 400 bp, Homo sapiens
aaaaaaggagagagggtcagaagagatgcccagcagactgccacatggtagacaagagttccctttctggtaaaatggccattactgtcaagttttctcaagcaagaaattcaggaatcttgccaggggcaaagctatccagatccaaaaattgggtgcaacctagttttgtgctcccggaagacatccagatggcaaggaaggcgtgtaaccaagcccctgaaataatcgattctatgaatagttgaaacatatcttctatgggaggacatgtttggaaaaaatatgagactcatcgatgctgaccactatttttaggctgctgggtcaaggtttctgatacatcatcctataaagtacactgcaagtgggccccaagaaagaataaataccacaggca

SEQ ID NO: 202977 - DNA, 603 bp, Homo sapiens
  misc_feature (28)..(28): n is a, c, g, or t
ttttgggggggggggggggggtttttanccccccccccttcttcctaaaaaaaagggcccaaagaggccccctgggccagcagaacagcactcctgggcggctcctgtgggcttcaggactggccggctccagccgcaagggcgatgctgtggacgtttgtgtggatggtgcagtgttcttggaatctgtagaccagatcggtggaggtatagaagtgcaagagtctaaaggctgattttacacacacacacacacacacacacacaaaatcactgctgtgtgttttcttccgcctgaggcatcagcgtcacctcggtgtggtcgtcgcctcccaggcccttggcctggcctcctctcagtttgggttttgccctcacccacatgagcccccccatgccctgccccccttgcggccttttgtgttccccgatgtctgggctgtgtccctgccgggattcccagccttcggggtcagccgtcgagccacttgctttgctcagttctgtgtttcagccacatttccacggtggaccctgtttgttttaaatattctgttcccatgtcaatcagtgacgataaatacagccttgatttggatgaaa

SEQ ID NO: 202978 - DNA, 347 bp, Homo sapiens
aagctgtctctttctccagcctaagacttcaagccccattgaggtggcccgccgggctggtgcggttcacacactcctgcagaaagcgcctggggtgtctgacccgtaccgggcggtggtcaagaagccggggaggtggtgtgccgtgcacgtgcagatcgcctggcagatctaccgtcaccagcagaagataaaggagatgcagctggacccccacaagctggaggtgggtgcaaagctggacctgttcggcagaccccctgccccgggcgtgtttgcaggcttccactacccacaggacctggcccggcccctcttccccagcacaggtgagactggagtcgggc

SEQ ID NO: 202979 - DNA, 3938 bp, Homo sapiens
  misc_feature (1831)..(1831): n is a, c, g, or t
  misc_feature (1902)..(1902): n is a, c, g, or t
gagcgcgcagagccggcgcggcggacatgcgcgtccccggcccgagctccggctgagcagggcacgcggggagaggggtcgcctggacgggccagggccacccggggctcgcgctccacgcccgcgtccatgcagcccggctccggccccgggactagtggcgactgcctggggcgccggcgaggcatccgtgggctctgagaagctctttgcgccgggaaccgataaaggcccagcgcttgagaagtcggaggccaaggccgggccggtgcccaaggtgtcaggcctggagcgcagccgcgagctcagcgccgagagcttcctgcccactgccagccccgcgccccatgccgcgccctgcccggggcccccgcccggctcccgcgccaatcccttggtgaagaaggaaccccccgccccgcaccgccacaccccgcagccgccacccccgcagccccgcggcctgctcccgacacacgtgcctgcatccctgggcgccttcgcgggccacagccaggcggcagccaacggcctgcacggcctcagcaggagcagcagcgcccccctgggcctggggaagcacgtgtcgctgtcgccacacgggccgggcccccacctgtctacctcacacctggcgctccggtcccaggcgcagcaccagctccacgcggccatgtttgccgcacccccgacactgcccccgcccccggcgctgccggccagcagcctggtcctcccaggacacccggccgatcacgagctgctcaggcaagagctgaacacgcggtttctggtgcagagcgccgagcggcctggcgcctccctgggcccgggggctctgctgcgggcggagttccatcagcaccagcacacacaccagcacacgcaccaacacacacaccagcaccaacacacattcgcccccttccccgcagggctgcccccgacgccgcccgccgcacccccgccgtttgacaagtatgcgcccaagctggacagcccctacttccgacattccagcgtgagtttcttcccgtccttccctcctgccatcccgggactgcccaccctgctcccacaccccggccccttcgggtccctgcagggcgcttttcagcctaaggtgtctgacccgtaccgggcggtggtcaagaagccggggaggtggtgtgccgtgcacgtgcagatcgcctggcagatctaccgtcaccagcagaagataaaggagatgcagctggacccccacaagctggaggtgggtgcaaagctggacctgttcggcagaccccctgccccgggcgtgtttgcaggcttccactacccacaggacctggcccggcccctcttccccagcacaggtgccgcccatcctgcctccaacccatttggaccctcagcccatcctggcagcttcctgcccactggccccctgacagaccctttcagcagaccgagcacctttgggggcctgggcagcctgagcagccacgcctttgggggcctgggcagccatgcactggctcccggtggcagcatctttgcccccaaggagggctcctccgtgcacggcctgcccagcccccatgaggcctggaaccgactgcaccgggcaccgccctccttcccggctccgcccccgtggcccaagtccgtggacgcggagcgggtgtcagccctgaccaaccatgaccgagagccggacaatggcaaggaggagcaggaacgggacctcctggagaagacgcgcctgctgagccgggcctcgcccgccacccccgctggccaccccgtcagcggcctcctgctccgggcccagagcgagctgggccgntccggggcccccgcggagcgcgaggccgaacctcgggtcaaggagagccgctccccggccaaggaggaggncgccaagatgcccgcgcgcgcatccccgccccacagcaaggcggcccctggagacgtgaaggtcaaggaggagcgcggggaggacgaggcctccgagcccccggcgggcggcctgcaccccgcgcccctgcagctcggcctgggccgcgagcgcctgggcgcgccgggcttcgcgtgggagcctttccgcggcctggagctgccacgtcgcgccttccccgctgccgcccccgccccgggctccgccgccctcttggagcccccggagcgcccctaccgcgaccgcgagccccacggctacagccccgagcgcctgcgcggggagctggagcgcgcgcgggccccgcacctgccgcccgccgcccccgccttggacggcgcgctgctgccctcgctgggagccctgcacttcccgcgcctctcgcccgccgcgctgcacaatgggctcctggcgcggaccccgcccgccgccgccgccctcggcgcaccgccccccctggtgacggcggccgggccccccacgccccccgggccgccgcggagccggactactccgctggggggcctcgggccgggcgaggcgcgcgactactccccgtcccgaaatcccccggaggtggaggcgcggtagccccggggccgcagacgcctctccgagcggagcgcaccgctgtccgtctctccatcagttcctagaactcaagcacagctcccgccgatcctggggcggcgccgcctctccacccgcagcctgcggaggcggggacttgggtgtcggcttttctgagggtgatcttttgttttccgagtttgggattcggctgttgggaaaaaaaaatcgcgtttgtaccttttccccccacagatgagaagtgtttgtaatggatttgtatttttcttaattttatgctctttagacgtttaaaagaaccaaaaaagaaacttttgcttcttcgttttcggttgggatttgcagtttaatggcctcagatccttctccagatccccagggtttctttgtcttatttatggagaaaaaccggtcactttgtccagcgcactgtgaggcccccactcaggccagccctggcccccccttggtacttggaaccgaagttacagattatattaaaataataatgtacaaaactttgtttttttgccttattatgcagaagtgtaatttcttttttggtttgtttttttaaaagcaaacgaaacgtgtaaatagtctgttgatataaatatatgacgttactaaattcttaatctagatagactttataaaaaccgtttccagaaacccctctggttgtttgtctaacatggtcacaaaaacccaggcgctgctggctgtaaacattatcagaagtttaatggcagcaactttccttcaactatgcaagcgcttcccggcggctctgctggttgggggaggaaggttccgccagcgacctcccagcccctgggtccgtggaggggttgggtccccccagcagagcccctgggccagcagaacagcactcctgggcggctcctgtgggcttcaggactggccggctccagccgcaagggcgatgctgtggacgtttgtgtggatggtgcagtgttcttggaatctgtagaccagatcggtggaggtatagaagtgcaagagtctaaaggctgattttacacacacacacacacacacacacacaaaatcactgctgtgtgttttcttccgcctgaggcatcagcgtcacctcggtgtggtcgtcgcctcccaggcccttggcctggcctcctctcagtttgggttttgccctcacccacatgagcccccccatgccctgccccccttgcggccttttgtgttccccgatgtctgggctgtgtccctgccgggattcccagccttcggggtcagccgtcgagccacttgctttgctcagttctgtgtttcagccacatttccacggtggaccctgtttgttttaaatattctgttcccatgtcaatcagtgacgataaatacagccttgatttggatgaaa

SEQ ID NO: 202980 - DNA, 2909 bp, Homo sapiens
  misc_feature (802)..(802): n is a, c, g, or t
  misc_feature (873)..(873): n is a, c, g, or t
aagctgtctctttctccagcctaagacttcaagccccattgaggtggcccgccgggctggtgcggttcacacactcctgcagaaagcgcctggggtgtctgacccgtaccgggcggtggtcaagaagccggggaggtggtgtgccgtgcacgtgcagatcgcctggcagatctaccgtcaccagcagaagataaaggagatgcagctggacccccacaagctggaggtgggtgcaaagctggacctgttcggcagaccccctgccccgggcgtgtttgcaggcttccactacccacaggacctggcccggcccctcttccccagcacaggtgccgcccatcctgcctccaacccatttggaccctcagcccatcctggcagcttcctgcccactggccccctgacagaccctttcagcagaccgagcacctttgggggcctgggcagcctgagcagccacgcctttgggggcctgggcagccatgcactggctcccggtggcagcatctttgcccccaaggagggctcctccgtgcacggcctgcccagcccccatgaggcctggaaccgactgcaccgggcaccgccctccttcccggctccgcccccgtggcccaagtccgtggacgcggagcgggtgtcagccctgaccaaccatgaccgagagccggacaatggcaaggaggagcaggaacgggacctcctggagaagacgcgcctgctgagccgggcctcgcccgccacccccgctggccaccccgtcagcggcctcctgctccgggcccagagcgagctgggccgntccggggcccccgcggagcgcgaggccgaacctcgggtcaaggagagccgctccccggccaaggaggaggncgccaagatgcccgcgcgcgcatccccgccccacagcaaggcggcccctggagacgtgaaggtcaaggaggagcgcggggaggacgaggcctccgagcccccggcgggcggcctgcaccccgcgcccctgcagctcggcctgggccgcgagcgcctgggcgcgccgggcttcgcgtgggagcctttccgcggcctggagctgccacgtcgcgccttccccgctgccgcccccgccccgggctccgccgccctcttggagcccccggagcgcccctaccgcgaccgcgagccccacggctacagccccgagcgcctgcgcggggagctggagcgcgcgcgggccccgcacctgccgcccgccgcccccgccttggacggcgcgctgctgccctcgctgggagccctgcacttcccgcgcctctcgcccgccgcgctgcacaatgggctcctggcgcggaccccgcccgccgccgccgccctcggcgcaccgccccccctggtgacggcggccgggccccccacgccccccgggccgccgcggagccggactactccgctggggggcctcgggccgggcgaggcgcgcgactactccccgtcccgaaatcccccggaggtggaggcgcggtagccccggggccgcagacgcctctccgagcggagcgcaccgctgtccgtctctccatcagttcctagaactcaagcacagctcccgccgatcctggggcggcgccgcctctccacccgcagcctgcggaggcggggacttgggtgtcggcttttctgagggtgatcttttgttttccgagtttgggattcggctgttgggaaaaaaaaatcgcgtttgtaccttttccccccacagatgagaagtgtttgtaatggatttgtatttttcttaattttatgctctttagacgtttaaaagaaccaaaaaagaaacttttgcttcttcgttttcggttgggatttgcagtttaatggcctcagatccttctccagatccccagggtttctttgtcttatttatggagaaaaaccggtcactttgtccagcgcactgtgaggcccccactcaggccagccctggcccccccttggtacttggaaccgaagttacagattatattaaaataataatgtacaaaactttgtttttttgccttattatgcagaagtgtaatttcttttttggtttgtttttttaaaagcaaacgaaacgtgtaaatagtctgttgatataaatatatgacgttactaaattcttaatctagatagactttataaaaaccgtttccagaaacccctctggttgtttgtctaacatggtcacaaaaacccaggcgctgctggctgtaaacattatcagaagtttaatggcagcaactttccttcaactatgcaagcgcttcccggcggctctgctggttgggggaggaaggttccgccagcgacctcccagcccctgggtccgtggaggggttgggtccccccagcagagcccctgggccagcagaacagcactcctgggcggctcctgtgggcttcaggactggccggctccagccgcaagggcgatgctgtggacgtttgtgtggatggtgcagtgttcttggaatctgtagaccagatcggtggaggtatagaagtgcaagagtctaaaggctgattttacacacacacacacacacacacacacaaaatcactgctgtgtgttttcttccgcctgaggcatcagcgtcacctcggtgtggtcgtcgcctcccaggcccttggcctggcctcctctcagtttgggttttgccctcacccacatgagcccccccatgccctgccccccttgcggccttttgtgttccccgatgtctgggctgtgtccctgccgggattcccagccttcggggtcagccgtcgagccacttgctttgctcagttctgtgtttcagccacatttccacggtggaccctgtttgttttaaatattctgttcccatgtcaatcagtgacgataaatacagccttgatttggatgaaa

SEQ ID NO: 202981 - DNA, 2708 bp, Homo sapiens
  misc_feature (601)..(601): n is a, c, g, or t
  misc_feature (672)..(672): n is a, c, g, or t
cagctcggtccagggtgagctgcagctcagggcgagctgctgcttcaggtgggtctttgctgcttcatcagctcacacatcctctgggactctactgcctctttcaggagaaaatccttctcccgctggtgccgcccatcctgcctccaacccatttggaccctcagcccatcctggcagcttcctgcccactggccccctgacagaccctttcagcagaccgagcacctttgggggcctgggcagcctgagcagccacgcctttgggggcctgggcagccatgcactggctcccggtggcagcatctttgcccccaaggagggctcctccgtgcacggcctgcccagcccccatgaggcctggaaccgactgcaccgggcaccgccctccttcccggctccgcccccgtggcccaagtccgtggacgcggagcgggtgtcagccctgaccaaccatgaccgagagccggacaatggcaaggaggagcaggaacgggacctcctggagaagacgcgcctgctgagccgggcctcgcccgccacccccgctggccaccccgtcagcggcctcctgctccgggcccagagcgagctgggccgntccggggcccccgcggagcgcgaggccgaacctcgggtcaaggagagccgctccccggccaaggaggaggncgccaagatgcccgcgcgcgcatccccgccccacagcaaggcggcccctggagacgtgaaggtcaaggaggagcgcggggaggacgaggcctccgagcccccggcgggcggcctgcaccccgcgcccctgcagctcggcctgggccgcgagcgcctgggcgcgccgggcttcgcgtgggagcctttccgcggcctggagctgccacgtcgcgccttccccgctgccgcccccgccccgggctccgccgccctcttggagcccccggagcgcccctaccgcgaccgcgagccccacggctacagccccgagcgcctgcgcggggagctggagcgcgcgcgggccccgcacctgccgcccgccgcccccgccttggacggcgcgctgctgccctcgctgggagccctgcacttcccgcgcctctcgcccgccgcgctgcacaatgggctcctggcgcggaccccgcccgccgccgccgccctcggcgcaccgccccccctggtgacggcggccgggccccccacgccccccgggccgccgcggagccggactactccgctggggggcctcgggccgggcgaggcgcgcgactactccccgtcccgaaatcccccggaggtggaggcgcggtagccccggggccgcagacgcctctccgagcggagcgcaccgctgtccgtctctccatcagttcctagaactcaagcacagctcccgccgatcctggggcggcgccgcctctccacccgcagcctgcggaggcggggacttgggtgtcggcttttctgagggtgatcttttgttttccgagtttgggattcggctgttgggaaaaaaaaatcgcgtttgtaccttttccccccacagatgagaagtgtttgtaatggatttgtatttttcttaattttatgctctttagacgtttaaaagaaccaaaaaagaaacttttgcttcttcgttttcggttgggatttgcagtttaatggcctcagatccttctccagatccccagggtttctttgtcttatttatggagaaaaaccggtcactttgtccagcgcactgtgaggcccccactcaggccagccctggcccccccttggtacttggaaccgaagttacagattatattaaaataataatgtacaaaactttgtttttttgccttattatgcagaagtgtaatttcttttttggtttgtttttttaaaagcaaacgaaacgtgtaaatagtctgttgatataaatatatgacgttactaaattcttaatctagatagactttataaaaaccgtttccagaaacccctctggttgtttgtctaacatggtcacaaaaacccaggcgctgctggctgtaaacattatcagaagtttaatggcagcaactttccttcaactatgcaagcgcttcccggcggctctgctggttgggggaggaaggttccgccagcgacctcccagcccctgggtccgtggaggggttgggtccccccagcagagcccctgggccagcagaacagcactcctgggcggctcctgtgggcttcaggactggccggctccagccgcaagggcgatgctgtggacgtttgtgtggatggtgcagtgttcttggaatctgtagaccagatcggtggaggtatagaagtgcaagagtctaaaggctgattttacacacacacacacacacacacacacaaaatcactgctgtgtgttttcttccgcctgaggcatcagcgtcacctcggtgtggtcgtcgcctcccaggcccttggcctggcctcctctcagtttgggttttgccctcacccacatgagcccccccatgccctgccccccttgcggccttttgtgttccccgatgtctgggctgtgtccctgccgggattcccagccttcggggtcagccgtcgagccacttgctttgctcagttctgtgtttcagccacatttccacggtggaccctgtttgttttaaatattctgttcccatgtcaatcagtgacgataaatacagccttgatttggatgaaa

SEQ ID NO: 202982 - DNA, 3946 bp, Homo sapiens
  misc_feature (1831)..(1831): n is a, c, g, or t
  misc_feature (1902)..(1902): n is a, c, g, or t
gagcgcgcagagccggcgcggcggacatgcgcgtccccggcccgagctccggctgagcagggcacgcggggagaggggtcgcctggacgggccagggccacccggggctcgcgctccacgcccgcgtccatgcagcccggctccggccccgggactagtggcgactgcctggggcgccggcgaggcatccgtgggctctgagaagctctttgcgccgggaaccgataaaggcccagcgcttgagaagtcggaggccaaggccgggccggtgcccaaggtgtcaggcctggagcgcagccgcgagctcagcgccgagagcttcctgcccactgccagccccgcgccccatgccgcgccctgcccggggcccccgcccggctcccgcgccaatcccttggtgaagaaggaaccccccgccccgcaccgccacaccccgcagccgccacccccgcagccccgcggcctgctcccgacacacgtgcctgcatccctgggcgccttcgcgggccacagccaggcggcagccaacggcctgcacggcctcagcaggagcagcagcgcccccctgggcctggggaagcacgtgtcgctgtcgccacacgggccgggcccccacctgtctacctcacacctggcgctccggtcccaggcgcagcaccagctccacgcggccatgtttgccgcacccccgacactgcccccgcccccggcgctgccggccagcagcctggtcctcccaggacacccggccgatcacgagctgctcaggcaagagctgaacacgcggtttctggtgcagagcgccgagcggcctggcgcctccctgggcccgggggctctgctgcgggcggagttccatcagcaccagcacacacaccagcacacgcaccaacacacacaccagcaccaacacacattcgcccccttccccgcagggctgcccccgacgccgcccgccgcacccccgccgtttgacaagtatgcgcccaagctggacagcccctacttccgacattccagcgtgagtttcttcccgtccttccctcctgccatcccgggactgcccaccctgctcccacaccccggccccttcgggtccctgcagggcgcttttcagcctaaggtgtctgacccgtaccgggcggtggtcaagaagccggggaggtggtgtgccgtgcacgtgcagatcgcctggcagatctaccgtcaccagcagaagataaaggagatgcagctggacccccacaagctggaggtgggtgcaaagctggacctgttcggcagaccccctgccccgggcgtgtttgcaggcttccactacccacaggacctggcccggcccctcttccccagcacaggtgccgcccatcctgcctccaacccatttggaccctcagcccatcctggcagcttcctgcccactggccccctgacagaccctttcagcagaccgagcacctttgggggcctgggcagcctgagcagccacgcctttgggggcctgggcagccatgcactggctcccggtggcagcatctttgcccccaaggagggctcctccgtgcacggcctgcccagcccccatgaggcctggaaccgactgcaccgggcaccgccctccttcccggctccgcccccgtggcccaagtccgtggacgcggagcgggtgtcagccctgaccaaccatgaccgagagccggacaatggcaaggaggagcaggaacgggacctcctggagaagacgcgcctgctgagccgggcctcgcccgccacccccgctggccaccccgtcagcggcctcctgctccgggcccagagcgagctgggccgntccggggcccccgcggagcgcgaggccgaacctcgggtcaaggagagccgctccccggccaaggaggaggncgccaagatgcccgcgcgcgcatccccgccccacagcaaggcggcccctggagacgtgaaggtcaaggaggagcgcggggaggacgaggcctccgagcccccggcgggcggcctgcaccccgcgcccctgcagctcggcctgggccgcgagcgcctgggcgcgccgggcttcgcgtgggagcctttccgcggcctggagctgccacgtcgcgccttccccgctgccgcccccgccccgggctccgccgccctcttggagcccccggagcgcccctaccgcgaccgcgagccccacggctacagccccgagcgcctgcgcggggagctggagcgcgcgcgggccccgcacctgccgcccgccgcccccgccttggacggcgcgctgctgccctcgctgggagccctgcacttcccgcgcctctcgcccgccgcgctgcacaatgggctcctggcgcggaccccgcccgccgccgccgccctcggcgcaccgccccccctggtgacggcggccgggccccccacgccccccgggccgccgcggagccggactactccgctggggggcctcgggccgggcgaggcgcgcgactactccccgtcccgaaatcccccggaggtggaggcgcggtagccccggggccgcagacgcctctccgagcggagcgcaccgctgtccgtctctccatcagttcctagaactcaagcacagctcccgccgatcctggggcggcgccgcctctccacccgcagcctgcggaggcggggacttgggtgtcggcttttctgagggtgatcttttgttttccgagtttgggattcggctgttgggaaaaaaaaatcgcgtttgtaccttttccccccacagatgagaagtgtttgtaatggatttgtatttttcttaattttatgctctttagacgtttaaaagaaccaaaaaagaaacttttgcttcttcgttttcggttgggatttgcagtttaatggcctcagatccttctccagatccccagggtttctttgtcttatttatggagaaaaaccggtcactttgtccagcgcactgtgaggcccccactcaggccagccctggcccccccttggtacttggaaccgaagttacagattatattaaaataataatgtacaaaactttgtttttttgccttattatgcagaagtgtaatttcttttttggtttgtttttttaaaagcaaacgaaacgtgtaaatagtctgttgatataaatatatgacgttactaaattcttaatctagatagactttataaaaaccgtttccagaaacccctctggttgtttgtctaacatggtcacaaaaacccaggcgctgctggctgtaaacattatcagaagtttaatggcagcaactttccttcaactatgcaagcgcttcccggcggctctgctggttgggggaggaaggttccgccagcgacctcccagcccctgggtccgtggaggggttgggtccccccagcagagcccctgggccagcagaacagcactcctgggcggctcctgtgggcttcaggactggccggctccagccgcaagggcgatgctgtggacgtttgtgtggatggtgcagtgttcttggaatctgtagaccagatcggtggaggtatagaagtgcaagagtctaaaggctgattcacacacacacacacacacacaaaatcactgctgtgtgttttcttccgcctgaggcatcagcgtcacctcggtgtggtcgtcgcctcccaggcccttggcctggcctcctctcagtttgggttttgccctcacccacatgagccccccccgtatgcattcggcgggggtatgaagtcagttgtttcgtttgtttttacatagcaacagtaaagaccattcactaggtccccccgtgagtgtgagcatacccagtatgctagagaattgacacgaaacctttaaatcaaggcctcttttattaccaaaacaaaacaaaaaaaagggaacaaaatacgatgggtgagggaagagatgatgccgaagtgtcatcct

SEQ ID NO: 202983 - DNA, 3048 bp, Homo sapiens
  misc_feature (1831)..(1831): n is a, c, g, or t
  misc_feature (1902)..(1902): n is a, c, g, or t
gagcgcgcagagccggcgcggcggacatgcgcgtccccggcccgagctccggctgagcagggcacgcggggagaggggtcgcctggacgggccagggccacccggggctcgcgctccacgcccgcgtccatgcagcccggctccggccccgggactagtggcgactgcctggggcgccggcgaggcatccgtgggctctgagaagctctttgcgccgggaaccgataaaggcccagcgcttgagaagtcggaggccaaggccgggccggtgcccaaggtgtcaggcctggagcgcagccgcgagctcagcgccgagagcttcctgcccactgccagccccgcgccccatgccgcgccctgcccggggcccccgcccggctcccgcgccaatcccttggtgaagaaggaaccccccgccccgcaccgccacaccccgcagccgccacccccgcagccccgcggcctgctcccgacacacgtgcctgcatccctgggcgccttcgcgggccacagccaggcggcagccaacggcctgcacggcctcagcaggagcagcagcgcccccctgggcctggggaagcacgtgtcgctgtcgccacacgggccgggcccccacctgtctacctcacacctggcgctccggtcccaggcgcagcaccagctccacgcggccatgtttgccgcacccccgacactgcccccgcccccggcgctgccggccagcagcctggtcctcccaggacacccggccgatcacgagctgctcaggcaagagctgaacacgcggtttctggtgcagagcgccgagcggcctggcgcctccctgggcccgggggctctgctgcgggcggagttccatcagcaccagcacacacaccagcacacgcaccaacacacacaccagcaccaacacacattcgcccccttccccgcagggctgcccccgacgccgcccgccgcacccccgccgtttgacaagtatgcgcccaagctggacagcccctacttccgacattccagcgtgagtttcttcccgtccttccctcctgccatcccgggactgcccaccctgctcccacaccccggccccttcgggtccctgcagggcgcttttcagcctaaggtgtctgacccgtaccgggcggtggtcaagaagccggggaggtggtgtgccgtgcacgtgcagatcgcctggcagatctaccgtcaccagcagaagataaaggagatgcagctggacccccacaagctggaggtgggtgcaaagctggacctgttcggcagaccccctgccccgggcgtgtttgcaggcttccactacccacaggacctggcccggcccctcttccccagcacaggtgccgcccatcctgcctccaacccatttggaccctcagcccatcctggcagcttcctgcccactggccccctgacagaccctttcagcagaccgagcacctttgggggcctgggcagcctgagcagccacgcctttgggggcctgggcagccatgcactggctcccggtggcagcatctttgcccccaaggagggctcctccgtgcacggcctgcccagcccccatgaggcctggaaccgactgcaccgggcaccgccctccttcccggctccgcccccgtggcccaagtccgtggacgcggagcgggtgtcagccctgaccaaccatgaccgagagccggacaatggcaaggaggagcaggaacgggacctcctggagaagacgcgcctgctgagccgggcctcgcccgccacccccgctggccaccccgtcagcggcctcctgctccgggcccagagcgagctgggccgntccggggcccccgcggagcgcgaggccgaacctcgggtcaaggagagccgctccccggccaaggaggaggncgccaagatgcccgcgcgcgcatccccgccccacagcaaggcggcccctggagacgtgaaggtcaaggaggagcgcggggaggacgaggcctccgagcccccggcgggcggcctgcaccccgcgcccctgcagctcggcctgggccgcgagcgcctgggcgcgccgggcttcgcgtgggagcctttccgcggcctggagctgccacgtcgcgccttccccgctgccgcccccgccccgggctccgccgccctcttggagcccccggagcgcccctaccgcgaccgcgagccccacggctacagccccgagcgcctgcgcggggagctggagcgcgcgcgggccccgcacctgccgcccgccgcccccgccttggacggcgcgctgctgccctcgctgggagccctgcacttcccgcgcctctcgcccgccgcgctgcacaatgggctcctggcgcggaccccgcccgccgccgccgccctcggcgcaccgccccccctggtgacggcggccgggccccccacgccccccgggccgccgcggagccggactactccgctggggggcctcgggccgggcgaggcgcgcgactactccccgtcccgaaatcccccggaggtggaggcgcggtagccccggggccgcagacgcctctccgagcggagcgcaccgctgtccgtctctccatcagttcctagaactcaagcacagctcccgccgatcctggggcggcgccgcctctccacccgcagcctgcggaggcggggacttgggtgtcggcttttctgagggtgatcttttgttttccgagtttgggattcggctgttgggaaaaaaaaatcgcgtttgtaccttttccccccacagatgagaagtgtttgtaatggatttgtatttttcttaattttatgctctttagacgtttaaaagaaccaaaaaagaaacttttgcttcttcgttttcggttgggatttgcagtttaatggcctcagatccttctccagatccccagggtttctttgtcttatttatggagaaaaaccggtcactttgtccagcgcactgtgaggcccccactcaggccagccctggcccccccttggtacttggaaccgaagttacagattatattaaaataataatgtaca

SEQ ID NO: 202984 - DNA, 441 bp, Homo sapiens
  misc_feature (25)..(25): n is a, c, g, or t
cgactgcagcattcaaagcccccanggaggttgaagccgggcacagaaacacagcagcgggagcagcaacaccagcactgccacacacacacacacacacacacaaaatcactgctgtgtgttttcttccgcctgaggcatcagcgtcacctcggtgtggtcgtcgcctcccaggcccttggcctggcctcctctcagtttgggttttgccctcacccacatgagcccccccatgccctgccccccttgcggccttttgtgttccccgatgtctgggctgtgtccctgccgggattcccagccttcggggtcagccgtcgagccacttgctttgctcagttctgtgtttcagccacatttccacggtggaccctgtttgttttaaatattctgttcccatgtcaatcagtgacgataaatacagccttgatttggatgaaa

SEQ ID NO: 202985 - DNA, 4082 bp, Homo sapiens
  misc_feature (1975)..(1975): n is a, c, g, or t
  misc_feature (2046)..(2046): n is a, c, g, or t
gagcgcgcagagccggcgcggcggacatgcgcgtccccggcccgagctccggctgagcagggcacgcggggagaggggtcgcctggacgggccagggccacccggggctcgcgctccacgcccgcgtccatgcagcccggctccggccccgggactagtggcgactgcctggggcgccggcgaggcatccgtgggctctgagaagctctttgcgccgggaaccgataaaggcccagcgcttgagaagtcggaggccaaggccgggccggtgcccaaggtgtcaggcctggagcgcagccgcgagctcagcgccgagagcttcctgcccactgccagccccgcgccccatgccgcgccctgcccggggcccccgcccggctcccgcgccaatcccttggtgaagaaggaaccccccgccccgcaccgccacaccccgcagccgccacccccgcagccccgcggcctgctcccgacacacgtgcctgcatccctgggcgccttcgcgggccacagccaggcggcagccaacggcctgcacggcctcagcaggagcagcagcgcccccctgggcctggggaagcacgtgtcgctgtcgccacacgggccgggcccccacctgtctacctcacacctggcgctccggtcccaggcgcagcaccagctccacgcggccatgtttgccgcacccccgacactgcccccgcccccggcgctgccggccagcagcctggtcctcccaggacacccggccgatcacgagctgctcaggcaagagctgaacacgcggtttctggtgcagagcgccgagcggcctggcgcctccctgggcccgggggctctgctgcgggcggagttccatcagcaccagcacacacaccagcacacgcaccaacacacacaccagcaccaacacacattcgcccccttccccgcagggctgcccccgacgccgcccgccgcacccccgccgtttgacaagtatgcgcccaagctggacagcccctacttccgacattccagcgtgagtttcttcccgtccttccctcctgccatcccgggactgcccaccctgctcccacaccccggccccttcgggtccctgcagggcgcttttcagcctaaggtgtctgacccgtaccgggcggtggtcaaggtgagcacgtgttgggaaggcccgtggcaagggaggactctggtgcccccggggcggcctcggggggcccgtgacagcaggagtctgcagaaaacatgggtgggggtggcaccagccccactgagcgcttccatcctgtcgcagaagccggggaggtggtgtgccgtgcacgtgcagatcgcctggcagatctaccgtcaccagcagaagataaaggagatgcagctggacccccacaagctggaggtgggtgcaaagctggacctgttcggcagaccccctgccccgggcgtgtttgcaggcttccactacccacaggacctggcccggcccctcttccccagcacaggtgccgcccatcctgcctccaacccatttggaccctcagcccatcctggcagcttcctgcccactggccccctgacagaccctttcagcagaccgagcacctttgggggcctgggcagcctgagcagccacgcctttgggggcctgggcagccatgcactggctcccggtggcagcatctttgcccccaaggagggctcctccgtgcacggcctgcccagcccccatgaggcctggaaccgactgcaccgggcaccgccctccttcccggctccgcccccgtggcccaagtccgtggacgcggagcgggtgtcagccctgaccaaccatgaccgagagccggacaatggcaaggaggagcaggaacgggacctcctggagaagacgcgcctgctgagccgggcctcgcccgccacccccgctggccaccccgtcagcggcctcctgctccgggcccagagcgagctgggccgntccggggcccccgcggagcgcgaggccgaacctcgggtcaaggagagccgctccccggccaaggaggaggncgccaagatgcccgcgcgcgcatccccgccccacagcaaggcggcccctggagacgtgaaggtcaaggaggagcgcggggaggacgaggcctccgagcccccggcgggcggcctgcaccccgcgcccctgcagctcggcctgggccgcgagcgcctgggcgcgccgggcttcgcgtgggagcctttccgcggcctggagctgccacgtcgcgccttccccgctgccgcccccgccccgggctccgccgccctcttggagcccccggagcgcccctaccgcgaccgcgagccccacggctacagccccgagcgcctgcgcggggagctggagcgcgcgcgggccccgcacctgccgcccgccgcccccgccttggacggcgcgctgctgccctcgctgggagccctgcacttcccgcgcctctcgcccgccgcgctgcacaatgggctcctggcgcggaccccgcccgccgccgccgccctcggcgcaccgccccccctggtgacggcggccgggccccccacgccccccgggccgccgcggagccggactactccgctggggggcctcgggccgggcgaggcgcgcgactactccccgtcccgaaatcccccggaggtggaggcgcggtagccccggggccgcagacgcctctccgagcggagcgcaccgctgtccgtctctccatcagttcctagaactcaagcacagctcccgccgatcctggggcggcgccgcctctccacccgcagcctgcggaggcggggacttgggtgtcggcttttctgagggtgatcttttgttttccgagtttgggattcggctgttgggaaaaaaaaatcgcgtttgtaccttttccccccacagatgagaagtgtttgtaatggatttgtatttttcttaattttatgctctttagacgtttaaaagaaccaaaaaagaaacttttgcttcttcgttttcggttgggatttgcagtttaatggcctcagatccttctccagatccccagggtttctttgtcttatttatggagaaaaaccggtcactttgtccagcgcactgtgaggcccccactcaggccagccctggcccccccttggtacttggaaccgaagttacagattatattaaaataataatgtacaaaactttgtttttttgccttattatgcagaagtgtaatttcttttttggtttgtttttttaaaagcaaacgaaacgtgtaaatagtctgttgatataaatatatgacgttactaaattcttaatctagatagactttataaaaaccgtttccagaaacccctctggttgtttgtctaacatggtcacaaaaacccaggcgctgctggctgtaaacattatcagaagtttaatggcagcaactttccttcaactatgcaagcgcttcccggcggctctgctggttgggggaggaaggttccgccagcgacctcccagcccctgggtccgtggaggggttgggtccccccagcagagcccctgggccagcagaacagcactcctgggcggctcctgtgggcttcaggactggccggctccagccgcaagggcgatgctgtggacgtttgtgtggatggtgcagtgttcttggaatctgtagaccagatcggtggaggtatagaagtgcaagagtctaaaggctgattttacacacacacacacacacacacacacaaaatcactgctgtgtgttttcttccgcctgaggcatcagcgtcacctcggtgtggtcgtcgcctcccaggcccttggcctggcctcctctcagtttgggttttgccctcacccacatgagcccccccatgccctgccccccttgcggccttttgtgttccccgatgtctgggctgtgtccctgccgggattcccagccttcggggtcagccgtcgagccacttgctttgctcagttctgtgtttcagccacatttccacggtggaccctgtttgttttaaatattctgttcccatgtcaatcagtgacgataaatacagccttgatttggatgaaa

SEQ ID NO: 202986 - DNA, 4227 bp, Homo sapiens
  misc_feature (1831)..(1831): n is a, c, g, or t
  misc_feature (1902)..(1902): n is a, c, g, or t
gagcgcgcagagccggcgcggcggacatgcgcgtccccggcccgagctccggctgagcagggcacgcggggagaggggtcgcctggacgggccagggccacccggggctcgcgctccacgcccgcgtccatgcagcccggctccggccccgggactagtggcgactgcctggggcgccggcgaggcatccgtgggctctgagaagctctttgcgccgggaaccgataaaggcccagcgcttgagaagtcggaggccaaggccgggccggtgcccaaggtgtcaggcctggagcgcagccgcgagctcagcgccgagagcttcctgcccactgccagccccgcgccccatgccgcgccctgcccggggcccccgcccggctcccgcgccaatcccttggtgaagaaggaaccccccgccccgcaccgccacaccccgcagccgccacccccgcagccccgcggcctgctcccgacacacgtgcctgcatccctgggcgccttcgcgggccacagccaggcggcagccaacggcctgcacggcctcagcaggagcagcagcgcccccctgggcctggggaagcacgtgtcgctgtcgccacacgggccgggcccccacctgtctacctcacacctggcgctccggtcccaggcgcagcaccagctccacgcggccatgtttgccgcacccccgacactgcccccgcccccggcgctgccggccagcagcctggtcctcccaggacacccggccgatcacgagctgctcaggcaagagctgaacacgcggtttctggtgcagagcgccgagcggcctggcgcctccctgggcccgggggctctgctgcgggcggagttccatcagcaccagcacacacaccagcacacgcaccaacacacacaccagcaccaacacacattcgcccccttccccgcagggctgcccccgacgccgcccgccgcacccccgccgtttgacaagtatgcgcccaagctggacagcccctacttccgacattccagcgtgagtttcttcccgtccttccctcctgccatcccgggactgcccaccctgctcccacaccccggccccttcgggtccctgcagggcgcttttcagcctaaggtgtctgacccgtaccgggcggtggtcaagaagccggggaggtggtgtgccgtgcacgtgcagatcgcctggcagatctaccgtcaccagcagaagataaaggagatgcagctggacccccacaagctggaggtgggtgcaaagctggacctgttcggcagaccccctgccccgggcgtgtttgcaggcttccactacccacaggacctggcccggcccctcttccccagcacaggtgccgcccatcctgcctccaacccatttggaccctcagcccatcctggcagcttcctgcccactggccccctgacagaccctttcagcagaccgagcacctttgggggcctgggcagcctgagcagccacgcctttgggggcctgggcagccatgcactggctcccggtggcagcatctttgcccccaaggagggctcctccgtgcacggcctgcccagcccccatgaggcctggaaccgactgcaccgggcaccgccctccttcccggctccgcccccgtggcccaagtccgtggacgcggagcgggtgtcagccctgaccaaccatgaccgagagccggacaatggcaaggaggagcaggaacgggacctcctggagaagacgcgcctgctgagccgggcctcgcccgccacccccgctggccaccccgtcagcggcctcctgctccgggcccagagcgagctgggccgntccggggcccccgcggagcgcgaggccgaacctcgggtcaaggagagccgctccccggccaaggaggaggncgccaagatgcccgcgcgcgcatccccgccccacagcaaggcggcccctggagacgtgaaggtcaaggaggagcgcggggaggacgaggcctccgagcccccggcgggcggcctgcaccccgcgcccctgcagctcggcctgggccgcgagcgcctgggcgcgccgggcttcgcgtgggagcctttccgcggcctggagctgccacgtcgcgccttccccgctgccgcccccgccccgggctccgccgccctcttggagcccccggagcgcccctaccgcgaccgcgagccccacggctacagccccgagcgcctgcgcggggagctggagcgcgcgcgggccccgcacctgccgcccgccgcccccgccttggacggcgcgctgctgccctcgctgggagccctgcacttcccgcgcctctcgcccgccgcgctgcacaatgggctcctggcgcggaccccgcccgccgccgccgccctcggcgcaccgccccccctggtgacggcggccgggccccccacgccccccgggccgccgcggagccggactactccgctggggggcctcgggccgggcgaggcgcgcgactactccccgtcccgaaatcccccggaggtggaggcgcggtagccccggggccgcagacgcctctccgagcggagcgcaccgctgtccgtctctccatcagttcctagaactcaagcacagctcccgccgatcctggggcggcgccgcctctccacccgcagcctgcggaggcggggacttgggtgtcggcttttctgagggtgatcttttgttttccgagtttgggattcggctgttgggaaaaaaaaatcgcgtttgtaccttttccccccacagatgagaagtgtttgtaatggatttgtatttttcttaattttatgctctttagacgtttaaaagaaccaaaaaagaaacttttgcttcttcgttttcggttgggatttgcagtttaatggcctcagatccttctccagatccccagggtttctttgtcttatttatggagaaaaaccggtcactttgtccagcgcactgtgaggcccccactcaggccagccctggcccccccttggtacttggaaccgaagttacagattatattaaaataataatgtacaaaactttgtttttttgccttattatgcagaagtgtaatttcttttttggtttgtttttttaaaagcaaacgaaacgtgtaaatagtctgttgatataaatatatgacgttactaaattcttaatctagatagactttataaaaaccgtttccagaaacccctctggttgtttgtctaacatggtcacaaaaacccaggcgctgctggctgtaaacattatcagaagtttaatggcagcaactttccttcaactatgcaagcgcttcccggcggctctgctggttgggggaggaaggttccgccagcgacctcccagcccctgggtccgtggaggggttgggtccccccagcagagcccctgggccagcagaacagcactcctgggcggctcctgtgggcttcaggactggccggctccagccgcaagggcgatgctgtggacgtttgtgtggatggtgcagtgttcttggaatctgtagaccagatcggtggaggtatagaagtgcaagagtctaaaggctgattttacacacacacacacacacacacacacaaaatcactgctgtgtgttttcttccgcctgaggcatcagcgtcacctcggtgtggtcgtcgcctcccaggcccttggcctggcctcctctcagtttgggttttgccctcacccacatgagcccccccatgccctgccccccttgcggccttttgtgttccccgatgtctgggctgtgtccctgccgggattcccagccttcggggtcagccgtcgagccacttgctttgctcagttctgtgtttcagccacatttccacggtggaccctgtttgttttaaatattctgttcccatgtcaatcagtgacgataaatacagccttgatttggatgaaaaaaaaaaaagaatgaaacacacacagcacacataccacccacccatacacaaccgacaccgacagaccacagagacaaaagaaagaccagacgagcaggggacgcccacagtggcgcgcgggcgagcaaaaaaaagcgcagcacaacaaccggagcagacacgacgacagaagcacggccccaacgccgagcccacactgcgcggaacacagacggcggagaacaaaccgggggccaccaccagtagcgagccgcaaacacacagcaaagacgggggcacccgcgagag

SEQ ID NO: 202987 - DNA, 3647 bp, Homo sapiens
  misc_feature (1831)..(1831): n is a, c, g, or t
  misc_feature (1902)..(1902): n is a, c, g, or t
gagcgcgcagagccggcgcggcggacatgcgcgtccccggcccgagctccggctgagcagggcacgcggggagaggggtcgcctggacgggccagggccacccggggctcgcgctccacgcccgcgtccatgcagcccggctccggccccgggactagtggcgactgcctggggcgccggcgaggcatccgtgggctctgagaagctctttgcgccgggaaccgataaaggcccagcgcttgagaagtcggaggccaaggccgggccggtgcccaaggtgtcaggcctggagcgcagccgcgagctcagcgccgagagcttcctgcccactgccagccccgcgccccatgccgcgccctgcccggggcccccgcccggctcccgcgccaatcccttggtgaagaaggaaccccccgccccgcaccgccacaccccgcagccgccacccccgcagccccgcggcctgctcccgacacacgtgcctgcatccctgggcgccttcgcgggccacagccaggcggcagccaacggcctgcacggcctcagcaggagcagcagcgcccccctgggcctggggaagcacgtgtcgctgtcgccacacgggccgggcccccacctgtctacctcacacctggcgctccggtcccaggcgcagcaccagctccacgcggccatgtttgccgcacccccgacactgcccccgcccccggcgctgccggccagcagcctggtcctcccaggacacccggccgatcacgagctgctcaggcaagagctgaacacgcggtttctggtgcagagcgccgagcggcctggcgcctccctgggcccgggggctctgctgcgggcggagttccatcagcaccagcacacacaccagcacacgcaccaacacacacaccagcaccaacacacattcgcccccttccccgcagggctgcccccgacgccgcccgccgcacccccgccgtttgacaagtatgcgcccaagctggacagcccctacttccgacattccagcgtgagtttcttcccgtccttccctcctgccatcccgggactgcccaccctgctcccacaccccggccccttcgggtccctgcagggcgcttttcagcctaaggtgtctgacccgtaccgggcggtggtcaagaagccggggaggtggtgtgccgtgcacgtgcagatcgcctggcagatctaccgtcaccagcagaagataaaggagatgcagctggacccccacaagctggaggtgggtgcaaagctggacctgttcggcagaccccctgccccgggcgtgtttgcaggcttccactacccacaggacctggcccggcccctcttccccagcacaggtgccgcccatcctgcctccaacccatttggaccctcagcccatcctggcagcttcctgcccactggccccctgacagaccctttcagcagaccgagcacctttgggggcctgggcagcctgagcagccacgcctttgggggcctgggcagccatgcactggctcccggtggcagcatctttgcccccaaggagggctcctccgtgcacggcctgcccagcccccatgaggcctggaaccgactgcaccgggcaccgccctccttcccggctccgcccccgtggcccaagtccgtggacgcggagcgggtgtcagccctgaccaaccatgaccgagagccggacaatggcaaggaggagcaggaacgggacctcctggagaagacgcgcctgctgagccgggcctcgcccgccacccccgctggccaccccgtcagcggcctcctgctccgggcccagagcgagctgggccgntccggggcccccgcggagcgcgaggccgaacctcgggtcaaggagagccgctccccggccaaggaggaggncgccaagatgcccgcgcgcgcatccccgccccacagcaaggcggcccctggagacgtgaaggtcaaggaggagcgcggggaggacgaggcctccgagcccccggcgggcggcctgcaccccgcgcccctgcagctcggcctgggccgcgagcgcctgggcgcgccgggcttcgcgtgggagcctttccgcggcctggagctgccacgtcgcgccttccccgctgccgcccccgccccgggctccgccgccctcttggagcccccggagcgcccctaccgcgaccgcgagccccacggctacagccccgagcgcctgcgcggggagctggagcgcgcgcgggccccgcacctgccgcccgccgcccccgccttggacggcgcgctgctgccctcgctgggagccctgcacttcccgcgcctctcgcccgccgcgctgcacaatgggctcctggcgcggaccccgcccgccgccgccgccctcggcgcaccgccccccctggtgacggcggccgggccccccacgccccccgggccgccgcggagccggactactccgctggggggcctcgggccgggcgaggcgcgcgactactccccgtcccgaaatcccccggaggtggaggcgcggtagccccggggccgcagacgcctctccgagcggagcgcaccgctgtccgtctctccatcagttcctagaactcaagcacagctcccgccgatcctggggcggcgccgcctctccacccgcagcctgcggaggcggggacttgggtgtcggcttttctgagggtgatcttttgttttccgagtttgggattcggctgttgggaaaaaaaaatcgcgtttgtaccttttccccccacagatgagaagtgtttgtaatggatttgtatttttcttaattttatgctctttagacgtttaaaagaaccaaaaaagaaacttttgcttcttcgttttcggttgggatttgcagtttaatggcctcagatccttctccagatccccagggtttctttgtcttatttatggagaaaaaccggtcactttgtccagcgcactgtgaggcccccactcaggccagccctggcccccccttggtacttggaaccgaagttacagattatattaaaataataatgtacaaaactttgtttttttgccttattatgcagaagtgtaatttcttttttggtttgtttttttaaaagcaaacgaaacgtgtaaatagtctgttgatataaatatatgacgttactaaattcttaatctagatagactttataaaaaccgtttccagaaacccctctggttgtttgtctaacatggtcacaaaaacccaggcgctgctggctgtaaacattatcagaagtttaatggcagcaactttccttcaactatgcaagcgcttcccggcggctctgctggttgggggaggaaggttccgccagcgacctcccagcccctgggtccgtggaggggttgggtccccccagcagagcccctgggccagcagaacagcactcctgggcggctcctgtgggcttcaggactggccttttgtgttccccgatgtctgggctgtgtccctgccgggattcccagccttcggggtcagccgtcgagccacttgctttgctcagttctgtgtttcagccacatttccacggtggaccctgtttgttttaaatattctgttcccatgtcaatcagtgacgataaatacagccttgatttggatgaaa

SEQ ID NO: 202988 - DNA, 366 bp, Homo sapiens
acccccactgacaggtcccaatgtgtgttgttcccttccctgtgccaatgtgttctcattgttcagttcccacttacaagtgagaacatgctgtgtttggttttctgtttctgcgttagtttgctgaggataatggcttccagctccatccatgttcctgcaaaggacatgatctcattccttttatggctgcatagtattccatggtatatatgtaccacattttctttatccagtttatcactgatggacatttgggtagattccatgtattcactattatgaatagtggtgatgcacattttccttgtggctggcacgtatcagattataaatcttatctgaatctgactaatgaagattttt

SEQ ID NO: 202989 - DNA, 733 bp, Homo sapiens
gatttcagagttgactttggggtcacagatcagagtgaccctgtgattgtagcttgcccacactcatactttctctgagtgacgtccttgcagctcttggtctatgaagtgcccagaacttcacattgtaaaggatgttcagtctgtggttccccatgggaatgattttcacctgaaatgtttatatttgcgtaaacttaatactaacgaatgggtttctaccgtgagatcctctagaagccatctggagggcttgtctgcagaaagccagcttttcttttccttgtgaatttgaagagaggtccgtaggctggccctggagcaggcctttcctctgttccctggccccagaagagtcatgtcccgagcccctcctcgatccgtcttctcgctgccattgttttaaatgtgctgtgacatcacccgtccctgaatccttgctcgactgagtgaactggctgggttttctgtgtctcagcggaagattccctttctcactgaaaagagaactgtgttttttttttttctttttttcactgtataatctatataccatcctaggggacttggtggaggtggggggcaatgcttgcaatatagataagggaaaatatcaaaagtgaacattaccttttatgaccagcattttttctgatcacttttattgaggtagactgtatataactcaataaataaagctcagcagttgtgagtgaacagtttcgtgagtttt

SEQ ID NO: 202990 - DNA, 314 bp, Homo sapiens
tggaagctattgctggagcctgcagccgcagctggtagtccatctgtgcgtcgattcctgcagagatgcagcgccgggctgtgtgggtgctgtggtaccagcccaccaggacaggccccgcaggaacaggctctggtagatctgtaatcctgttggctggcgacacgtgtcgccagccaacaggatgggaggaagggcagactgtggtggccaaacaccagcatgcaggagggttgttctagatgcatccatccttctgtgggtgcacggatgaggttctggatgtaattcatgggcttcatgaacttggctga

SEQ ID NO: 202991 - DNA, 105 bp, Homo sapiens
atcatgtcatctgaaaagagacagagtttttcatcgtttctcttttttttttgagacggagtctcactctgtcccccgatctggagtgcagtggcgcaatctcgg

SEQ ID NO: 202992 - DNA, 405 bp, Homo sapiens
acacacaccccaacagaaacaaacacaccccacacccacacacccaccccagtaaaaaccaaaccaataaaacaccactcagaagctctccctttcccctgagctgctgctttagatgtgtggccccgacaggtaccttaccctcagagcagaaatccaggcatccctggcagccttccttcctcacccctcagtcttgctggtgcccagatgggagctggcagagatgtctcctggatgggcgctcactttgctcttctgtagccttggtggcttagccccagaccactcctccttacaacagcctctggaccctgagtctacccctcactcttctgctcgtccgtagcggccggccgctacggacgcgggcgggggatatagggtcgaagccgcactcgtaag

SEQ ID NO: 202993 - DNA, 643 bp, Homo sapiens
gcaaacagactcaagattttgggccaatcatgtgcctctctttttacctggatggagagtttcaaagaaggcataggcatgttagtgtgcacaggagagccccaagacaagcataaatttccaaaacatcaaaaggagcagttgcgttgtttacaagcgctcagttggctcaccagttctgaccttcttgctgcaataatcagttctatggctgaattacaagacgtcattggtaaagcagatccaaattccagaatttgtggacatttactcataggtgcagccaagaattcttttgcaaaactcatggataaaattagtctggtaatggaatgtatacctctgcacagtagcaggagtattacatatgtagaaaaagattccctggttcagaggctggcccatggacttcataaagtaaacacactggccctgaaatatggtttgcgtggccatgtgcccattacgaaaagcacagcatcgttgcagaagcaaatacttggatttacacaaagactgcatgctgcagaagtggagcgccgctcactacgcttagaggtcacagaattcaaacgaagtgtgaatgaaatgaaaaaggagcttgacaaagcccagggtctgcaaatgcaattaaatgaattta

SEQ ID NO: 202994 - DNA, 678 bp, Homo sapiens
cagcttcttgggaaaccaacacacaatcacttgaaccaaggaggcagaggttgcggcgagccaagatcgcaccactgcactccagcttgggccacagagtgagaccctgtctcaaaaaaaaaaaaaaaaaaaaaaagggtaagggaacaaaaggagctggtagaagtgcagttctctaggtgggcatagtggtgcgtgcttgagtcctagctacttaggagactgagatgggaggatcacttgagcccaggaattcgaaaccagccaccgcggcatagtgagaccccacctcaaaaaaaaaaacaacaaagaaaaaccttccatgatgcgattattacgcattgcacgcctgtaccaaaatatctcatgcacccctactatgtacccacaaaaattttaaaaagaaaattttaatgcagcaagtatatttaaaaaaaaaaagaaaaaagtgcagtccttagcctaaagggaaaggacttttaccacgcttcaggcagttgactttcccctctgggtccctgcaagtccaagaggaggaaagcagccctcagggaggttctgagctcccctaggaagaatgatgcatctagcccagtcggcatctggtattaattaacctactgtactagagcaggctgagatatagtaagaggagcggggtaccgccgcgtctcgata

SEQ ID NO: 202995 - DNA, 1414 bp, Homo sapiens
gtgaacctgtcactacagggaaaacatctgactgtattggttgacagtgataaaatttgagcttcaagtgaaattataagtaagtaaacttgaatcggccaccatgagcataacagccttttattactttcctgatgagatgggtggtgacattaatgaatgtgggttaaaaaaattgtgtaatgaaatgtaccagcatttgaaagatctactttaactcagtgaaccagtattatctaaatgacccggtgtttgattatacagtgatgcatgggttaaagatctgttcagagtgcaagttagatccaatgcattttaatgagacagcatgaaaattcatttatatggtttcagattccactttgcaactgtaggagactagaatataccaccctaaaatatgcctgtttggtgtaaggattattttgagaagcagacacaggagaagttctgaaaacagagtagaagttacccttttgtaagggaaaatttatatctataaaggaaatctcccttgtaagggtgtcttcctcattaccaggaaaaggatgactcaatcactagaaacttactaatggagaaggcatagacttaaatctgtataacaagccttactgttgtttaccatgcttttcttggtcacctctccataactattgctccctagcccctgtgcccttctttatttgtttcagctgaagatgatatttaagtctgaattctaagccacctcttagaaatgaaaagatttactcatttctctgggtatctctcatggatacatgagatatatttattatatttctgattttctcttgttaatttgtcttttgttaaggggtctgacccaacttagaactcagatagggtagaggaaaaattatttttttctctcctataaaactcacctttaagaaattaccagttgttttagtgtaatatcaagaaatatccataattatttataaaagtttattaaaatagtccttccttttacaagtacatgtctttgtgaggccagattttctttatatccttaaatcaagataacattgcaccggattgaatgcagaagtaaataactgttttctattaagtcaggtaattatatgcaaatatatgtttttaattattttataattctcattgtttcagaagttttgttttttgcaaaaattgttatttatgttaatatatgatgggctttaaaaagtgaatgagggccaggtatagtggctcatgcctgtaatcccagcactttaggaggccaggcaggtatatcacctgaggtcaggagtttgagactagcctggccaacatggtgaaaccctgtctctactaaaaatacaaaaattagccgggcatggtggcgggcacctgtaatcccaactacttgggaggctggggcaggaga

SEQ ID NO: 202996 - DNA, 530 bp, Homo sapiens
gctcaatggaaatagcagtgtgatgtggctgcccaaaaatgccatgaggtttctgctgttttaataggactgggatgtctcagataagacaagacagtgccactgtactcttcactgggcatatcttaccacacatgatttcctttcttatcacctcgtttttagaaggatgtgcacaaaccggaacaaggtcagagagcaaggagacgagtgagggaaattgacatcatgtcttaaaaggaagaaatggggttgggcctgatggctcacacctataattccagcactttcagaggccggggcgggtagatcatttgaggccaggagttcgagaccagcctggccatggtgaaaccccatctccactaaacatacaaaaattagccaggcatggcagcacatgcctgtaatcccagctactctggaggctgtaacacaagagtcacttaaacctgggaagtggagtttgcaatgagccaagatcacgtcacttcactccagcctgggcaacagagcgagactccatctca

SEQ ID NO: 202997 - DNA, 527 bp, Homo sapiens
cagatcactgtaagattttctgcttgtgtatagcaacttaggtattctaggtattcaagccgttaatttactcactcaattagttgtcttttcatacaaatagtttccaagaagcccttcagaaacactaaaggaattttgaagtgccataagtggaccagggagggtgatgtaaagattatttttggcagtgctcctccttgaacccatttcagcttccctcctcctccctcttttggggaaaacaagcaacctgctcaggctgcccagtcttagtcacaccttccctactgatgttaacatttttaatggtggcagggtaattgtggaggtggtggtggtttttaaacaaagcaatactttgctagaggttgtgtctgtggcaccagtggctcacaccaggccttgccaggaccccttccagtatgtccaacaccttctctgcctgacccagtgagacagtcaactgaagtgtctctggagaccctaaaatatgggcataaccagactcgacaggtttcggggtc

SEQ ID NO: 202998 - DNA, 555 bp, Homo sapiens
ttttttatttgtacacatttatgggctacatgagaaactttgttacatgtttataatgcatagtgatcaagtcagggcatttagggtttctcactgtaccccagggcagccccagggctctccttgggcttctggcagcctgagtggtgtctcatcacagggaattttactgagcaaaggcagcttggcgtatactgagggtgtacagtccaggacccacagcattgatctcacctgggaacttattagaaatccagattctcaggccaaccctaggcccactgaattagaaagtctgggagaaaggcctggaatttgggttttaacaaacgctgcaggtgattctgatgcacgctggagaaccactggatggacaaaggctgcaggacttgaggtcagtccatttgacccccaatctctcactattttgtgaccttgggaaggttactaagccccgtgaacctcatcatctccctgtgaattgctttgttacgatgtccatgtctggaatgcagctggccctccataaatgttagctctctttccttctcactt

SEQ ID NO: 202999 - DNA, 521 bp, Homo sapiens
aaaatgagttaaagttacaaggaagctgattttggcatccataagaaaaatgggcacaacgatcgttgctttttgcgtggattgccacaagaatgtttttggattcacagatgtttaatactacacatcactttctccttctcctacttttcccataggttttcattcaacagatatctgttgattatcttgtggtgtttcaagatgtgtccatctgcattttagctgggcatatgcccaaacagcatagatttcaagctgtcacaacccaccatgggacagatacttcttaaagtgtgtgtgggttgcgttactgggacccccaattgccacaccgctagcatttgtccacttgtaaagattttcttacttgtcttccttgttgaatcaggaagtggacttttacatggtgcatgcagtttttgatgcgcttcctctccctgctccctggaggtgccgcatgaaagcgcttttccctggacgttcagttccctctccactccttgtctctgtgcatcctg

SEQ ID NO: 203000 - DNA, 190 bp, Homo sapiens
caatctactattctgcatggagacatattcctattattctctgctaaaaatactttattggctgcccaggtcttgaaaataggaaatttcacatattcgtcacagtttgagtggagaaacattgtctatttttaccttattcattttctctcctcctttgaaaccgtatggtttatactttcacaacata

SEQ ID NO: 203001 - DNA, 277 bp, Homo sapiens
ggttttacagactcaaatttgaaactctaacagctctgccacctactgtgtggccctgggcaatttaccctctgagaatcagtttcctcatctatataaatgagggtataaataatatatatcttaaaagtgatctgaagagtagatgagaactgctgacatagaagacactcacagctggattccttaattcttcttctggggattgcatcaatgcatcaccctcatcaaagcagcttacatgaattaaagccttactgagtcttgcactgctctg

SEQ ID NO: 203002 - DNA, 378 bp, Homo sapiens
acctgctaaaacatctgtatataatttgaagaaattacatactttatgatttcattttattgctgtaaatatttatgttttttactaatttctgtctcaagtgccataatatataagaaatatacaatggataaagagagaacatgcaaaataaagggaatgtggagaagaaagctgagggatataactcaaatattttcctcaagtccttggattctgtgaactataaattgctcatgatggattaatgttttaatttcagtaatacaatcaggattaagagaagcttagatagcatctttaaagggattcttctgctacatacataccacaagacagatacataataacgtatcaggtggatgaatacctgtatct

SEQ ID NO: 203003 - DNA, 684 bp, Homo sapiens
aatgagaggttctaagagatgggctagtggcttgtaatatggggaaatggggtgaatgtcaggtggatcagagagatgcagtcatggggatcaggtgtggtatcaggaataatgtgggaggccagattgaagtctgggccaggaacaatggtaattgtgggacttaacaaagaatgagtacagctgaaggagccggggagcagaaagtatatgcgtcaggtatgaggaagaaaatagattttggaagttatgagaaatgtagagagtgagttgaacatagtttgtgatttttagggcctctaaaattattaaagcagcggcagctgctgcatgcagacatgagggctaggctaaaacagtaaggtcaaattgtttggtgaataagctaataagacacttgctagttattctgtaatttttatttttaaagttgacattcaaaagagagctgaaagcttcaaagtttgggggccacttgcagttctgtaatgagagagcaaagtcacggtttatacggagctaggaaaacctgacgtccaaagaaattgacaaagggatccattccacaaacatttgtggccaaggcagtattactggagcccttagggtggggccagcatttctcataaacaagctcctgtcagtttggaccacctaaaatgtggcctgggttaaacctctaac

SEQ ID NO: 203004 - DNA, 657 bp, Homo sapiens
tggtctccaagacaattcccgctgggatcaagtcaggaaggctcaccaggacactaaagcctaaaagtatgtgtcagaaaaagagacattttataagctttgaaggagcttctttctatcactttcaagtgatctacaattgcatctttaatgaatgtttcatctctgggaatagccggatgatctgataagacttaagacaatgaaggaaaagaatggaattccattaaaaaaaaaaaagtccatcctgaagacatcatagcctttggtagaataaatggcatcagcaataaaactgtttgctttgtcaaagactggaacagaaaatttaacaagggagtaacaggaaaataggtgcatttcagctacaaaagatcttagcagaacttctcttggttattaagtttactccagaattaaatattgactctgtacgatgtaaatgaataattcataaactgcaaagttatgcatacatgaaaatgaacataagggaaaagataagtcagtttcacacttcttgaagaagtttcattttatgtagggtagtaaaatcagtttgtctttttttaagctttttaacaaccacctccccatcctcctaccctcatagtcccaacacaaagactggatttgcttgtagtgcagtaatcagct

SEQ ID NO: 203005 - DNA, 492 bp, Homo sapiens
taaaaatacaaaaattttagctgggcgtggtggcgggcgcctgtagtctcagctacttgggagactgaggcaggagaatggcgtgaacgtggaaggtggagcttgcagtgagccgagatcgcgccactgcactccggcctgggcgacagagtgagactccatctcaaaaaaaaaaaaaaaaaaaaagataaaaggtcacctttactgagcacaccctatctcagtccatccctacatcagccctttatttcaccagtggggaagctgggacacagagtagttaggtgggatgcccaaggtgggaccactcgtgtgaagtttccacaccctaatgtgagaccctccatgacctagcccctctctttctccagcctcatttcctgattctctcgcttggcctgcaggcttcagccacacaaacttctttaaagtcccttaaatctggctgagcgcagtggctcacacctgtaatctcagcactttgggaagctg

SEQ ID NO: 203006 - DNA, 614 bp, Homo sapiens
ttttatggctgcatagtattccatggtggtatatgcatttatttcacttcctccaaataaaataacagtaaagggatttttaaatgcagaaagccagtgagacaaagggactctataaagcctgtggataattgtgattaacctagaagtccttacatgctgaaacctaagctactattgagagacattgagaagcaaccttattttcatttcagaacctccaactgactcaacagtgagagtgaggctaagaatagtaggatttattagtcatgtgtttaaagtgaacttggatcccagatgcctcctcacactccagtaaaaccagtagtttattctgtggagaatgtgaactagagaactcggttggggataccaaggtacagacagagggtgaaagatgaaatgaaatgcttagtaaacagtaagacaaccctggctgacttcttccacttattgccaaagttttggcagtcagctttacattctctaaacatggaatgggaagatacttccttggagaacctgactgatctatgcaaaagaccgatagacactgatggctggggtctgccagcaggacttctgtgcagtgaagcccacttgttcacaag

SEQ ID NO: 203007 - DNA, 470 bp, Homo sapiens
agaaataataatgttttagagcagagataatacaaaatagagaacagaaaaacaatggagcaaatcaaggaaaccaaaagttggacccttaaaaagacaaataatattggcatgccttacctagactgaccaagagaaaagttactaaattactaaaatcagaaataaaaatgaggacattactactaaccttacagaaataaaaacaattataagaaaatgagcaatgggatatcaacaagtcacataacttagataaaatagatgaattcctagaaacacacaaactaccaacactgactgaaaaagaaacacaaaatctgaaatctataacgagaaaagaatgaatcagtatcaaaaaacttccagataagaaaagtccaggcccagaaagtttcactgatgaattctgccaaatgtttaaagaattaacactaatctctctcaaattcttgaaaaaaaatgaagag

SEQ ID NO: 203008 - DNA, 715 bp, Homo sapiens
tccatggtgctggcgcgggtggcgcgccggccggcggggtctgcggaggcccaggcgtccctggcggggaaggcggcgcttccgggtctggggagcgagggtccccgctctaggggcacggaggatatttagactggggcgcccgtgggcctggtgctgccgcctcgggcgccggcatcctgcgatatcccctctccccggctctgggagggaaccgaggcagccccgcgccaggcctccccggacacctggggcaaattcgctcctcagagcctcgtgttccttccccaaacctgaggtagcgacccctccacccctaagggcggccgtgaggtcgaatcatgtgccgaccccagccggcccttgcaaacgttgtgatgtcggcctccggaggccgcgccttctgatcatgggcacatgatgggggtcaccggctgtgggtgcctcctctgtggagggcccggcctcaccttccaggacccgaatgatactctggggagggggagatggtacagagggtggagctggggctcctgccattagggcaggaaggactttaaacccaaagctgggttctcagccacgagggccacgtgttctggcgagacccctggtcccggctccggtctacaccccctccccagatgtggaccggtggcaaggctggccctgtctggggcttggaagccagtgtggggacctgctgctgggaaga

SEQ ID NO: 203009 - DNA, 919 bp, Homo sapiens
tatggacttggatgatcacttggttaatattcaggctatcttgacagtctccacacccgtgagcaatgtcccagggcagcctgcaggcctgatagaaactccacaaacctgcctatcacggggaagaggccttatccttcgccacataacctggctcgcctctgggttatgggtggggaatcagtaagtcctactgctgttcaggccctgaccccagttcccaggaaagcacaaggctagtgccaccagaggtccaggccctttgctggaggctccatcaactccactaccagtgggctaccagcagctccactagggttcctagaggaggcagcccagctgcagaagaggacaggaggatctacggtgtggcagcagccctgtcttagatcactggtggcctgcaaagaaggctggtccttaacacacaaggttcccccagggcctctggagcacaagacctggcagaagtggtatccagcttagaggtgactgcctcagttttcccagcccatggactgatgggaaggtcaagaccctaatgatgctccatgggagaagaggacatgcttgaggcaaaggccagcccatgcttagcccctggccacgagccaggattgcctctgctgcttgccctgtggccctgcagatgaacttaggccctctccagagcagagcatttgttgcccttcctgctcctttagcctcagggcaggaggctgccgggtttcctcacacgcagggcctcttctctctgaggtcttggccctgagggctatatatgaagggccatgcccatggagactgagatctgacccctgcagtaggtctcagggatgaggaccccagcatcagacactctgggttgcttggggcacttccttccccaacagaagcttcagtcccaacccaggtccca

SEQ ID NO: 203010 - DNA, 568 bp, Homo sapiens
catggccagctagtcttttaataataacaataaattatcagcattggagctctggatgtgggaaatgcaaaacagtcctgctgggtcatcatctcaaacctggactcttgggagagataccctgtggatcattacatcttttcaattccttccactcctgtttcctcaccccatttgtggtactcaggcaacagagatgtcctctggctggaaatccagaggatgaggtgggcacccttggactgtccctggttaaatgtcacctcctctccccaccccctttcctggctctctcaacgcacatggggatgtttaatgacattctccttttcccctcgtttaggccttgggagcagtgatattaactcactcagtccacacaactttccatggagattactgtaatctgttattcccgctgtacagatgaggaaactgagtcaaaataaattatttgcccaaagccacacaggaactgctagagctgagactggaactcaaaccatcaggctctcaaatcctccttttagccaccatgccctaatgcaactcgaaacagaaaaaggac

SEQ ID NO: 203011 - DNA, 424 bp, Homo sapiens
gtatgattggcatacttagatgttttttaaaaatttggaatgagggagttggtcatatagactagctcttgtaaatataattataaaattgtatacgtacttgaagtttgccctaatattcaattcaaaatatatatttgaggctgggcatggtagctgacacttgtaatcccagcactttgggaggctgaggcaggaggatcacttgaagccaggagtttgagaccagcctgagcagcatagaccctgcctctgcaaaaataaaagtaattagctgggcatggtggttacatgcatgtagtcccagctacttggggggctgaggtgggagggtcgcttgagcctggaagttcgtggctgcagtgagccacgattgtgccactgtactccagcctaagcaacagagtaagactctgtctcaaaa

SEQ ID NO: 203012 - DNA, 542 bp, Homo sapiens
  misc_feature (1)..(1): n is a, c, g, or t
ncaatgtctctcacctgaactcagatggaactttatgattgcctcaagaaatggccttgcgtgacttccgggacaaggtgataaaggtattatgacttccacctgcttcttgttctctcttgggcctctagtccgtggaaatcgccaccatgctgtgaggaagctcagattagcccaagctgagcaaccgtatggagaggcccctcaaccctcacatcaaaaccctgtggtgctgtcattgtgcccattttatggatcaggggagaaccaattcacacagctagtaagtggcaatcatgtctacagaaaagcacaaagaaaattatcgtggggaattctcaatctagtaggagagatagaacataaactatgaaaaacaacaatggaaggcaatggttaaataaatattaaagcaacatgacaaggcagtctaggataaagtgccaaattggtgccaacagacttcagcagaatggaggttcttatgctgggctggagtgagcagggagacttcctggaggaggcagaatgtgaggtgttca

SEQ ID NO: 203013 - DNA, 425 bp, Homo sapiens
tttaggtcaaatagtaggcacacgttgaaggctttgaatatgtatttcatgtaacccttcagaacagtttcacacaatcacttacacatcagcaatttccctgaactttgccaatttttatcttttctttttaaaatatctttgccattttgataggtgaagaatgaccttctgctggatgtggtggctcacacctgtagtcccagctacttgggaggctgaggcaggagaattgcttgaacccaggaggtggaggttgcagtgagctgagattgcaccattgcactccagcctgggcgacagagagagactgtctcaaaaattaattaattaattaattaattgaggataccattggatgcattcttttcttacacatattgcaactgtcagtatacaaggtttcctgccagggtatttggatg

SEQ ID NO: 203014 - DNA, 349 bp, Homo sapiens
gaataatagcagttattctcaaagcatttccaaaaattgaagcagagggaattctttctaactcattctacaaagccagcataaccttggtaccaaaaccagacaaggacacaacaaaaatataagccaactccctgtaagccaatatccctgatgaatataaacataaaaatcctcaacaaaatactagcaaactgaatccaacaacatatcaaaaagataaatacattatgagcaagtgagatttatcataagaatacaaggatggtttaatatatataaatcaataaatattatacatcatatctatagaatgaagaagaaaaaacatatcatctcaatagatgct

SEQ ID NO: 203015 - DNA, 228 bp, Homo sapiens
caatggcatggtgtgagccccttgaatgcacagcctctaacacctgtccgtttctaacacttctgctcacgatgggcttgcaaagaaaagttgtaatcggctgggcgcggtggctcatgcctgtaatcccagcactttgggaggctgaggcgggtggatcacctgaggtcaggagttcaagaccagcctggccaacatggtgaaaccccgtctcaactaaaaatacaa

SEQ ID NO: 203016 - DNA, 339 bp, Homo sapiens
aagtactgggattacaggtcagagctaccccgcccggcctcatttgttaaaattctaatactctctaaaacagtgaactcattttctttttttaacccattataaatacatgtaaatgttgcatttatgggtagacagaactaaaagaacaaaatttggcctacttttgagatgcaagatttatctggcataatgcattgaacaggttattattgaagtctacaccagtcacttgaacaagcattcatgaaatgtccatgatacccaggacacaagaatgtttccttttagagtatagagccatgcatatcatctcttaattgtttagatgtgtttcga

SEQ ID NO: 203017 - DNA, 487 bp, Homo sapiens
tctaagatgtcattgatatcactgatgctaggctggtatgatgaaactgtgataaaatcctttctttttatcactatttgctttatattaattgagtgttcttttaattttatttacacatagttttttttccattgtgtatcacttgtgtgcatccttaaaaagaaccacataaacaggagactattattctaggtaaggtaactcaggaatggaaaaccaaacattgtatgttctcataagtgggagctaagctatgaggatgcagaggcatgagaatgacacactgggctttggggactcggggaaagatgggaagggtgtgagggatcaaagactacaaatcaggttcagtgtttactgctcgggtgatgggcgcaccaaaatctcacagatcaccactaaagaacctactcatgtaaccaaataccacctgttccccccaaacttatggaaataaaaaaattaaagaaaaatttatacaaaa

SEQ ID NO: 203018 - DNA, 240 bp, Homo sapiens
gcgcccggccgaggtgtctttctatgtcagtggttctcaaccttgaccgcatgttagagtcgttagaggagcttaaaatgtccagactgtgccccagagcagaatccctcgggatagggtcgatggattaggactttttttaagctgataattttatatctatgtaagatcttctgtttcctgaacttcgtgtgaacaggtcaggcgcctgttggacccctggagcctggttaatgggaa

SEQ ID NO: 203019 - DNA, 468 bp, Homo sapiens
gaaggaaggaaggaaagacgggaggaaaccagacagaaaaaataacttacaaaggaacaaaaagtagactaacaggagacttcatgcatgcaaaaataaaggccagaagacaatcaaataatatctatagattgaggagagaaaagtatttccagctaagctatcattcaagaggaagagtaaataaaaacactttcaaggccaggcatggtggctcacacctgtaatctcagcactttgggaggccaaggcaggcggatcacctgaggtcaggagttcgagaccagcctggccaacatggtgaaaccccgtctctactaaaaatacaaaatgtagccaggcgtggtggcgcgtgtctgtaatcccagctactagggaggctgaggcaggagaatcacttgaacccgggaggcgaaggttgcagtgagccaagatcccaccactgcactccagcgagactctgtctca

SEQ ID NO: 203020 - DNA, 401 bp, Homo sapiens
atgttaggaatgatcaaaatggtatgttacatctacttttccaaaaccggaaaaaagtgtaaatgcattagcacaaagtgagagaaatgtatcttgtcatcagcacaagtaaaaattttgccataggtgtcaccaatgtgttctggctgcctggaatgtttccaccgttgttgggtagtcagatgtttgggatgaggaaaacagtctgtccccgttgccagcagccagcccacacctgctgggctacactgccacctacaaaggggctagaccagtggtgtgccccacagcagaggaccctaaaagcaaaagtgatttgctcttgtcgataccatgtcaagggcccagtcagagggccagcggttgaatttgttgaagacaacattcagaatatactaggg

SEQ ID NO: 203021 - DNA, 571 bp, Homo sapiens
gtagattttattgcaagtttcaaaaggggaaaaacagtggagagcctagaactgacagacccggcttttccttctttgaaacacagcaagaaggaaggaaagacttagggaattttacaccattcagccagacagggctgcagagcggaagcaggggggctcccaatctggcccccgccttcaggacaggcctggggccataaggtggccggccagcaacctagcagggccaaagttctcttctctggaaaaagatggatgctgagctgccttcaacctgcccagggaccagactgagagagcgggagagcgttctgtgcgtgtgcgtgtgaatgcgagtgccgcctcctgcctcctgagcccctgagcttgggccgggatgcccacgctgctcccagtttgcccagcgtcatacaactcccagcacctgtgaacagaaagcaggtgctgcacagacagcaagacagccaacccagcgacgacagaaccaaggcagagtgaagaacagatcaggagggagggaacgggggatggagagaagcatttatgtttacagaagaaaatgtgcaag

SEQ ID NO: 203022 - DNA, 493 bp, Homo sapiens
tgaaaagtcacaaatgacttgaaacactataaatgtgtaggtatttcagtatataagtcacaaaacaaaaaaatattcagttcaaattgttctaaagctcaagttcaaatttccctttctagttgacatttgctgaatttctggaatccaccaattgtctttaaattctaaacagggaaaaactacttccttaggagtaaggaaaaaaaaaactgatgaaaattaaatcactttttaaagcaatcacaaaccagccatcaactatcattactagggaaatatgtagttaggattaggaagtgagaactctttgagtgggaccctgaaggcatatatataaatataaactacacaccacaccttggctgtacttgccagctgaggcttcaaaaattacatggtttctaataagtaaattacattcatatttttcccataatcaaaggatatagatcaaagtttggattcacaatcttgttgccttctgaagagg

SEQ ID NO: 203023 - DNA, 387 bp, Homo sapiens
atcttatcatgttgtccaggctggtctccaactcctgacctcaggtgatccgcccacctcggcctcccaaagtgctgggattacaggtatgagccactgggcaccacatggagctgtggtcaatggggtcgggaaaggtggggagcaggggagtgcaggggaggggcagaggcagagagaagatgctgctacccggggaggtaagaggagctggttggtaggaaaccaattccttgaagaggcaaatgtgtgtgtttgtttgtttttgttttcagacagggagacagggttttgctttgtcacccagggcagagtgcagtgtcgcaaacacagctcactacagcctcaaattcctaggctcaagggatcctcctgcctcagcctccc

SEQ ID NO: 203024 - DNA, 471 bp, Homo sapiens
tggtggcgcttactggaagccgcaccgaggcgtgtgctgtattttaaaaatcccatttctggtcaatttctccacgtaatcagacacccgcagagaaactgcatataactctttgcctcaaggcttttagacaagcagagggccaaaacttgcataaaaaaaaaaacatcatcattaatatcagtaccatctaaattaagagcttctaattgttttaagggaaggtggaagctaaaatgaaccggcacatccaacagagggcactatctgtggaggaccaacaaaggaaaacagagcggaaaatatgggcgcacatgtgcctccagttcatgaagttatttggagggaggggggaagaattaaacttacattattgattaaaaaaaaagttgaaaatctgttagagtgaaaacagccatggtaatctacagaagaaaagggagaatggaaagtaaagatcattcatgtctt

SEQ ID NO: 203025 - DNA, 634 bp, Homo sapiens
gcgcccggcctctcatatgtagtttttaatgagagttaccacataagcaaactgggttctaagtggtgaaatttaaggttatgcaacctcagtttcttttaacccctcttcatccctaaccctggtcggatacttgattgacagtagaccattgggatctctgagctcctgtccttctaacctgattgcctctttaaaggattttgaaaaactatgtcccttgcacatttgtattgttttgagacacggtctcactctgcactccagcctggatgacagatggagaccctgtctcaaacaaacacacaaaaagacatgaaaagtaacttattgaaaatgcatctcttggccaggcgtggtggtttacacctgtaatcctagcactttgggaggccaaggcaagcagatcccatgagatcaggaattcgagaccagcctggccaacatggcaaaatcccatctctactaaaaatagaaaacttatctgggtgtggtggcacacacctgtaatcccagctactcgggaggttgaggcaggagaatcacttgaatccaggaggcgaagcttgcagtgagctgatatctgtcgtgccactgcactccagcctgggcgacagagagataatacgtctca

SEQ ID NO: 203026 - DNA, 311 bp, Homo sapiens
cacaagaacaacagaccgataaggcaaaatatacagtacgttagaggagaaaaactaaagcaggaaaatgaaatgttcatgtctttgatgggaagagtagtgggaaagttaggatggccagaaaagtccctgctgagaaagagatttttctttaatatgaagaaacttttatttgtacatcaaagactctaaaaaatgatgatgttaacagagttgatgtcaagacacaaataggtttgaagttagagatgataaatcactttgtttcattgaaccttccctcaattacgttagagagcatccctggtatg

SEQ ID NO: 203027 - DNA, 594 bp, Homo sapiens
tctgtagggacggggtttcgccatgttgcccaggctgttcttgaactcctgggctcgagtgatccacctgcctcagcctcccaatgcgctggggttacaggcaggaaccactgcacccagccccctgacctcatcttttaagcaaggctgacattgctatgcaggcttgttgggtggacttggtgagggcacgcgtgtgaagtggctggcaggtgcctagttctgttaagcacctgccatatgataacctgaggtcccactgtgtggcagatgaaggggaaacagaggtggaaggcacccgtgccacctgggtggagcacagtggaaggcctggtgttggctctgggcgtcctcctggcaccagcctgaccactctgcctctcttactaacccatctctccctcacgtgtcccctgggaggtgacttctcaaagcgctaacaggctccgctgggtgagtccacagctgtccctcttgtgatcatgggactcagcagcactgaccacgtccttccacgctctctcacctgcccccaactgggggcccatgacttggcattagcatgttccaaataaagtgatactggcaacaaaa

SEQ ID NO: 203028 - DNA, 414 bp, Homo sapiens
tcaccaaagggacctgttacctggaccaggtagaagtgagctactgcagtgggtactgcccatccagcacccatgtcatgccagaggagccatacctgcagagccagtgtgactgctgcagctaccgtctagacccggagagccctgtgcggatcctgaacctgcgctgtctgggtggccacacagagcccgtggtgctgccggtcatccacagctgccagtgcagctcctgccagggaggtgacttctcaaagcgctaacaggctccgctgggtgagtccacagctgtccctcttgtgatcatgggactcagcagcactgaccacgtccttccacgctctctcacctgcccccaactgggggcccatgacttggcattagcatgttccaaataaagtgatactggcaacaaaa

SEQ ID NO: 203029 - DNA, 341 bp, Homo sapiens
actggctgtaatgcagtttactcagagtgccatttttttttgttgaaatgaaatttactctagctttgagaatttgagagaccctcttaagaaaataccacagctggaaatttgagacctaaaagtaatacaatttgagtatctcatatctgaaatgcttgggaccagaagtgttttggattttggattttttcagactttggaatatttgcgtttacataatgagatctcttggggatgggacccaagtctaaacacgaaattcattaatgttttatatacgccttatacacatagccatttaggtaacagccatttaggtaacagccatttagggggta

SEQ ID NO: 203030 - DNA, 545 bp, Homo sapiens
tcctgagttgaaatgtgtttgttcagtagaaatggagttggcctattggccaggctgtcttgaactcctgacctcaggtgatccgccctcctcggtctaccaaagtgctgggattataggcgtgagccaccatgcccagtggcccagccagcccattttttaaaaattatcactttttgtagagatggggtcttgctatgttgcccaggctcgtctcaaactcctgacctcaaagcaatccacctgtctcagcctcccgatgtgctgggattacaggtgtgagccactgcactgtaccgggccttaaatggatttttaaaccaaagatttatgaatgcaaatgaattagtagcatgtatgctgttctttttgaggaggggaccttttttttttaattaatttttgttttttgagatggagtctcgctctgtcgcccaggctggatgtgcagtggcgccatctcggcccactgcaagctctgcctcccgggttcacgccattctcctgactcagtctcccgagtagctaggattgcaggcacgcgc

SEQ ID NO: 203031 - DNA, 1325 bp, Homo sapiens
gggtctccgcctgagggccccggagcagtgcgcgtatcccgggagcggatcttgatgctagctctgtgtgcagtgtaattttatgaagagtcccgccccctccatacgggaggaaacgtgtgtccctggggccctcagccaagcctccactatcttttggcccagacggatttcccaggtcacaagtggctggagacttcctcttgaaaaacatttgccgtcgtttttccctggcagagcccctttgaccctggctaacaaggacagcctgacttggatcccactatgcaggaaggaaggcgactcttccccgcacctcttgctacgattaggacttgcgacttggtgaaaacaggaatcaaaacttgggcctatttctcctgaggtctgcttgcctagaacaattcgtaacgatgaatcttattaaaaagagaaagtcctccccgactttatctttttccgcccagaatccgataaggaagacttgttctggccccctcagctctctgacctcatctaccagaggagagagtgggatcctctaacactcgagccgtcatcccagcactaggggacagtgaccagtgtggctcccgtggccagaacccttctgaagtttgggttgccctgtggtcttcgccttcaaagcaggccgccacttgaatccttctggaacggacagtgttgctgtaaacgccgcggaatagtatcttctaagtattcgtagcttctttcttgagggatctcgggaacgttccgtgtattaaccactaacgtattccaaagttaacttcgtggtaaagtcgctggggaaaaaaataactgctccagttccacaggtgattgaaacaaaagtgatctgtttcccaaacttccttgatggtaaagaatgacttggggtactaattaaaaataaaaataattgcgtcatttccaacctactaaatcggagtctttaagggcaggtcctgggaagccatccatgtaatgggggtcctaagtgggctcttatcggcgagggcggggactcagcgagagggctggcagcgatgggacaaaccccagacggctgcgcggatgcgtttgttcctggagcttgcgagcacttgcaatgcatggacacctccacagggtggtggcctgccaccacgagagcaccagctccgccagcgtcctctccagaggacactttagagcagaaagaaacggacagttcagtcttcccctcagcttgaaggcagcattcttttgcttctctttgagtcaggtaattgttttgtcttccttccactcagtcagcaggtattaaacagcaaccgcattgc

SEQ ID NO: 203032 - DNA, 451 bp, Homo sapiens
attctaaattgacttcacttccacttcaataatacagtgggaaattatagttaataatttattatatatttcaaagtagctcgaagagaagatctgtaatgctaccaacataaagataaatgtttgagatgatggatatcccaattatccccatttgatcattatacatcatataaaggtatcatatatcacatgtatctcaaaaacatgtataactatatcaataaaaatttaaaaaataataaaacagctctgctgaagtcacctccaagagacaacaatcaataaagattatccagtcctcaacttacctggcacacctatgaaatactttctacctcaggtttccatgacatacaacctctttgttttcttccaatctctcaggttagtccttctcagccttgcttgctcatgtagccctctctaatcaatcactgaaagttgacct

SEQ ID NO: 203033 - DNA, 581 bp, Homo sapiens
gctccgcctcccaggttcacaccattctcctgcctcagcctcccaagtagctgggactacaggcgcccgcacgcccggctaattttttatttttagtagagacggggtttcaccctgttagccaggatggtctcgatctcctgacctcatgatccgcccgcctcggccccccaaagtgctgggattacaggcgtgagccaccgcgcccagcctacaaacaattttgaatctgttcctatttagaaattttccaatgcaaatattgctaaatgatctacttttttctttttaaagaaatggggtttcgttacgttgcctaggctggtctcaaatttctgggctaaagtgatcctcctgccttagcatcctgagtacctagaactacaggttactgattttttatttcccttgaaaactattaataaccttatgggagagttcatttgattctattgaaagaaaattcaccaagttttagaagtgattataattccccttgcaaacaaaacccctattatctggaatgttttaattgccagttacatccctttagatgttaacttcggataagaacaaagttc

SEQ ID NO: 203034 - DNA, 254 bp, Homo sapiens
gaaaaatcagagctggggttttgtgcaaaataccaccttactacgaaaatctcaaagacaagcccacatcaagcaaacagtaacaccagtccccatgtgcccatcatgcgctttcaatgagtatcaactctcggccaggcttgtttcatttactgtattaattgttgcaaatctcagatatcaagtcatttgatccagaaatatctcagtgtgaattctctaaaagataaggatcctttaaaaaaaaaaaaaaa

SEQ ID NO: 203035 - DNA, 288 bp, Homo sapiens
aaggatcccccgtgggtccctgcatgctttctgctgcttccccctagctctctgggtagttactagaaactgcacccacttattttcattttatatattaatgttgagggaaaataaaaagttttctgtgtgcaaccccttcattgaatcagggcagttactcatttatgatgtaattgaatttccttccggattctgttctggctcattgatctgtctgtctcttccttcatcagggcccacccagctttaattaccaatttctgttacttttcattatccaaacat

SEQ ID NO: 203036 - DNA, 315 bp, Homo sapiens
tggtcttgaactcctggcttcaggtgatctgcccgactcggcctcccaaagagctgggattacaggtgtgagccaccatgtccggccagatttttgtattttttgtagaagacggggttttgccatgttgcccaggctggtcttgagctcacagactcaaacgatcctcccacttcagcctcccaaagtgctgggcttacaggcataagccaccatgcctggccagattctaattaaaagttgagtgcttactatgagtcctaaattaggatatagaactggcattgatgtagtgagaagaatagatacaaaata

SEQ ID NO: 203037 - DNA, 673 bp, Homo sapiens
agcaggggccagcaaactttctgtgaaaaactagatatttttggctttgcagggcatccagtctattgtaggtactcacctctgtggctgtagcacaaacacagccacaggcaatacgtaaacaaatggtcatgcctgttccagtaaaactttgttgacaaaccccggcctagtgtgtgaccctgtttatgttatgctatcatctatgtgtgctgggtgtgcagggattgaacctctggtaagaaacacaagaaactagatatagtgacctccagagagaaaatctgggtgtctgggggaaacaggaagatttccttttttctggttatccttaagtatctttggaatcatgtattatgtgtttattacctatcaaaagatgaaaaagacaggacttctataagtgatgttttcacagacagcttcctgtgatgatgtcatcctctcactttatttttattttttagagacagggtcccactttattgtccaggccggagtgcagtggtgcaatcatggctcaactatagcctccacctcttgcctcagtctcccaagtagctgggactacaggcgtgcaccaccacacctggctaatttttgtatttttagtagagatggggtttcactatgttgcccaggctggtctccaactcctgggctcaagtgatcc

SEQ ID NO: 203038 - DNA, 434 bp, Homo sapiens
gaagaatggggagttgttgtttaatgtatacagagattcagtttgggaagatgaaataattctggagatggatggtgatgatggttgcccaacagtgtgaatgtacttcatgccactgaactgtgcacttaaaatggtaaagatggtaccttttgtgttatatgttatactcggttgctcccaccttttggctacagcaaataatgttgctatgaacacggaaatagaaatatctcttccagacccagctttcaattattttggatatatactccacaagtagagttgctgggtcctatggtgaaattgtgttatgtttatttcattgcaattaaaattacctgagcaagaaaagaagtgaaagtgtgatgaaaatatgtttgaattatttagaatgtcacttaaaatcatgattgtcttcagcatgctctggg

SEQ ID NO: 203039 - DNA, 194 bp, Homo sapiens
caaaaaaaagtgcaattatgagtcaaaggatgaggacatcttccaagctcttgattttgccagctgcttcccaaaaggattgtactggtttgcctctcccaccagtgacgtatgaaagctccagttcatttcaccatagcttccccagcaccaagtattataatttttaaagatccttgccaatagagtaggtt

SEQ ID NO: 203040 - DNA, 306 bp, Homo sapiens
cttttctaacccatctgccttcctcactcctctttcttccttggttctaccttactatcttgatccttaactaaagatactttcccaagagtcacttttgtgcactataaacttctgtttacacaagagaagcaggggtggggagggaataagaagaaagacaaagaaggaagaagaaatcttttaactctaaacaacttatcagactttttccacttggacatcccaacatcatcttaaattcaccaagtaaaaattaagtttctggcactgttcaaaaattctctctttaactttccttttcat

SEQ ID NO: 203041 - DNA, 392 bp, Homo sapiens
aatagaaaccgacctggattactccggtctgaactcagatcacgtaggactttaatctgttgaacaaacgaacctttaatagcggctgcgttaggtctacctggccaggtagacctaactcccttggtgtgagctgccaccattcacatgcagaggactcacctgtgtttcctgcgggttgggggtaatggtggcatgacagagggcttgaggactgacctagctgcttctccggaattggacgcctgctgactacctgcgtgtatccagatggccattggcctgtgggggtgcaggatggaggccctgcccacatggagctcactgtcctgggtgggagtgaaataaactctaggtggcagaaggaagtggtgcgttggattatcacctgg

SEQ ID NO: 203042 - DNA, 364 bp, Homo sapiens
agtggctaccatttgaattgagcctggtggaatcagcgggattagtcagatgtggctggagttcagcacagattgaagctggctagggcacaaagaaatgtggttgaaaatctaggctttgactaacaatatgtttatgtatataaaatgtgttatataagttttgaaacaatgtatttgctcccctcctaggttttcttttacttcaattccaaaataatatatttgttaaaactctgaaaaggcccagatagtaatgcactttatgtgatgcacataacacctaatttaggttcagtttagtcaacaaatcattatcctcaagcactgagaaatttctcacttgcagatgaggcacgagggg

SEQ ID NO: 203043 - DNA, 678 bp, Homo sapiens
cccccaaaataacccgagctcttgctctgagaaagtcctataattctttctgaaaaaccctctcctctgacactctctcagaagaccccgccttccccatatactcttttggagactttactcagctttctcctcaactgagatctctgaagagtttttcctaaaaacatccctctgtcatcccactccaggaccagtctcagaagaccacaccttcctcagacactttttagagaattttctcccaaattgccctccatcagccacccactcccagcgcttcctgagacttcctcagaactttccctcagattccacttctgacatccccaagaaacattatttaggaccctatcagatttacccactaactttagaattgctatttacaccctctcatttccccattctctttcctctgaagtcaactcagagacctttctcagggggcccccttttcccattatcccttcagaggtccccaacattctccagactcgttgcccaagagcctctatgtttccttgtaaagattcttgagagacacctttccccgcccccttgaaatcccagtgctccgagatctttctttcagaccatttttcttaggtgccatgctcatagacccctcttcccttcagagatcaagagacccttaacaccctccttagagactta

SEQ ID NO: 203044 - DNA, 276 bp, Homo sapiens
tagccgacttctcccctatttctacattatatctaacattatcacatagtggtatacaaacatccatcaatccttcttactgctacatattactaggagatgaactatgtatttgccacagatataaatttacaaaatattaaattcctacccatatggtttacattttacatgcccagaagcaacgtatgattttccataattccgaacatgttgccaaaaaaaaaaaaatgttgtcaaacttctggacttttgctagtctaatagtagagaaac

SEQ ID NO: 203045 - DNA, 169 bp, Homo sapiens
ccacccagataacctcaaataatctctccatctcaacatcctaatgtagtcacatctgcaatgtactttttgccatataaagtaacatgttcacaagtgtcaggaattaggacacgcacatctttagggggatatctttgggggtacatctttcgggggacattgttca

SEQ ID NO: 203046 - DNA, 559 bp, Homo sapiens
ttgtgaggctctgattagcactcagtgaatctacattttacatgtaaaaagaaaggagtagaggaaaagtcaattatgcattcatctcatgctcagtacatctacattttacataagataaagtaagcatgtgaaattacagctatttgggaacaaatggaaggcagtttttggatgactcagttcccaagcttaatttcccttttgccatagtgagtttggggtcctgagagtctattttttattcacagttctcatgactcccttcttgagttcagtaatttactggaatgactcacagaacttagaaaagtgctttgcttactattaccagtttattgtaaaggatacaactcaggaagagcctaatggaagacatgcataaggtaagatatggggtatatttggcacagagcttccatgccttttctgggtgctccatctgatcagtacatcaatgtattcccaacccagaagctcccgagccccatcatttagggattttaatggaggttttatcgtataggaatgatttatgtaatcattggccactggtaat

SEQ ID NO: 203047 - DNA, 713 bp, Homo sapiens
cggagatcacgccactgcactccagcccgggtgacagagcgagactccgtctcaaaaaaaaaaagaaacaagaattttagaatatagatagtttactgagtgtccccatcttgcttcatttcatttttgtaaacataatcagcttctgtcagacttaggctcaagacttatagacagaggaaagtatctaacacagtgagttttgttttctaacacagtgattttctaaagtatctgtggtgacaaaggaaattatctccagtctagttcagaatagaaatgatcataataatcatctatcaaacctcctcattttatataacaggaaaatgagttccagggtctgagagtttagtagtttaaccaggattaaaattaaatcctcttgattttcagtacagtactcttaccatctcacctggtgacctcttttactctgagagcaggagctcctcaggaatgttttacatatgtaatgctcttttccccttagcttctctcaaatcatttaaatttctaaacaaccactaaatgcttacctcttttcaaaatctttctagattgttcagttgctctaaactggattggtgactcccaaggggctatccccaatccaactaattaagttttccattccaaaactgtatatgcccctgacctacatttgatacatatgtccatggccaattcatgtcttgatttgatgatttgat

SEQ ID NO: 203048 - DNA, 692 bp, Homo sapiens
tcgagtcggtaccttccatttgtcacacaggctggagtgcagaggcgcaatctcagctcactgcaacctccgcccactacaacctccgcctcccaggttcaagtgattctcctgcctcagccgccacagtagttgagattaaaggcatgtgcaaccacgcctggctaatttttgcatttttagtagaaacggggtttcgccatgttgcccaggctggtctcaaactcctggcctcaagtgatccacacactcagcctcccgagtagctgggattataggcatggaccaccatgtccggctaatttttgtatttttagcagagatggggtttcgccatgttggccaggctggtcttgaactcctggcctcatatgatccacccgctgcagcctcccaaagtgctgggattacaagagtgagccactgcacccagcctggctaattttctttttaatggccagatacttgattacacctggttacttgttagaccaataaaattcaagcttacttgaaatgaaagctaatttggtttattaagggaggaaattcttaattagcatagaatgccagttacatttataaaactttatttttttctggttgcagttagagtttggttcttctgtaaaacatctaaagcaaatgggtatgttttgtgacttattttcaggagcgtgtatatttctagt

SEQ ID NO: 203049 - DNA, 274 bp, Homo sapiens
gtctatccctgtgcccatgccacattgtcttagttactatagctttataattagggtgaccttgcttcaagtttactgtggaccagtcgccatctctattttagcatttgtctcatttgtcttttttttttttttttggaaatggaccctcgctctgcccccggcctggggaccagttgggttatttggactaattgaagcctcaacctgtgggaatcagggaattctcttgcctaaccctccaagggggctgagattccggcccccccccacc

SEQ ID NO: 203050 - DNA, 469 bp, Homo sapiens
agttattgaatcttctctttctcttcctcaatctcataacccccatgaacatccttttggttgtcaagatctattaattctacgcttaagtcttgcttctttctctctgctcttttctacccttaccctccctgtcttagcttaggccctacatattgtgtcttttaatgaactgatgatggcctatgggtcagttatgtcataccatatttgtctccttggtgtttagtgcttgggatatagtatcattatcgaattgaaacattttaaaattccattgtaaaggagaaacggtcttgtatatatgactaaatatatgtgcatctgtgcctacattcactataatcattatgacttagataagatgtaaaatagatttaatgactaaaatatatgaacaatatatggcaatttatatgtgaattactgtttgaagtatatgtgaaaatatcagtgggacattttaaaa

SEQ ID NO: 203051 - DNA, 502 bp, Homo sapiens
atttatcctaaggaaatatcgtggatacatgcaaaatgttttacaaattgtcacagcattggctacaatgtttaaaatatttaaacaaaaatgcaatattggactggttaaataaattcacatccatatgatgaaataatacttagcagctagttaaaattttgcatgagacatgtagggcatggagtaaagtttctgatttttttaatatatacaagctgggcatggtggatcacgcctgtaatcctagcactttgggaggctgaggcgggtggatcacctggggtcaggtcagtgtttttgaaacactgtcctccccggcttcaaggacgcctgctcccttgctgaccacttctccctgcccacttctaaaacatggatgtctgctgggcctgtccacagtcccgttctccctcttagatatatatacacacacatatatacacttagtgtatatatatatatatatatatatatatatatatatatatatatatacaca

SEQ ID NO: 203052 - DNA, 203 bp, Homo sapiens
ataaaaaaaaaaaaaaaaaaaaaaaaaaacacattaaaaaaaaaaaaaacaacaaaacaaagcaaacatggaaatgtttgttattttaattgttatgatggtttcatggctgtttgcatgtgtcaaaactcatcaaatttgtgtacgttaaatatgtgaaacttattgtatgctggttacacctcaataaagctgttaaattt

SEQ ID NO: 203053 - DNA, 416 bp, Homo sapiens
taaaattatgtccttcgcagcaacatagatgcagctgaggccattatcttaagcaaattaacacaggaacagaaaaccaaataccacatgttctcacttataagtgggagttaaacactgggtactcatggacacacagatgaaaacaatagatgttggggactactagagggaggagtaagtggggagagagaggcaagggttgaaaaactaactattgagcactatgctcagcaccttggtgacaggatcaatcatactccaaacctcagcatcatggaacatacccaggtaacaaaccagcacatgtacctcctgaatctaaaacaacagatgaaattatattttaaaaagaacacgaagcacaacaaattattttgataggatatagactttttgtttcccaggcagatccc

SEQ ID NO: 203054 - DNA, 308 bp, Homo sapiens
tggaaccagcttctagccagctcagggctgctgcagcaaaggaagtttaaaaaggaaacaaaacaacaacaacaacaacaaaacccttactgtgcaggtaaaaaactggttaggagctccaaggagaaaaaaaaaataaagtagcaatgttttcatgaacctacaagatagatcagcagtggctccgggtgtggtggcgcatgcctttaatcctagcacttgggaggcagaggcaggcggatttctgagttcaaggccagcctggtctacagagtgagttccaggacacccagggctacacagagaaa

SEQ ID NO: 203055 - DNA, 318 bp, Homo sapiens
tagcaatgctaacactagaacaccttttttttttcttatgcagtaagaagctttaataataatttcagggtatgggcaaacaagaggtatgagcaaagcagacagtctggcacatcaagggcagctccatgggtcttttctccccacctcatacatgtattctctgacccagaagctggaacgctatattctgaccccagcttcaaggctttttccattttgatgaagtgagtccctccctttaagtcttaaatcttgtataatactcaatgttacctcatctagtgtgttcagtactgtggtttaacttcagatcta

SEQ ID NO: 203056 - DNA, 559 bp, Homo sapiens
cagtctgcccgcctcggtctcccaaagtgctggaattacaggcgtgagtcaccgcgcccagccaaaaagccattattctaattaatgcatttgtgaacctcaacataaaaaaatccagttatataatcacaagagagttatccctttcaaatgtatacctacaaaagatagaaaaatgatcagaaaacttgtatctgtcgattgaaataaattatttttatgcctgacttgaagccattgttttcactacaaataacagttaaccagcaaagtggtccacacctgtttccagaaaacagtccttaagactcaaagactagatgttttcccctctgtgatttttaactcctgagagacatcttttatttcaacattgagacattcaaaacatgttctgtctcctaaaataaaatctcattcatttcttaaaaggcaaatagcttgataagcacactttaggaacaccaggttttacatccaaataactaaaactatccctagatttagtgttcagcctgctgctgcaattaaaaaaaaattgttttttaagttacatttg

SEQ ID NO: 203057 - DNA, 1475 bp, Homo sapiens
aagaaaagcagagacgattggattacagcaattgctcttataactcctctccgcccaccccctcgatgagaagctggtttgaaggactgagtatcaaatccctactgagctctgaggttccaggtgtggatggagtgtggggcccatgtgtgtgtcagtgtgtgtgggtgtgattgtgtgagcaactgggtgtgtgaggttcaggcccagtcggcttgtccagacgccaggcctgagatgccctgggggtgctaagaggggtagagagaagccaaaggaacacaggctttgaaacgaggcagaattgagttggagtcccaaccccaccaacctcacctctcttcactcttcaggcagcgtagaaaacaatgcctgccttttgccaggcatcctcatggaagtgacatcgtctttaaacctgtgtggcaatccctgacgcaccaccgtgatgcccagggaagacagggtgacctggaaacccaactacttccttaagatcatccagctattggatgattatctgaaatgtttcatcgtgggagcagacaatgtgaactccaagcagatgcagcagatccgcatgtccctctgcggcaaggccgtggtgctgatgggcaagaacgccatgacgcgcaaggccatccgagggcacctggaaaacagcccagctctggagaaactgctgcctcgcatctgggagaatgtgggctttgtgttcaccaaggaggacctcactgagatcagggacctgctgctggccaataaggtgccagctgccacccgtgctggtgccattaccccatgtgaagtcactgtgccagcccagaatactggtctggaccccgagaagacctcctttttccaggctttaggtatcatcactaaaatctccaggggcgccattgaaatcctgagtgatgcgcagctgatcaagacgggagacaaagtgggagccagtgaagccacgctgctgaccatgctcaacatctcccccttctcctctgggctggtcatccagcaggtgttcgacaacggcagcatctacaaccctgaagtgcttgacatcacagaggaaactctgtattctcgcttcctggagggtgtccgcaatgttgccggtgtctgtccgcagatccactacccaactgttgcatcagtgccccattctatcatcgacgggtacaaacgagtcctggccttgtctgtggagactgatgacaacttcctgcttgctgaaaaggtcaaggccttcttggctgatccatctgcctttgtggctgcagcccctgtggctgctgccaccacagctgctcctgctgctgctgctgcagccccagctaaggatgaagccaaggaagagtcggagggaggagtcagacgaggatatgggattgggtctctttgactaatcaccaaaaagcaaccaacttagccagctttatttgcaaaacaaggaaataaaggcttacttcttt

SEQ ID NO: 203058 - DNA, 503 bp, Homo sapiens
gtaccggaccggacttctggtgtctgtgtgttgtgtaagcaagttagtgagtggtaactagtagttttttaaaaaaattaaacagaatacaacaaaatatggctgggtacagtggctcactccttgtaatcctagcactttgggaggccaagatgggaagattgcttgagttcaggaattcgagactagcctgggctatgtagtgagacctcaactctataaaataataataaacaaaatatcaatgcattgcacatagtaagtcttgctttttgatccttttgttttaattatgttcaatctctcaatatgaacataagtatggttttactgtaaaacatacttctcacatttggagttgcaaagaagtggcacttctgttctagggtccctcacagcccctatctctgcaaggaaatgaaggatcaattttccaaagattacaaagcaaatcagcttcctccctaggagcctcaactacaccagaagaaagaaaagcccca

SEQ ID NO: 203059 - DNA, 438 bp, Homo sapiens
gtgaactcactctccaacagatggtgctagctttcctctagtgagagctgccatggcctatcctttcttaaaacaaaccatgaagagtgatgtggggatttgtatagaacacattgtaaacatttttctattacctatgtactttggtttataagacatcatcattccacacaatcagttggagaatctatgattgtatccttttatgaatttgatctcttctgctatagccataagaaatcatgtttttaaaaaggtcatttgtgtgataataatgtaactaggagggatcaaactaactttttcagaaaagtcaacttagaaggcctgtcacttttcctgtatattccctaaaatgatgttgggtattgaaaatcttgggggggtgtttctttctaattaatttgccatttgcttagtgttgatctattgtatgtg

SEQ ID NO: 203060 - DNA, 571 bp, Homo sapiens
gctacactgacgaacgtggtatgactactacatccattgctttagttaccacctaaacctggaagcccagctcagatttctctgtactaagctcatgacttatttgacctagtgtctacttgatatccaccttgatttccacaagcacctcaaaataaagatgccctcttccatctccaaacttgattctcctccagtgttacttattttagtgagtggtagcatcatccagttgctcaagtagaaaacatggatattgtccttgatttatccttcgccttcagcccccttcccccatttagccaaccattggcttccattaattctattacagtgagagaaattgtatccccccagaaagatatgtgaaagtcccagcccccactgcttatgaatgtgatcttacttagggtctttgtagatgtaattcaggatcttgagaggtgattatcccggattagggagggccctaaatccaatgactgatgtccttaaacatgaaaggagagggagatgtgagacaaagacacaggggagaatgccatgtgaagatccctataaggctggagag

SEQ ID NO: 203061 - DNA, 407 bp, Homo sapiens
cagcccacctaactgcagatctcaaatcgcagaactgctcagccagaaaacacatcttttgacccacctgaccacaaaccatcacagtacccagccaggagctccgcctggtggcagagcccagccagtggcctcagcaggaaggggcccagagagcaaacccacccaacattagaaaaaaggcaaccagaaaaatccacaacaagctctgcctgccctgagtcatcatcaggcagcccttccaaaatccaaggctatactaactagagaaggcctatccctgctgaacacctataaagaccagaagagggggctgtctgttatgacttttgatatatatattgacagatttgctttgacatatttttacaaatttgtatatgcccttaaaaatgtatgaaagcttc

SEQ ID NO: 203062 - DNA, 589 bp, Homo sapiens
ctgcctatatcaattatttaaaattctgccttcagtctctctcagtgccttactggaactcagagattgggagctatacccctctgaattgcattttttgtgggaatcttccttagatttgtcaatagctgaatgtgatattgtaatataagaaatatatatttggtctttgccctcagttcctgacatagagctcctaaaatcctagtagataggggtgttaggtgaatcttttctcatagttggtctttgaccccagttcctaacacacaattcttaagactgtaatttcctcagtgctaggagcatctgacacagagcccctaaatcccttggaatttcctgggtaatagaagcatcttttgttctaatgaggctcttgatgggctcctggatagcctcaggatgggggctggttgccaggggaaccaatcttgtgattagaaagctggaactttcagccctagcccccaaactccagggaagcgagaggggctgaaggttgagttgattaccaatggccaatgatgtaatcaccaatggccagtgatgtaccatgtccatgtaatgaagcctccataaaaaccca

SEQ ID NO: 203063 - DNA, 279 bp, Homo sapiens
tgttagtgaaaagagccctggactagccaggaggtcagacaacctgagtgctagtctcgctctgtcattaatgaaagcttctatttgttgagcatttatcttatacatgtattctcctctaactgtttttttgtttatttgtttttgagacaagagtttcgctctattgcctgggctggagtgcaatgtctcgatcttggctcaccgcaacctctgcctcctgggttcaggcaattctcctgccccagcctcctgagtagctgggattacaggtgcctg

SEQ ID NO: 203064 - DNA, 475 bp, Homo sapiens
attgaatgcaaataagattttagcttccatctgcctttgtcacacaatagaagaaagaatatatgaatttggtattattatggccaaagcaaaatgagactatcaagttcctaaaatagaccacagaatttagaagccatcctatcctgcctgggaaatcatgtcttcattttggtggaaagctcgtcagtttagtaggctccgaaatagaatagcagttgtcactcaaagattttcagattatcttcacctctttggcctcagttcccttatctataaagtgtaaggtaggagacttagctgttctctaagaaacattttagctcaaattttttcttctaggaaaatctatgaaagggctccaagtcagaataaaggtcagagtaaaaccaacatttgcagaataagtgttctctaaattataggctatgaattattctgcaaaaatatatttagtagtttgggtcattgctgt

SEQ ID NO: 203065 - DNA, 431 bp, Homo sapiens
agctaacatttattgagtctttacttttgtgttaggcattgttcttagcactttacctaacaaccctatgaagtcaataatattatatcccagatgaggtgatcaagacatagagaaggtaagccacttatacaggttacacagcttgtaagtggagaggacagaatctggatccaggcaatctgtccccagtgcctgagctcttcttaactactacccatactacttcaggccactggaaatgacagaatagaggagcagttttggaagtcaggcagacagctctactatttattgctgtaaccgtaggaccaattcaaaccaagtaatcactgcttaagttacaggtagtgcagagccaaagttacctggcatgctcaggagaaaagctttagcagcctaattgttagcatcaccagcctggctgacca

SEQ ID NO: 203066 - DNA, 678 bp, Homo sapiens
tatgttgctctagcacagtacagtcatcctatttctaggtatttattcaataaaaatgaaaatgtgtctacatgaagacctgtatgcaaatgtctatatagtagctttattcataacagtataaaactatacacaaccgaagtatccatcaactggtaaatggacaaacaaaatgtaatacatgaatgcacatggaatactattcagcagttaaaaaaaagaaggaacagttgatacatgcaacaatgtgaaagacttccaaaagcattatgctaagtgaaagtttccagataatttaaagatactgaatgattccatttatatgatgttctggaaaagataaaactatagggacagaaatcagatcagtggttacctggggctgggggaggaaatctactacataagggctgcgggcatttcgtgaggtgatggaactattctagatctttggtaagggtaaattttactgcatataaattataaatgtgacttttaaaacaaattaattttcttaaaaagtacatgttatggcattattaggatgaaacagagggagtgtccccaaaatgaataaatattacaggcaaaatatactaagaagaatgtgtacatttctcgttttgatacttgactcattaaggaataatttgcagaattggcataaattaatataga

SEQ ID NO: 203067 - DNA, 236 bp, Homo sapiens
agtattttgctcttttccttagtcttatctgagtggcaggttttattttttaaaatctagatgtcaagttgaatgtgtaatttttttatacactgaatctgaaatatattgggtctactccttgccgtaattccttttagttttcagtggtgaaaaaggcaaaatttgtaatatagctattgctattccttattctgaaattcctgttcatcctaggaaatttcagcaaatgcaga

SEQ ID NO: 203068 - DNA, 289 bp, Homo sapiens
atcttgggtttgggatgctgaacttgtatttgcatgtgtggaaagagatcaggagtcaaggcaggagtcaggaaatgtggcttctattcttggctaacttgatggtgtagggcagatcacttcactagcctaagctgcagtttgccactgttcactcctgagggtagctggagaggcttgagaacaaattttaacacactacatagtgcagacaccttttcatctgaatttttcctttgaaggatgagtcattcttatgaaacaattttcttttttttttttttttgag

SEQ ID NO: 203069 - DNA, 422 bp, Homo sapiens
cgcggccatgagcacagcttccatcaagtcggcggtggctccccatgaaggtgcagcaggggtgggggttccagctgctggcgggactatttcttgagtgctgtttggatgaatattcacttaatattgtttgctatacgatgcgtttttgtgtgcatttctctattatatctatgaggttaaaaaaagcaagaatgaatctcagttgtgtttcaccagtgtgtgtgtatgtgtccttgtgtgtgggaagacattctctgaggcagcggttatggactgaatgtgtctcattgaactcagtgtgtagaaggccaaacccccaggggatggtgctgggaggagaggcctttgggccgtgattgagttagatcacccgtgagggtggggctcccacgatgggataggtggcctttgggcggtga

SEQ ID NO: 203070 - DNA, 367 bp, Homo sapiens
gaattgctggatcataaaataggtgaatgtttaactctggaaaacaatgtggcattacttaataacatggttgtgccaaatacactttcacccgccctatgtaagagatcctgccaaatgacctcccaacactcagtattattcttgatatttgccagttgaacaagtgtaaaattatatttcattgtggtcttaatttgtattttcatgtttaagaatgaagttggcatctcttcacatgttaattagctatacatatatataaaatatattttactgtgtaattcctggtcatgtcttttgcctatttttctatttggttctttgtcctttcgtacttatttggtacaggttctttatatatgtt

SEQ ID NO: 203071 - DNA, 333 bp, Homo sapiens
gataacagtcttgggctgactcagatttctataagtatcccccatattttgggaattcccaggccgtcttctttctttctcaagcttgtcttcctttgtcctggaaacatcttcatttgttacctctgttttggagtaaatcttccttctcacccctatcacacacagaagaaactcagcttgttgaaggatttttatcacaaccaacctttctaggggtggagaatgtgttccagtgaatcttctccctttacacaatcttatggctctctccttgctgttccttgtcttccgcaccttctctccctaatcgtcttctgggagcccccaact

SEQ ID NO: 203072 - DNA, 415 bp, Homo sapiens
atcgtgcttagttgtgcttgctcatcgtcctcactgtgtcctgtgccgggatatgagcacaagaatgagttccccaacccacccacaggaacagaagctcctgtgctgggaatcctttcagacctcagcccacctatttatctcttcacccttaaaataccctttgttagctaggcatggtggcggaatgtcgtgtagtcccagctacctgaaaggttgagacacgaggatcgctatgagatctccccagtaattgggaccacaggtgtgcacctgaccaccatgcccggctaattttgtatttttagtagagatggggtttctccgtgttggtcaggctggtctcaaactcctgacctcaggtgatccacccgccttggcctcccaaagtgctaggattacaggtgtgagccac

SEQ ID NO: 203073 - DNA, 162 bp, Homo sapiens
tttatttctgggctctctgttctgttggtgtatgtctttgtttttatgctagtatcatattgttttgattactgtagctttgtaatatagcttgaaattaggaagtatgatgcctccagttgttttttttgtttgttttttctcaagattgcttaggctatt

SEQ ID NO: 203074 - DNA, 591 bp, Homo sapiens
attttattgaggatttttgcatcaatgttcatcaaggatattggtctaaaattctctcttttggttgtgtctctgcccggctttggtatcaggatgatgctggcctcataaaatgagttagggaggattccctctttttctattgattggaatagtttcggaaggaatggtaacagttcctccttgtatctctggtagaattcggctgtgaatccatctggtcctggactctttttggatggtaagctattggttattgccacaatttcagagcctgttattggtctattcagagactcaacttcttcctggtttagtcttgggaggttgtatgtgtcgaggaatttatccatttcttctagattttctagtttatttgcgtagaggtgtttgtagtattctctgatggtagtttgtatttctgtgggatcggtggtgatatcccctttatcattttttattgaaaatgatcatttttattgaaaatgataaaggagatattaacctgttaactttcagccactctgttatcacagtgggaacctctccactgtcacctaataattcatcacagtgggaacctcttcactg

SEQ ID NO: 203075 - DNA, 1372 bp, Homo sapiens
cttccacatcgtggaagctttgttctttcgctctttgcaataaatcttgctactgctcactctttgggtccacgctgcttttatgagctgtaacactcaccgcgaagatctgcagcttcactcccgagccagcgagaccacgaacccaccagaaggaagaaactccgaacacatctgaacatcagaagggcagactccagacacgccaccttaagagctgtaacactcaccgcgagggtccacggcttcattcttgaagtcagtgagaccaagaacccaccaattccggacacaatttcttggctctcagtggcttccatggaagttctgcaatcaaccagcaggagaaccgcttaaacccaggaggcggaggttgcagtgagccaagaatgcatcactgcactccagcctggaagacagagtgagaccctgtctcaacaaaataaattaaaataaaaaataatatatttttctaactatcatcccttttccaaatcaggaattccccttaagttttcctcaatttccatggcaatatctttgcatagattcattaagaatttgtcctttttaaataaaaaatataaagggaactattcattaggcaacaaatgccttgtctgaaatatcacatttgagaatgctgctcatttaatcagaaaggtacgctactttaaagaactgaggtccactttctggagccaaaaactcataaatccctctcagaaaaacctgatttgctttgtagggtctcaggtttagagatgctgaaaaagatattttcgttgcagacaaaggacctcagagtatttggagaactttgagaagagaggaattctcccaaatgtataggtgtcacaggtaaaatacagtcgagagattttcttggactttaattccttaaatcaggatagcaaataataggggcttttacaaattcaatctgtttccttacaaaaattttcagcaaagtaatttcagcaaattaattttcagcaaagtaaatgtaagaagacttatgtgaaaaattaacattctccatgtatctatgaagccaaacctaataaaaccagctttaatttgtgctcaaaaaaaaaaaaaaaaaaaaaaaaaaaaaaaaaaaaaaaaaaaaaaaaaaaaaaaaaaaaaaaaaaaaaaaaaaaaaaaaaaaaacaaacgaaaaaaaaaaaaaaaacaaaagaaaaaaacaacaaacaaagcaacaaacaaacaagaaccaacaaaaaacaaacaaaacacagcaggccgccagccgcacacacacacgacagcacccgaccacacaccacacacacaccagcccgtgccgcgcggaggacgacgagacgcaacgcacccaccggaccaccag

SEQ ID NO: 203076 - DNA, 453 bp, Homo sapiens
ataggtgtcacaggtaaaatacagtcgagagattttcttggactttaattccttaaatcaggatagcaaataataggggcttttacaaattcaatctgtttccttacaaaaattttcagcaaagtaatttcagcaaattaattttcagcaaagtaaatgtaagaagacttatgtgaaaaattaacattctccatgtatctatgaagccaaacctaataaaaccagctttaatttgtgctcaagaatattatttcactgagttttcttaaatcacaaaggggagactgttatgaaaactgatataaaataaaaaaaacaaggaagaaaagtctactagatgtctctaatggaagactgcatttttagaacatatccttataggcgattctagcctttctctgctatttggctctcacactctttaccgtgcagataattcacagcaatgcaaaa

SEQ ID NO: 203077 - DNA, 359 bp, Homo sapiens
cctgatgatgctggaagacagtagatagatgattgatagatagatagatagatagatagatagatagataattgagatagataatagatagctgatcgatatagatagaagatagatagatattcatttaaaccttattcatattcctagacagaagatactgtttttgacccatctcacaaatgaggaagctgaggcacagatttagcagcttattcaaggtcacagctaaggaatgaaattagaaggttgtacccaaacagcctccggcttgagccaagcattttcatgtaagggagtaggtctttgaaggttggagaaaagacagggacacagctctcacaggatccctctggaaa

SEQ ID NO: 203078 - DNA, 703 bp, Homo sapiens
ccttccagtatagaatcagacatggctatggctgtcatgactcatcttgatcttttatgtcattgatatgtattttttttgagacggagtctcgctctgtcacccaggctggagtgcagtggtgcaatctcggctcactgcaatctccgcctcccaggttgaagcgattctcctgcttcagcctccggagtagctgggattacagacgcccgccaccacccccagataatttttttgtatttttagtagagacagggtttcaccatgttggccaggcctgagctcaagtgatccgccatcctctgcctcccaactcctgatctcaagtgatccgccatcctctgcctcccaaactgctaggattacaggtgtgagccaccgcactcagcctcattgatatttttggtgaatgtagccacccccaaccccaccctgtttttttttttttaacagaaaacaactcagtttgatatttcctcatatttagaatcagtttatgtgtttttgcccataatgacttgatatccatctgccccctcattgatagtggtaaattttgatcacttggtcaaggtgtccaacttctctgtatatccccctacctggaacttataaccagtatatgtagactttcagaccatgcaaatctcttgcctatgaaagtgtcccgttaaattagcatgcattgatgtttcttacctgc

SEQ ID NO: 203079 - DNA, 810 bp, Homo sapiens
tagtttcagaaagttagattaaatcgaaatgagctggtgccatcaagtaggtgctgtaaggacagagaaaaagcttcccttctgtcctctctgaaggttccctgaaatgactgacagtagacagattaacaggagaaaaggcatagaaatgtattaatgtgaataagcataggacccacataaaataagagactcaaagaaaggccacatggttgaagtttttataccctttccatggaaaggagggaaatggggaggtgggtaggcaatcatgattagtagtaagtgatttctaggggaaatgaatggatccaggaggtagacgttaccttgttaataattcttaggaactgaacaggacttgtaagttatgggaaggtgaggggtagaactcttactgtgaccaaaggtttcgacaacttttattctcttctctggtggttaagtctttcctggttatttggggaaagcaggagatcagaaagtccctggctctgaagcagcttctaaggcatgcttgtccagcttgcagcctgtgggccacatgcagcccaggacagctttgaatgtggcccaacacaaatttgtaaactttctgaaaacattatgagattttttgtttgtttaagctcatcagctcttgttagtattcatgtatttatgtggcccaagacaattcttcttcttccagtgtggcccaaggaagccaaaagattggacacctctgttctaaggccttccagttgtctttaattcaaaatgctcaggccgggcacgatggctcacgcctgtaatcccagcactttggga

SEQ ID NO: 203080 - DNA, 399 bp, Homo sapiens
atgcatagattgtgccccaggcccattatagccagatgatccatatctaatttgatggtaaaaacaccattttcacaactcatttatttaattcttccaatttatgtgcagcaagtttagatgggattaactaaatggaggaaatatgggcaagtatacttctcttcctggtctattttaagatcttcataagatcttaaaagacttgtttaataacttactccaatatttggaactggtgatcctgaaacagtctaggatatactatgaatgactcagatactattaagatggaatggttgggatacctgggatactaagtgatgatgacaaataccttcaaatatcttcaaatgtttagaaatatatatcctgctttgtctaaaaaaaagtaaatcc

SEQ ID NO: 203081 - DNA, 452 bp, Homo sapiens
agcaaattgttgtggtgaaggagcagaagtaaccatgaagcaacggagaaagataggtaggtagtgagaggagaacacagacgccatggagaaggagaaattctgtgagtgatgtcccggtgcacagtcccgaaaattgtctgaattcctggtaatttacagatccaaccccgaggcatttggaggatcgcaatatgccaccaccattgtgtgaggtgccaccaccagactgcagaggttcaagacccacattcaaacctcagtttaccacaccacctactagccttctgacttgggcaagtcatttaaactctctgagcctcgctcccctaatctgtccaactggcatcatgatagaacttccttcataggattgttgaaagaaccacatgaaatctaagtgctcagcacatagtaagtaccaataaatgagaactattattaattaatac

SEQ ID NO: 203082 - DNA, 253 bp, Homo sapiens
agaatctttcattctacacacaggtttctttgggggttctgttttatcttttttcatacactgcctaccagagagaacaagactggcaaaaggactctgtcctcataaagctcagagacgatgaacagataaacaagtaagtgaacaaaaatacttcagataatgctaaatcctccaaggagaatatgatacagtagatgtaatgggaagctcctttagactgagtggtcagagaggacctttctggggtggg

SEQ ID NO: 203083 - DNA, 560 bp, Homo sapiens
aaaaaattaatgttgttatctgaaaacctaatgattttacggataataaaaatggcaaaaataacacatttttatctctaagtgcttgagcaatacgttaagtatcccaaagtattttaggatagacatttgactaagtacttgcctgttatctttcagaaaaaattaaatatgattttatttgtttccctaattatactgttacagttttttttttaaactgtttttagtttcttaactgttagtttttttcccaaaactaactttactgttttttggagccatctatttaatggaaaatgcaaacctattaatgtaatccaatggaataagacagattacatgccaggaaatggaaagaatcatattgtctagaaagcgattactcctgaaagtttttcactttttgttggaagatggaagagtactagtcatttgaaagcaactgatttctttcctgaattccagtcttgaaatatgcattcatcaataatcaaataaatattcatgatccgtattggtgactcatttgatattttcagtggtttgttgtttgctta

SEQ ID NO: 203084 - DNA, 446 bp, Homo sapiens
gaggcaggagaatcctttgatcccgggaagcagaggttgcagtgagccgagatcacaccagagatgcactccagcctgggcaacagagcaagattccttctcgaaaaacaaacaaacaaacaaacaaaaaaacagttcaaaagacacagaatggactggtggcgatggcccacgcctgtaatcccagcactttgggaagccaaagcggaaggatcgcttgaagtcaggagaacagcctgggcagcatagtgagacctcgtttctacttaaaacaaaaacaaacaaacaaacaaaaaaacaacaggtgtggtgacttagacctgtggtcccagctactcaggaggctgagatgggaggatcacttgggccccagccgttgaggactgcagtgacctatgatcgcaccactgctctccatcctgggtgacagagtgagaccctgtctc

SEQ ID NO: 203085 - DNA, 402 bp, Homo sapiens
agatcacttgagtcagaagctcgagaccaggctggacaacacggcgaaaccccgtctccactaaaaatacaaaaattaaccgggcttggtggtgggcacctacaatcccagctactctggaggctgaggcatgagaatcacttgaacctgggaggtggaggttgccatgagctgagatcgcgccattgccctccagcttgggtgacagagtgagactgtgtctcaaaaaaatgggggggctatgggggcacttagcgtgcgagtaggacaggggcagaccagaaatacctgcaaaacagtaatagctatcactgagccactaccacaggcccaacactttacaaatccaatgttgggatcccactgataaaccagtgatgagagataaaagggatggatgaa

SEQ ID NO: 203086 - DNA, 300 bp, Homo sapiens
tggggtacacatgcaggtttattatataggtaaacttgtggtttagacatttttcaaagccctaatacatagaaatggagctgtgacacataccatcatgactcttgaatgaccttgtcatgggaacactgtgaattggattttacatctgggaattcagtgttcctagatttaagcaatagggggcatcttgggtttgttcttttcacatatttttgtagtctaatctttagggcagttctaatgaaagaaaattctgctttgagcctgctgtgcaaattagccatatggtgaagtgta

SEQ ID NO: 203087 - DNA, 353 bp, Homo sapiens
ggcaatgttttcttggatataacaccaaaagacaggcagcaaaagtaaaaataggtaaattaaagtacttcacaattaagttttgtgcatccagggatacagccagcaagcagagtgaaaagcaccctatgaaatgggaatcttatatttgatcagaggtcaatatccagaatatataaagaactcctacaacaaaacaaaacaaaaataaccccattaaaaaatgaagtacttgaatagacatttctccaaatacatacaaatagacaggaagcttatgaaaagatcaacatcactaatcattagggaaatacaaagcaaaaccacaatgagataccatttcacacccatta

SEQ ID NO: 203088 - DNA, 301 bp, Homo sapiens
gtttctcttgtcactctgcaatcagaagccatggaagttttgtgcagggcagttgcctgacctgacacacattgttcgaggaagaacctgattgagtgacgtgtagggtgttgggatgggaaggaggtctgggtgaaggcaggaggtaggacggaaggtgggtggcaccgtgcaggtgagaggagttgcctcatgtaacagctcatagtcatcaaggtcgctaggttggaggtgtggttagaagacagacatgacgagatgtgctgattcgaagtctccatgcaggcggagaggtggacag

SEQ ID NO: 203089 - DNA, 1329 bp, Homo sapiens
ggagtctgaggggagaaatgtttgggggtgatgaatatgttcactatcttgatggcagtggtggtcctacaggtgttgtataagtcaaaacttataaaatgtcactttaaacatgtgcagtttattgtatgtcaattatacctcaataaagctgttaaaatgcatttattagacttcagactatatacccaatatcatgcattaatatattaatgtatggctgtaccaattacatttatttagaaactctatattttctgtatttgtttttgtgttataagttaaatttttaaagaatttttgagtccctaccatattcctacattgtactgtgcatgtactacagaagctacaaagtaagtatgtaagacatttattcccttcacggtattgatagccttcctaggaagacaagactttttaaacaatgcaatatttccagtatggccaaatgtctatatacaaacagttaagtgaactgggaagtgagagtgtgtaaaactcccaccgcatatgtgtgctaaatgttgtgtggcaggccatccctttcttcaaggagcgtacagctttatggaggaaaagaaaagccattggatagaatgtgataagtgacctggtagataaacggaaaactgcaccaagtgttatatgagagtgcacgggagatacctcatggcaaacttgatttgtggagttcatggctgagctgagtcttgaatgacatgttaggttttgccggagaacggctggtgaagaaaattactcgcagtaaacaaagcaatgtgttcaaaggcatagaaggcatagcagatgtactttgtttctaacacacctgaagattatgtctttattactaatggctcagaatgtgaggtttggaatggcacgagacacagacggggtcaggtatagatcgtatgtgttaccttaaggaaactgtacagtatttgaatggcaaacgtctttgcagcatttggagcagggaaatgacaagatcacacttccactgtgcatgtgtgtgtgtggtggggattgaactagcccttaaataacaagtagactctgaatggaaagaagggacaaaggaggtgccccaggttaggactctatacaccagaaaggcgactttcaaaagtccttccacctgcctccccttatcaagtgcctggcactaagaaggcaaatgcaaacacataaagactgacttactaaaaacaattaggccctggcattagactgccacgccaaggaaacggagaagaggacaaatatttactgagtatctactgagtaaaagacttataaaaaaatacttttttcttttttttt

SEQ ID NO: 203090 - DNA, 352 bp, Homo sapiens
aaccatttatcgtgtgccttaccatgcttatattttacttgatcttttgcataccttctaaaactattttagccaatttaaaatttgacagtttgcattaaattataggtttacaatatgctttatccagctatacctgccccaaattctgacagatgcttttgccacctctaaaggaagacccatgttcatagtgatggagtttgtgtggactaaccatgcaaggttgccaaggaaaaatcgctttacgcttccaaggtacacactaagatgaaagtaattttagtccgtgtccagttggattcttggcacatagttatcttctgctagaacaaactaaaacagctacatg

SEQ ID NO: 203091 - DNA, 203 bp, Homo sapiens
ataagcttgattcgcattgttagcaacactcttcaaaaacttaaagcaattttaaaaccacaacaaataaagcatgcaggaaaaataaccatgcctacaatgtggctctgttgtgaatgatgtttaaaataacatatgtacaggcaagatattataaatactaaatgctgatacgacccgaattaggaatttttttttttttt

SEQ ID NO: 203092 - DNA, 824 bp, Homo sapiens
tgaggttgagttgatagtatgtaacctaaagtccctaccataaatcatattggtagacttatctgtcatggcttaagtcccctagtaaatcattatcaagaggatattcaaagagtttaacattacttcctaagagctaagggcaaatgccagacctctctttgggcaaggttaaattctttactacataccgtgctagttgaagtgttaggcctaactaagaggaaggggaaggggactagtttggagttttttgaactaagaaaatgtattttctgcttaaaaagttaaatatatatatatacacattgaattttttttaaaaagtagatccaagttgatagagcttccaggcacctgagagatgcaaactcagatcatccctggtggaatatacctcaaccctggcttcaaagaattcttaaagatagattaccaacatatgtgagcttataatagtaaccaaaaaaccaaaaaaaaaatcacaaaagaaacacggttctgtgaaccagcatcaacagaaacaactgaatcagacccagagaaactttaggtattggaattattgaatatagaacataaaataaatatatttaatgaaatagaaaagtaaataaagaccaagaataagaaatgagagaataaagcaagactggttggtttgtaaaataagcaattaaattattttagaaataaaaaaataatgattgaaagaaactcagtggaggggaacttacagttctggtgatagctgcgtaacaggaagctgatttatgctgctgtcttaagtgaataattggacaaagtatatgaaaaaatgtttt

SEQ ID NO: 203093 - DNA, 416 bp, Homo sapiens
cccctctgagtccaattattcttttattctaaggtgtttatactgagcacaaagtcatatataataatgtccaaagagcttataatagaaaaagaaatgtctaaatatagaggaagatgacactgtggggaaaaccacagaacaaactatccaggtcatccacaaatacatggttcctaaatatccaacaataaacaacaatgatctcatctgaaccaaggttcttttatctatccagtgaaatagtcattaaaaatgaggcaatcaaaactcagaaaaaaacacaggagttaatctttgtggccacggattaggcaaaactttcttagatatgacaccaaaaacacgagataaaagaaaaataagataaattgcacttcaaattaaaagttttcatccttcagtaataacaccat

SEQ ID NO: 203094 - DNA, 615 bp, Homo sapiens
ctgctctgtgggatcatgattagaccaataaatcaaactggttaccagcctaagcttttaagaatttgacaatcacctacaccacccacctcattttgtaaatgaggaaagtaaggcccagaaaagcaaagtgactagcccaaagccacacagctagtgtaatctcaacactcaaaagcaacagttattactaaactgtactatgtataaatgaatcactaaatagcctcttctattttattctattttaatatgccaaaatataaaataaatggtaaaatttgaggtatgaaattttcaaagttttccttctctgacgatataaaaatatatcatcataagcatttacttaaatgtttttgctcatacttgattcacaccatgtataatggatttcaagacgtatatgtgtctatgtatgtatatgtgtatgtatgtatgtatgtatctatctatcaactcattcaacatcccacactatgtctttcctggcacatattatgagaacattgaatatttgttgagttaatgaattttaaatcatatagatttattgccaaattatactctaatcccaaacaattaaaagggagattttcttaaatgttttttaaa

SEQ ID NO: 203095 - DNA, 554 bp, Homo sapiens
aagaagaagttggttataacttgaagatccaagagcaaaaggtaagctagagcaagttgtcatccaaagacagcagaacaagggccatgtttccaataaaccaggtataagcgccagcgaaggcaaatgaaaccccatcctaacagaagataggcccctaaaaccccagggccagcactgtggggacacttaaaattggctagccagacaatttctggcttatgtcaaaagaaccaacaggaggattcctatggggatacaccagtaatccataaaagcatccaccacccactgacagcgatgaaaatggtactggtcatgtatgaccttttctgctttttctctcatctctgaacccctgcttcccaaccctgtggaaacctatggcagttagtgaacggaagagaagattaaatgaggggagacagaagaagccaaccatgcatcctctcgtagagcaaattccaaggattaagttggcttagcccagtgcttggcacatagaagacattccatcaatgttaactgaatacattcttctttcattcttcatc

SEQ ID NO: 203096 - DNA, 1278 bp, Homo sapiens
attatgggttactggagagaggggtgaataatcagagaacaggttttttagggcaatgaaactattatgtacagtactataatagtgcatacatgtcattatacatatgtcaaagatggtagaatgcacaacatcaagagtgaaccctaatgttaactatggactttggttgataatactgggtcactgtaggttcattgatggtaacaaatgtaccattcttctgtgggagataagtaaatcaataattaaaaaatcataggactgtatgatcagtataataatttgatatatatgtgcagactgccatggagtaacagaagaggtgcacctaactctatcattagtggtcacagaaggcttcctggaggaggaaggtttatattgagccagggctggagaagaagggcttatgcacagttgtggagatgagaaagctaagccaaagcacactgaaggaatggcatgtctgttacagcaggcaagtcccagaggtggagatggaggttccttagaaactaagtccattctgtaggtgtatgggagacagggcagatgagtattgagggacaggtcctagagggtccaaggatcccatgtaaggaactgctggcctggaatataaatccctacttccctttgcatctgttccagtgcctggcaaagttatgtaataaatgttttcagataaaatgaaagtgctgggtaccaggaaggaaatcaaggcagagatttagccttggagaaacatgactccttgcttccctgcttaccctgtccagacctccaatattcatcttcgacatggtctccttccctgattgacataatctgggtcaggggcctctcctacacactcctgacactttctgtgatttccccagcatgggaatgggaatgttcacaccttattatatctgatcacatacctgcctcctctcttcagctttgagctccactgagggcagggacgatgcagccccctctggctagcacagtgctgctgagcacatactcggcccttgctagaagtgtgcagtatgaatggacaatttcccatggcctagaaaatttagtccaccctctaggcctggcctgccacaaaaatgatccagttttgaaaattacttctgtagctcttgctccgttcatggtgtccttaaactcccactcaactccaagctaactagtcttttccaaataagtcttaacgttcataatcatagcaggagctttgcttttactgtttactctgcttggaaaattctttccctattg

SEQ ID NO: 203097 - DNA, 210 bp, Homo sapiens
aggagctcattgtttgcgtgttaacagtgggaaatagttaaggaggtgggaaaagagctacctgtagaaaggtggcctaagtccctggagagctgagcacaggaccccagggcacacacccccttatgcttcccctgtctttcatcttgaaagcacctgcctgtgaacctcaggcttggagggaatctggatgttttcccaggatctacc

SEQ ID NO: 203098 - DNA, 486 bp, Homo sapiens
ccagcatcacatggctgtaagtgttggcaccaggatttaaatcgaggctcatggcaagcacccggttttccaaccaggaaagaagtctctccatcgtccccactgactccctcaatgccgcttcttggagtgctcatcctttggatctctctgtacaccctcaaaactgtagcatttggaattcacgttttggggttccatgataccactccgccagctctcctctaacccctcctcaggttgtcttagtgagctcttccctgcatctacctgctgcatgttggcttctcacttgctctggcctgagctctcttgtcttgttctacgtgtgctctctggacaagcttacctgctctgattctaaccacccccggaacactggtgacccaacatacacatctgcagttcctaccatgctcagcatgtcttgaaatgagctcatggccacctttttcatttcaaatctattctgcaggttggttagca

SEQ ID NO: 203099 - DNA, 256 bp, Homo sapiens
gttaagtaactgagcctggtccatctgctgtggcacctcccattcttgggggtccttagggaagggaaagggaagcagacctcccctgaaaatcatggatgcggtgccctgagtgcctggggtggcttggctggctggtgcctccccttttatattctcatcagctcccacaattaagacaggtccctgagtccccagtggcaactaggaagctcccagttttcttttcttttcttttttttttgtgagatggagt

SEQ ID NO: 203100 - DNA, 327 bp, Homo sapiens
tagtatctatttcctaagaaaaggaaagcaggaaaggaatcatgtcagaaaaatcaactgatggctgggcacagtgcttcatgcctataatcccagcactttggaaagctgaggtgggagaatcaatcacttgagcccagtagttcaagaccagcctaggcatcacagggagaccccatctctacaaataataataataaaaaattagccaggcatagtggcatatgcctgtaatcccagccacttgggaggctgaagtgggaggattgagcctgcatggtagaagctgcagtgagccatgattgtgctactacactccagtctggg

SEQ ID NO: 203101 - DNA, 773 bp, Homo sapiens
ccggggctcaggtgaggggcgcggcggggtggcagggcctcccctgctctcactggctgtgctggttgcaccctctgggagtgagtctcgtcgcaggcgtcagaacaaggcagtttttgcagtgctgtgtgaagggctcgtgtgttcatcctgggaatgacctcgtgagcactcactgtccctgaggactaggacagctcctagctggaagtaggtgccagtcagtcagggtgggcagcccacgttctacacagtagcgtagccccacaagttacgtgagcatcgctaccactgtgggagaccatgcatccacccgcgatcctgactgcatagctcgtctctcagacggaggcgccagcaccctccccgtggctgtttcttcaatacctccattttcctttctttggaattgcccttctggcattccctttttgttttcgtttttctttttttggagacggagtctcgctctgttgcccaggctggagtgcaatggcgtgatcttggctcacagcaacttccagctcctgggtttaagcgattccccttaagcgattctcctgagtagctgggagtacaggtgcacaccaccacacccagttaatttttcaccatgtcagccaggcgaactcctgacctcaggtgatccgcctgcctcggcctgccagagtgctgggatgacaggtgtgagccaccacacctggccgtgttcccattttttatttccatgctgctttcatcttcatttcccagttctttcttttgattaccta

SEQ ID NO: 203102 - DNA, 323 bp, Homo sapiens
gccttgtaccccaataacagcattattcacaatagccaaaagaatatagagacaacccaaatatccataatatccatcaacagatgaatggataaacaacagaatattactcggccttaaaaagaatgaaattctaatacaggctacaatatgaagggaccttgaaaacattataccaagtaaaataagccagacaccaaaggaaaaagaaaaggtacccagaataggcaaattcatagagacagaaaatagaatagaggtttccaagggctgggggaccggggaaaagaagacaatgtttaggccaggcacggtggctcacg

SEQ ID NO: 203103 - DNA, 483 bp, Homo sapiens
tactgttaaatctacagtgatacagttagcactctggaaaatcagatgggcagttttcatttgagttacatatgagggactataacctgcataatcatacatggaatttcttaaaactccttggcattctctatgtggttttttgatttgtaaatccaaatatttgctattgtgcctcagtctttttttcctcattagaaatctaagctctccccgccccctcctggtgctgttccttgaggggctgtgtttttatttctgagcttttcccatttgtgtgtgttccttttgtctggagtatgcccaaccccctcacctttttacctgggcagttcctactatctaaaaaattccctataaatgacattatttttcattcttaaaatctaaagataatgcagaacgagctgataatcagcatttaccaaaatagatttaagggttattatttgtaataactcatgtgtcagtaaccttatgtat

SEQ ID NO: 203104 - DNA, 346 bp, Homo sapiens
ctccatccccataacactggcctgtagcagccctcattccttatgaccaccatagcctcccactgggatctcagaatccaggccttctgcccaaccccaaatccttcctgggcacagcccctgattcaccttttacaaatgccccctaggtctgtcactctggggctcccctcatccacaggcaagtcttagcctgcctttatctctctcctctttcattcctgctctatctccctccatcctctgaaacaaaaactaatttgttgttccctccggattgcatgctgttccctgcatttgaatgcctttctcccacctcaactcatcgaaatctcaaccaatcttc

SEQ ID NO: 203105 - DNA, 566 bp, Homo sapiens
tcatttcattcacaatcataaatgtaaatatctaatattgtataaaaatcatataaaatggtcaggttggctttgtcccagatctgcaaatatattttaatatcagaaaactgatgttatttaccacattaattaattaagtgagaaacagcacatgattatggtaataattgcataaaacatctgattaattccaacacaaattcgtgttacaaaaaatcttaataaattaagggaatttttaaatgtgatatatctgtgggaaaaaaatctttgaaacatccttttaaatagaaggatactagcatttaaaaaattaagtaaaaggaactgaggaactgtactcattatcaccacttttattcaaccatacactagtcttagctgccagctagtgcaataaactaagatgaagatatttatggtataaacattgggatggaggaaataaaactgcctgctttggagatgatctgattattttttttttaaaaaaaatcacaaattaatagaaataatgaaagtcagcaagtttctgaatgtaaaactcaatatataaaatcaat

SEQ ID NO: 203106 - DNA, 592 bp, Homo sapiens
atgtggcccacaggacatagcttggacaagcctgtactaaagtttaacatgtgtataccctatgacccagcaattccactcctgtgtatatacccaggagaaatgcatacatcttttcaccaaaacacatgaataagaatgttcttagcaccattattcataatggtctaaaagtgggaacaacccacaggtcaatagtatagtggataaatgttttgtggtatattccatcaggtgatggaatactatatagcattgaaaatgaacaattattgatatacaacaacatggatgaatatcacaaacacaaaatatgtagtatgatttcatttatataaagtttgaaaactggcaaaggtgatctatgttgttagaaataagaaaggttaccttcagggaaaagagaagggtagtgacttgaaggtggcatgagaaaaacttctggaaagctggtaatgttttccttcttgctatgaatgggtattacacggatttgctcaccttagagtaattcaagctatacacttatgatttgtacattttcctacatgtatgttatgcttcaataaaagttttttaaaagatagcacta

SEQ ID NO: 203107 - DNA, 365 bp, Homo sapiens
acagacaaatccaatgactgctacagccagaaaccacggataaactctgtctgagagggagacatgttctcctcccctcaaagatggggactgatgggagagaagcaacctctgttcttagtgaacacgtagttctattgatgatctgagctacaacctctgttcccagtgaatacagaattccattgatgatttactgatgaactccctagagttctatagggagtcccagagagagagatatgccataccttcctttcttccttcctcttttctttcattaatatatccacatatctaacattaattgagcacctactgtgtgtcaggctttgtgcctggcaggaggtagagtgattaataat

SEQ ID NO: 203108 - DNA, 291 bp, Homo sapiens
aaaaaaaaaaaaaaagttggtttttgaaaagatcaagaaaattgaatagccagactaagaaaaaagagaagactcaaatttactaaaatcaggaatgaaatagaagacattactaatgacattacagaaattaaaagatttatgagggactcttatgaacaatgtgccaaccaattaaataatctaaatgaaatgaacaaattcctggaaagacacaaactactgaaactgactcatgaagacatacaaaatctgaatagacctaacacaaatgaagagattgaagtagga

SEQ ID NO: 203109 - DNA, 635 bp, Homo sapiens
ggtctagggagagagctgcagggagaaaaccttatatgcgttggtgacatcagcattatgtgctatgtagaccaggagtcgtcacccagatttctcataaatccaggccttcactccttcacctgccagcctgtttccctcttccaggcaggcatgtggcccaggggtgagaagaattgttctactgccagactgtgccagttcaagtcctggccctgcatcttgggcaagtaaaacagaaagaatgctactgtctaccatacagggttatgaaagtgatccgagatactgaacgcaaagtgtaagccgaggcttcgtgcgcagtaagccctcgcaaggggggtagcagcagtcatagctgtgattgttactattatattattattattattcctccctcaaagttgctccatctgggctggagacagagatggaccttttttcctttggacagagggagagagtggtatgaactcatcttagtagtatgaatgtcaaggtcaggatttgaggggggcgatgagaatgattctagggctccctcccgcctgcctccacttggctctggtgtgttcataccactctctccctctgtccaaaggaaaaaaggtccatctctgtctccagcccagatg

SEQ ID NO: 203110 - DNA, 530 bp, Homo sapiens
agaaaaactgatgagtttagtttttggtttggttagttttaggaactaggagacctctgagagatttaatggcagttagaaagtgaagccatgtagtacagcagaaagagcacttggcttgtttcttcttctataaaatgaaagatttggatttaaaaggtggttatgttatagtgatagagagcaaaaattttagatccctgcttgttttagcttctcactaactgtttaacttggatatattatttattctccctgggcctcagattctgtaaaatcaggataaccattctatgcctacctcatattgctactgtgaggaatatgtgcacacacacaatttatttagaacagtgcctattgcatagtaagcttaatgttacgtaggtgaagtccttttcagatctgaggatccattgttgcgtggtcagtttctatgagactggcattccaaggtagaagtcagggccagagacctaggttaatcatttcttttctaaagtattatcgaatagctgggatgagatacc

SEQ ID NO: 203111 - DNA, 374 bp, Homo sapiens
atcttctgtatcatatgttctcattgttcaactcccacttctgaatgagaacatgctgtgttggttttcgttcctgtgttatttgctgagaatgatggttccagcttcatccaagtccctgcaaaggacatgaatgcattcttttttatggctgtttgtctttttgttgttgacttttgggaattctgcatacattctagatattagtgttttgtaatgtgttataaatattgcaaatatcttctaagtcttgtatttggcttttaataccattgcagtttttgttgcttagatgtgcctttttctttaatatgtagtcatattgatcaatcttgtcttttctgctaacactttgttcttctggttaacttcta

SEQ ID NO: 203112 - DNA, 233 bp, Homo sapiens
tggtggtgcacacctgtggtcctagctactcgagaggctgaggcagaggatcacttgaacccaggagtttgcgggtgcagggagctgtgatcacgccactgcactccagtctgggcaacagtgtgagaccctgtctcaaggaaaaaaaaaaacaaccaacagagatatgtgggaacttaagattaattcctgtgccaaataaaatgagacatcttgaaatggtgctgaggagg

SEQ ID NO: 203113 - DNA, 425 bp, Homo sapiens
aaattgcaaatccagtaaaaataacacatagtctctttctttctaactggatagagtctatcatatacaaaaggaaatttaaaaatactattttcttaaacatcattcactaattagtactaataagcaatgttttaaaagaaggtaaaaagaaggaactagtggctacttagatgtcttcaaatcatgtgtgcacagtgtgtgtgtgtctgtatatatattaatgtacatgtgtgtatatatatataacaacacatatatactggagactaaaaatagaaaatacatacatatatacactaatgagatctttatttttaattagttggatgcttgatattgtccaactgatagttgggtagtagttgggcacagccttgttttcaagcagttgtaagttagtgtgacttgcagtgatgaaaaag

SEQ ID NO: 203114 - DNA, 241 bp, Homo sapiens
aagcagttcaacaacaaaatcaacaccctcactaaccaagtgaaatcaaactgacagattgtttgtagcagccttataatggtctccttgggtttatgatctggggaatgaagacaaattgttgatttttaaatagaatgccatgtactctttgctaagaaaatttgcctttaatttttagacctttgagtattttattactagtttttttctgtctctgattcagtattattatatcttc

SEQ ID NO: 203115 - DNA, 649 bp, Homo sapiens
cattcacctattgcaggacatcttggtggcttccaggttttggttattctgcttttgctgttttgtcagtttcctttttctagattgttaactgtacataaatgaggtaaagagatcatagggcagtaaaatgttactatttttcaagaaacttatgtagaatccagattagtttggaaaatgtttgtggcctgggaatggcaataagacgtggctcagaataggtttctgatagaaggtagagttataattatttttccactcattgagccctgtaagtaaaaaggtctgccttagaattttctccagtttatgtacattgatattgagactagtagattgatgaagctatagaaatataatctgtcggccgggtgtggtggcttatgcctgtaatcttaacactttcggaggctgggacgggcaggttgcctgagctcaggagtttgagaccagcctaggcaacatggtgaaaccccgtctgtacacaaatacaaaaaatcagctgggtgtggtggtgggtgcctgtaatgccagctactcaggagactgaggcacaagaattgcctgaacctgggagtcggaggttgcagtgagctgagattgtgccactgccctccagcctgggcaacaaagcaaaactctgtct

SEQ ID NO: 203116 - DNA, 489 bp, Homo sapiens
cagttcttgcgtggggtctgtcatgaagttgtagtcacatagtgcctgggactagggtcatctgaaggcttcactgggatggatgcttagtatggtgagcagtgatggtcgaccatcacctgggacctcacctggctatcaggtgaaactcttacccaaggcctctgcttgtggcttgagcttctcacagaatggtggtgggttcccagagggagcatcctaagagctagtgctccaggagacccaaatgtactccacatggcttcttgtaagttatgtgtctcagaatgtcacttccactatattttattggtcaagcaagtcactgaagtcagtccaggttcaaggggagggttgttagatgtcacctcttgaagggaaatggtaagttcatgtcaaaggaattattatcatagttatctttggaatacataatttgcctgaggcctgttagttccataagtgttgaatcagaactttgaacttaac

SEQ ID NO: 203117 - DNA, 338 bp, Homo sapiens
ccaccctcacgacctaaatacctcccaaatgctccagtccctaactaccatcacattgggagtttcacttatagtaaatgctgaaatcacgtagagttcttctaaatgtgttctttttcaaacttgttgtgttcctttcaatagtaacggattttgttctggagtacagttaagttacctggaatctgggtggtccttgtgaggctggcttttgatctttcttaaaatggttccagagaaacctttagtctaggactagcttagctccactgctgaagccacatgttcctgaggattctatctggtgtcctgtgtattatgaggtcttttcagtctgg

SEQ ID NO: 203118 - DNA, 185 bp, Homo sapiens
gttcgactgtacgagtttcgaggttcaagtaagctgtgatcgtgacatggcctccagcctgggtgaccgaatgaggagctgtttaaaaatatgaaattgaggctgagtgtggtagcttgggcctataatctcaacactttgggaagccgaggcgggagggtcacttaaggccaggagttggagac

SEQ ID NO: 203119 - DNA, 450 bp, Homo sapiens
atactaatgctacataactgtttctagacctataaatgtataaattatgtaactacttagaagaaatagtgtgaaacattcatgtgactgttaagaataaaagtaatatgactacctaagttttagtagcattaattataatagattctgatatcagataccttcatagcattaaggtaggattctgccttttaccaactatactcaagtaacagacagaggaccctgatccaggacaagaactctgcagtaatggaacagccccttagaaatgtgggattgaatcaaatgtacctacttaaaacacatgttacatgctctaaatctaaaagctgttttcaaaaggatgtgagtgtcattatttttaattcagaattgtctactcccagtttggagtcaaaactacctaaacatataataattaatagaattttgaataccgctaaattt

SEQ ID NO: 203120 - DNA, 423 bp, Homo sapiens
ttttattcagaataagttaattcttccagaatttatatatttaaagactccaaatatacatccccagtggtatcttggactgttaaatagaaaaatattgttgctcttaaaagaaattcagtgaagtctggttataaagtcagaatgtctaatacttttggtcagagtcaaacagcagttccaatataggcagcaagttaaaggggtagttggtggcctgtgttgaaagcgacttgatgaaaataaatctttaaattaaactttagtagaataagaagaaaaagcagagccaggtgacgcagtggatcatgcctgcagtctcagctactcagggtgctgagggtggaaggatcacttgagtctaggagttttgagaccaacctggacaacatagcatgactctgtctctgaaaaaaaaagtta

SEQ ID NO: 203121 - DNA, 412 bp, Homo sapiens
tagatgactgcttcacttttcacatcttttctcaaacccccaacacctctccccctccttattctcagctgaggatcttgcttcatgtcttattaggaaagcagcaaaaagccttagatgagaaattctgctacatctgcccacccacctgcatttacacctgtaggtgctgcctgtccctcgataacagatgaactgactacattcctaaggccagcctgtacacttgaataccagattccattcctctttccctctcaaagacattctcatctttttttattaattttcccctcttgactggatcattttccctgccatacattgttatttttctcaacttaaaaagcaaaaacaaaaataccctccagcaccgctagattcttctgctcctttgcatcaaaactcctta

SEQ ID NO: 203122 - DNA, 479 bp, Homo sapiens
ggacttccttgggcaatatactggctgctgagcaaactgctggctgctgagcaaactgctggctgctgagtgatatgcggccgttcctgagggcctggcttttaaaggcacagattcccggctccccccacgccacccagagagttcagttctgtgggtgaggcctgtgaacctgtatcttaaaaagctgcccagcttattactccaccataccatgtacacatggtctctgggccccaggctcatatggacagtaattgctgtagattctgaggaggatgtaatagtctgattgaagggtatgttttttagctgcaaagtgaagtatatagcgggttcttttcttactaaagagtgtgcctttatacagatactggacactcagagtcttatgattcctggccagagaggaagcttcaggcttgcagattctcagcacacagacagggtcctgtgcacactgatggcagagaagtggg

SEQ ID NO: 203123 - DNA, 516 bp, Homo sapiens
cactttatcgtgcttcacagagagtgcgtttttgcaaattgaaggtttgtggcaaccctgtgtcaagcaagtctatcagcaccattttcccaatagcacatgctcgcttttgtcctgtgtcacgctttggtaattttcacaatatttcaaaccttgtcattattatgatatctctcatggtgatctgtgatcagtgatctttgatgttattcttggaattgtcgtggggtgccatgaacggcaccatataagatgatgaacttaatggataaacgttgtgtgtgttctgactgctccactgattggccgtttctggtctccctccctctcctggggcctccccattccctgagacacaaaaacaatgttgggtttcaacaacattgaaacccaaccacagcctgtaagtgttcaagtaaaagaagggtcacattatctttcagtttcaatcaaaagctagaaatgattaagcttagtgaggaagccatggtgaaagccaagataggctgaaagctg

SEQ ID NO: 203124 - DNA, 595 bp, Homo sapiens
cgtcctgctgtcactttggtttgtgttaactttgacgcctttcttgtttcttactctgctttcctgcatggagcacacagccccggctccctttcagtctgcatggcagacacctggcctctgcaggtccagttcattctgtgtcccctttcggtcgtccctatgttgccgtcaggtgattgagggtgaaggtcggccttggcagcccagtggaaagtcccttgactcctggccgtcagtggcaggtctccagcctttgggaggaggaaacttctatttaacaaagaaatggaattgactttgccacacacagccagagcgatgatttgtagagccaacctgctgagacattcaaagcatcagtcgtagggtcaggaccgccaggtgaggtgtggctccacctgcagcagcctggggcaggttgcctagcctctggctttagcatccccttctgtgaaatggggaaagtgatgggacctggctttgtagggtggttgtgaggacctacaggggtttttgcaaaatacttagcccagggctgactaaaagattcagagacgctgggcatggtggcacacacctgtagttccaggta

SEQ ID NO: 203125 - DNA, 443 bp, Homo sapiens
aatgaggtaaatgaggctcagagaggttaagtcactttcccaaggaagcacagagaaggagcagactcagagtttgaaggggtttcaaacacttgctctttaaaggccaggtactaattcccaaacttctgagtatcacaattatctgagggggatgttttgttttgttttgttttggagacaaggtcttgtcttgtctctgttacccagctggagtgcagtggtgtgatcagggcttactacagcctcaacctctcagactcaagccatcttgccagcccagcctcctgagtagctggggctacaggcacatgccaccatgtccaactcatttttgtattttttgtagagattgtgtcaccctatgttgcccaagctggtcttgaactcctgggttcaaccaatccacccacctcagcttctcaaactgctgggattgagag

SEQ ID NO: 203126 - DNA, 361 bp, Homo sapiens
gtgtcggcccagtgatccgggagctcagagtgtaggtacctgacggcttgactcgtccccaggacaaggcctgtgagtgggagaggggcactctgagtgtgcgaatctgtgagagtgtgtgtgtgtctgggcacgagtgtgtatgcgtgtgtgtgcatgtatattcacatgtgtgagggtgtgaatgtgtgtgtctgtgggtctgggcacatgagtgtgtgtgtgcatatactacattcacgtgtgagtgtgcaaatgcgagtgtgtctgtaggtctgggcacgtgtatgcgtgtgtgtgcgagtactatattcgcatgtgtgagtgtgcgaatgtgtgtgtctgtgggtctgggcacacg

SEQ ID NO: 203127 - DNA, 385 bp, Homo sapiens
tgattctgaggatcccgaagcgcacgatggcgcgtctgtaatcccagctactcaggaggctgagacaggagaatcgcttgaacctgggaggcagagtttgccatgagccgagatagatcacaccattgcactccagcttagacaccaaaagcaaaactccatctcaaaacaaaacaaaaaactagagaaaaacagagacagaaaagaaagaaagaaaataaagaagaaatgcaggccgggcgcggtggctcacgcctgtaatcccaatgctttgggaggctgaggtgggtggatcacaaggtcaggagattgagaccagcctggctaacacggtgaaaccccgtgtccactaaaaaacacaaaaaattagctgggcgtggtggtg

SEQ ID NO: 203128 - DNA, 448 bp, Homo sapiens
acagttggtgtcccagtctctccattgagtctgtttctgtgctgagtgtccctacagatgtggtaagcctctgaatgtcaggtctgtgctggtctttctttaggtcccatctcctcctagacttccaaagtctctcaagatcctgaatcaggaggacttttcctatctagatctccagtcagtgagcatgatggtcagggcatgtccacagtgtggtatcctcataggccattcgtggaccccacctggtgatcccttttattcatcagctctgtatatgttacaggattagctagtggtcagttgctttatgaaaactgtgggccaggtttggtggctcatacctgcaatcccaccactttgggagaccaaggcaggcggattacctgaggtcaggagttcaagaccagcctggccaatatggtgaaacccatctctacaaaaaata

SEQ ID NO: 203129 - DNA, 639 bp, Homo sapiens
aggccaaatctgtcttatctagtgagtcactactgctcctctttccaactgcattttgatttcagcccacttgtgcagctcatcagggctgcaccatatgttagtaccatgtaggcagaatgtgactaatttttttctcaagccctgtcagagcgacttttaaaatcaccttataatcttgatgtctcttgcggagtcattataacacataacctttggaaaggactataattatttttctgagtgctcaaaggagattcttcagcattttcattcccatttttcagatgaaggaactaaagggaagataagggattaagagacctgggttccacaaccaaccactgggacttggactttcttgagtcacagtgctgtatttggtaaaataaggcagcttgtaaaatgccttttattgggaaactcaaaatattactttgcctctctttattatttacttatttatttttttttagatagagtcttgctctgtcacccagatggagtcttgttctgttgtccaggctggagtgcaagaccttgtttcaaaaaataaaattatttaaaaaatctcttttcctaatttctccccaaatgccccacactggtgtactctcaatccccgtattctctctgtcc

SEQ ID NO: 203130 - DNA, 486 bp, Homo sapiens
ttataattatattgtaatgtgtgtcataattggtaacacatttgaacttggtgtttctttcattagttaatatctagatctatgcaagttgctctaattagattgctttctgaaaataataataaggcaggtttaggaccaggcagaacgtgagcataacgatagtgtctttccttaccatattcggtttaattttaggcatgatcttaccttcctaaagaggggcaatgagctcatcactgaactacagcacattttttaaacagttatttgtcgcattgcaagcaatctagatgagatttcaggaaaagaatgagctaccccactcaaatgcataacaaatatgcttgactggcatttggaaagaagaaactcttattaaaatttaacatcaacttggccagacgttgggctgaattggaagaacaaagtgctgctcagtaaaaagccagggatgggaatgatttgatttctactcatatggct

SEQ ID NO: 203131 - DNA, 539 bp, Homo sapiens
taatgtgcactcttctatactacatgtaagtgagaagtcaacccattcagatattaatatacctataggacatctgataacaagcacctcaactgcagtagatgttaataactgatgtatctgaaactagaaggaagggaggtttgcctttatatttagtgcattcttttgttgtagtcaagatctatcacagagtttcctgttgttatactcttggaaatgttagttgtattcagatgagggcatttaatgtgcccatttttatcactaaattctgtagtagatatagaagagtgcacttttggcaaagtgcctcacatgctagtaatctaccatatttttgaaatggacgatgatttgtacaatactgtgtatgtgcgtattttatactttaaacatttataagccatagaataatattaccagaatagttgtttcaggaaggaagttaatttagtagtcgatatagtagctgtatggagtacgggggttgattgacggttcatatatagaagtagatatagaagagtgcacttttg

SEQ ID NO: 203132 - DNA, 825 bp, Homo sapiens
  misc_feature (10)..(10): n is a, c, g, or t
tgtcgagtanctaacagttttaaaaacatgaataggtataggtttaattaagtgttttctggagtagtatttctggagttctaactgggaacatgggggcatttcctgggccattcctctttgacgggccttgcatatcaatccagtttcagcaactttctgctcaagcctcttagccacttagggctgccccacttatgaactggtggatgacttgggaggaaggttttacagaattcatcacttgccttagtatgtagatatagaagagtgcacttttgggggagcgactacgagtagatctgcaacatgtaagtgagaagtcaacccattcagatattaatatacctataggacatctgataacaagcacctcaactgcagtagatgttaataactgatgtatctgaaactagaaggaagggaggtttgcctttatatttagtgcattcttttgttgtagtcaagatctatcacagagtttcctgttgttatactcttggaaatgttagttgtattcagatgagggcatttaatgtgcccatttttatcactaaattctgtagtagatatagaagagtgcacttttggcaaagtgcctcacatgctagtaatctaccatatttttgaaatggacgatgatttgtacaatactgtgtatgtgcgtattttatactttaaacatttataagccatagaataatattaccagaatagttgtttcaggaaggaagttaatttagtagtcgatatagtagctgtatggagtacgggggttgattgacggttcatatatagaagtagatatagaagagtgcacttttg

SEQ ID NO: 203133 - DNA, 389 bp, Homo sapiens
cgcacttcccagctcatagcagacgatgagaggactacattttgaccccagtaagatgtgacgagtaatagttggaccccacagcagttacttttgtagagaggaaaattatgctccttggcttcaggtgaagacccccagatccaggccagtggatttacaagtgaaagtcagcagcactgggcattttgagcaatagctccgaacaagccctttaccacgcgggtaggtaaaccccagaatatacagatgccccttacaacacgcgggtagggagggtatgtggccgagagagcatgagcttaggaaatagactgggcttgaattccaccaagtttttggctatggacccatggggatgtggcatcgtctgccgctgagccttaatt

SEQ ID NO: 203134 - DNA, 401 bp, Homo sapiens
aacaacaacaaaacccaacaaaatgacaacaacaaaaaacagtaaccaagaggtagaatcaactgaaatgtccgttcaatgtggcatagacatacagtgattattctaccttgaaaaggaaggtaatcctgccacatgctacaacatgggtgaacacaccttgaggacattatgctaagtggaataagccagtcgcaaaaagacaaaacacaatactgtgtgattccacttatatgagatacctggagtaggcaaattcacagagacaaaaagcgaatggtggtggccagaggctggaggtggagggaatagggagatgtttttggttacagggtttcaccatgggttgatgaaaaaattctggacgtggatggtgatgatagttgcaccacaatgtgaat

SEQ ID NO: 203135 - DNA, 364 bp, Homo sapiens
tctctctctctctttctctctctctctccctctctcccccctaatcattgccttgcccaagcctctgctagttctgttctgataagatctcaagcactagagcaaagtagggaggtcacagtgcagtgcagggagctttggtgtaggaggcagaggcctgggatctggctgtcagcagtcgcctctcttagctgctattggtggtgcttcaaatgtgcttgactttggagtcggctactctcagtttcctctcctcactgcaggatccaggctgaccacactttctttggtctttgcctcaacagctaaggagagggagggctcaagaagagagctgcctctgtccccagggagatgagaacta

SEQ ID NO: 203136 - DNA, 197 bp, Homo sapiens
caaggcagacgccatccctgctctctaagagtttaaattctagttggaagggggatattaaattggtaaacaaataagagatgatttccagcagtggtaaaggctacgaagaaaacaacgtgatcaggaatgcctagcagggaggtcagggagtgtcagggctcattaatgtgatcagatgtgattctgagccaaat

SEQ ID NO: 203137 - DNA, 429 bp, Homo sapiens
accactttgatctggaaaaataaatccaacacagcaaaaactgacaggcacctgctcatgaacagcagtagcagtgctgtggatctgcttgctagctgtttcatctgctgagggaattgttttaattttgcaggctgtggcagacctggggaaacatactataatatgcaaagcacagaccccgattaatatttcacccattgcatgtggcttgatggcgttcctgacttgttgcaatcataagtgtgaaactctgggggtttcagttaaattatttcataacatgtagcctaatatttttgtgccctaacctcaccttctattaaaataattttagggtattgcttgtatacagtgacactatacatattatataaactgtgttttatttacaaaaggttttttaaaagtgtaaagacatcccatacc

SEQ ID NO: 203138 - DNA, 668 bp, Homo sapiens
gaagaaaatagtggtacggatgtgctgtaggccagcgctgaacatgctcttcgcgcctccgggagcactgtacgcagaggtccccgtcccctcctccctgatgccagacacagaccagggcttcctgctgggccgggcggtcagcacagccctggtggcccctgtacctgcacccgacaatacggtgttcgaggtgcggctggagaggcgggccagctcagagcaggcgctgtggctgctgcttccggcccgctgctgcttggccctggggctgcagcctgaggcccgcctggtcctggaggtgcagttccagattgacccgatgaccttccgcctctggcaccaggcagtggacacactgcctgaggagcagctggtggtgcccgacttgcccacctgcgccctgcccagaccttggtctgtcccacccttgcggcgtggcaaccgcaagcaggagctggccgtggcgctcatcgcgggctggggccctggggatgggaggcgtgtccccccgctactcatctatggcccctttggcaccggcaagacctacacgctggccatggcctccctggaggtcatccggaggcctgaaaccaaggtgctcatctgcacacacaccaacaggtaagcccgagcctggcctgcccccacctcacctgacgccc

SEQ ID NO: 203139 - DNA, 471 bp, Homo sapiens
cagcatggaaaccacatataattggcaatagccaacatttttgagtccctatttatttgccaagaatattaacaagcattcatttaatacaacaatattgtgaagtaaatacttttattctcatggtatttttagtaggaaacaaagaggagaactatataacttgtgcaattcatacagaatttagacttgagctccagtaatctgatttcataacttttaacgaatcaaccaatataacagactttcttaaggctaataaaagtaaagtgacaaaagaatataaacatagccaaaaatgatataatactctgctgaggaacatgtacttgttcttaatggcataagtggctactgacaaatttttaagacagggcattacatatgttacagaaattattctattccagtggaaagtagatatgactaatggcaccagtggagataaaagatgagagatacctaatgtca

SEQ ID NO: 203140 - DNA, 364 bp, Homo sapiens
aagctatactggtttttgagaactttcttaggttatttgccacatgtacacatgtacacactccacagggatttacaatttataaagctctttttaatacatgatcttgtctggatttcagagtacattatatggagaagtagagtggttgtcaatatctgtattttacagatacgttgaaacttagcaagattatgtaataggtcggtgcaaaagtaattgtggcttttgccattaaaatgccacatacttttgcaccaacctaatacttacagttctcatacattcacatgtagacagagtaactgaatccagactccatggctgtggttcctggtgtggtttccttcctctggcaccaacc

SEQ ID NO: 203141 - DNA, 859 bp, Homo sapiens
agctacttgctgtttttggttttagtcctgccttttttaagggaagaaaagaaataatattaatttgagagtgtattatgaattatgccattatcctaacagtaacttttattgtaatctcaccatgctaaaaagtatccaaaatattttgagatgggaagggatttgagtttggtttctaatgtttatcttttggtaatccctaccaaattttcatagtaatagtagaaagaaggaaagtgaatattggatattatttcctttacttaaaagcttttgatggatactatttgaattggtgtaatatgctgaagtgtatgtaatggaaaaacattattattttctaaattgaataaaatggatttaataaatactgaaagcagaattaactaagcaaaaataagtatgttttgcttagaaaatggatggcagttgcttaagaaaaaaggtttttttactaatttaagaatatacagattgtctggggaaaagaaacttttttttgtattttacttgtacagtctcacatataaccactgttgttctcatgacactctcctatattgatgtgatctttatatggtttgtaccttttttatctcttattccattatttcttaaattctattttattcaccagtttcccaaataaagctatcagggttgacatcagctatttccaggaaaataaaaaggttattactgctgaacactggaataatttgattatgtagattgaagaaaagtcaatctgttataattgctgtaaagaagccatttaattttgtgcctgtttgcattagtctttttttaactagatatgcagattagtgggatgaaaatatatattctttatttg

SEQ ID NO: 203142 - DNA, 644 bp, Homo sapiens
accctgtcaagctttctatgttatattatacgaatagctggttaaaatgaagaaataatgaaatcagaccatcccttcaggggaaacaattgcagtgttcaagagttgtttttttgttttgtttttttgtttttttgagactgagtcttgcgctgttgcccaggctggagtgcaatggcgcaatctcggctcactcaacttccgcctcccaggttcaaatgattctcctgcctcagcctttcaagtagctgggataacaggcatgcactaccacacccacctaattttttgtattttcagtagagacagggtttcaccatgttggtcaagctggtctcatactcctgacctcaggagatccacccaccttggcctcccaaagtgctgggaattacagctgagagccaccatgcctggcatgaatgttgttttaattgtcacagcatctgctactagaggatcattattatgatcatttccagtgaaagcatgtttaaaaacaaacaagaatttagactttaatataaaatgtgtagattgatcaaaatttgatgttatgaaattttagtgtatttttagactagaacccatctaggaaaattccatttcaagttgattctgtgtgctatggttggatgtgttgc

SEQ ID NO: 203143 - DNA, 873 bp, Homo sapiens
gagatgtacataataccaatattaaccttttattagaggaattctccaagtgagtttaagtccacagtacgtggattctgggccagtgtgggccactggcacggttgattggtaccctggtgaatccccaagtttttctttgtccatcccccttccttcagcaaacactgtgtgctgaattaattccacttctgaggttctgatcaaagtacacttatttggtggaagaaagctgtaggagcagcccaggctgcaaatactaaaagatccatctaaaatgtaagctgcctgagggcagggactctttctcactactatatgtccagcacctagcacagtgcctggcatgtagtagactatttttgaatggattagcagtcttataaaaaatatagcatcttcaaaataagtctttactcaagcttagcagctaccaccagtggtaccgaacctttcatttaatgataaccttactaaaatcaaagttaaattatcatttttattatttacaactatttattgatggtcttatgtgaaccaagtaaaatactaaatgttccatgtatgaatcttatgatttaatcttcataataacctttaaaatgtacgttagcttcattttacagataagaaaattgatgattcaaacttaggttggatttagccaaatttccatcactttgcaccatgcaacaacttgtctttgttttctgtttcagagaatccttttaaaatcagaagtaatttttagatttaataatttttgaaaacagaaataaggtaaatgtctggaagtaagatgtggctaactttggcatcagtacagagttacatgacattaacttagccagcgatccatatcccagttcatca

SEQ ID NO: 203144 - DNA, 365 bp, Homo sapiens
cccattatcagcaagtgaccctctcagtccgtctccagccattttaaagaagcaaagaaactactgggcttttgggaggatttgccctcagcgttttaaatgttggcttgctgggccgttcttgggtttgtagcacaaaatattaccattgtgtttccaccgtgggtttgccattcttgtttcagaagagaaatatttctttcatctactttcttctttctggttattgttcttctttttaaaaaaataattctgggctgggtgtcgtggctcacacctgcaatcttagcactttgggaggccaaggcaagtggatcgcttgagctcaggagtttgagaccagcttgggcaacatggtgaaaccc

SEQ ID NO: 203145 - DNA, 505 bp, Homo sapiens
aatccaggtctcatcagggctgcactccttctaaaggcactagaggagaatccatttcttctcttttcccagcttctagaggccacttgcattccttacgtggccccttcctcacatcgccttgatctctgcctctctcatcacattttctctaccatctctgacccccttgcctctctcttataatgacatttgtaattacactgggccccctcagataatccaggataatctctccatctcaagatccctaaattaatcacatctgtaatttcttttactatgtaaggtaacatatttataggttcttggaattaggatgtgaacatctttggggtgtcattattcagtctactacaagtttgtgcagcccttggcctatgagccaccatgtagcccaggacggctttgaatgcagaccaacacaaatttgtaaactatcttaaagcattatgagtttttttgcgattttttttagcttatcagctatcattagtgttagtat

SEQ ID NO: 203146 - DNA, 408 bp, Homo sapiens
gtaacctgaaagacacttcctgtcatttgcctgatatgatgtagtccatatcatgacatccacacccttgatttggggtcactttgcaaatgctcatcactgcctatccccatgaccttggcaagcccatctcacctacaatatatgagtagatgtttgaaataagtgacctttaaggacctcctagctctgaaattctagaattctgagaggtctggggtaaagggaaaggttggcataacttgatcttagggcaaggatgcagctagctggtggtgaataagggaggcagccccaagtagggtgcagggtggggtctgtagggccagaatagagattaagagggaagggactccaagcgtgtaggagggatggtagggttgggtgccgagaagggaaaatggcatt

SEQ ID NO: 203147 - DNA, 408 bp, Homo sapiens
ttctctggctgaaatgagagaatcatttcacatgggaaaagaagttttggggacgatgccctacgaagctggtagtgaaataatgctcctagttttgatagtatttccccactgctccaccaacttagctgaacatcgtttatcttagctcagctgtagcaatgaccaaaatttccatttgctactcatcataaagtgcaggagagaacctgtcttgtatataatttgcagtttcttctttggggctggagcatgggtttgatgtagaggcagatcagtaccttgccaactgaacccaaggagttaagtttaatgttgtgctatttcccagtttgaagttttcaattttgattctgtgtcagagtctactatggaaataattaagaagagtagataagcacaaatatg

SEQ ID NO: 203148 - DNA, 606 bp, Homo sapiens
gttctgacaaagggacctgtattttcccgtaatcagtgagttctgagtccctgctgctccttcagacagggtccatgctccccatcacctccagtcccaccactcataggtaagtgtccttgtgggctcttaaactggcccacttctgtcatgtgagcctgccttgccctgaaagcaggcgaatttctgaccccagccctgtgtgcttctcttttcaggaaggatggtgaacctgtttttttgttttttttttttgagatggagtctcactctgtcgcctcagctggagtgcagtggtgtcttggctcactgcaacctccacctcctgggctcaagcgattctgctgcctcagcttcccaagtagctgggattacaggcatgtggcccagccaatttcactttgtatctaagtattagtgagtgtattagttagctgctgtgtaacactgtcctaaaacagtatctgttttacttaaaacagtaactgtttctttagctcacaaacctgcaaataagtggtttaggccagtctctgctggtaccctcgtctgtcttgttagatgtaggtcagctctgcctggcgttgttgatcttggtgagtcctc

SEQ ID NO: 203149 - DNA, 469 bp, Homo sapiens
tggaattctagcaccctgagtcgtcacttaagccaaaatctgaatcattccaaattgagctgagtaaacccatcccagtccatctaaactttaaaagctaaaaatgaaataatgcagcattttaattttacttcttcaagtcctcatgtagtattttctaattgacacaactgtagatgagggaaaggctagtgaactgagagatttaaaaccatcatcattatgattgctacttatgaatataatagtataaagctcataggtagtgtacacattagcacattttgtgtttggtgctactgtattagcagctattcctctaaactctgggatgttagtgatctaaccgtagatcagaaatagcaagatacttgatcctcatagtcccaaatggggaaggcattgtaaacccatagatctcaattgaaaattaccttgtccccttgagtagttcaggctaatatcttaa

SEQ ID NO: 203150 - DNA, 401 bp, Homo sapiens
ttgtggccttggctggagctactttatcagataaactgtagtcacctccaaggcgtatgtgcatttagatatgaggcattcaggtaagatccagatcttggacagttctggatgggacagtgcaatgggaatgagaagcccagggaggcccaagtggcagcataagggcacatagggacggctgccaaggtttcccatttacaacctctaagtggaaggagtgtgctcttatcatttagcaaatggctggttgggagtacatggtggcagcttgtgtctcactcttattgggagaatttggccaactcagaatgtttgagtgtccccttctatgttaagtcgttttgtaaatctgcactctgatgaagtaatttgtattctcagtgcactgcttttattat

SEQ ID NO: 203151 - DNA, 692 bp, Homo sapiens
cactaggcatcacactctcattcagcagcatcaaagaaatgaaggggaaatgtctcattactatctgagaggaaaacattttccaggacccactacctcatcacgcttccccttggtgtcactggccagaactgggtttcacactgccttgccgcccctacccctctgaactaatcattggcagagaagagtgaaattaacatgatggcaaagaccaatcttgacttggaggggcccatcttccttgagcacactgtggcaagatacctgatcaaatttggggttctattttcaaggaagaagggggaaatgactctttggtaagccaccaacaatgtctgctctaagtcctaatagaagcactggtgttcagcaagctgcagttacccagacattcaagaaacatgaggagcttgaaattccaaatgaaattataagaattatcattttaattttcatgtgtataatatctaaatacacaccaactataattttgataacaaatttatgtaagaagctataaaactgaccacacaactgtaaattccttggagtagttcttagagcctttaccgaatgtcccagaattatgggtattagtcacataggttcttttcaatatgcctaatagcagaaaggaatgttaatgagcaaggctcctattcttagagctctatgactatcttactagc

SEQ ID NO: 203152 - DNA, 357 bp, Homo sapiens
tcatagcttactgcagcctctaactcctgggctcaagcattcctccacttcagtctcccatagctgggactataggtatttgacaccatgcctggttaattttttcatttttaaagaaatggggccttgctgtgttgccctggatggtcttgaatgcctggcctcaagagatctttttgcttcagcctcctgagttgctaggattataagtgtaagccactgctcctggctaacacaaatagattttaaaacaaaaaattattagagatagtgagagacatttataatgatgaaagcgtaaattcatcaggaaaatataacgattataaacatatatgcatctaataacaaagcccc

SEQ ID NO: 203153 - DNA, 397 bp, Homo sapiens
ctggagacatcagtgactgtcatgacagggaagatattactggcaaccagtagtagaggccaggaatgcgagtaaacatcttgccaagcccgggacggtcccccagcaaggagtcacttggcccaaaatgtcaatcaagccgaggttgagaagccctgggttcaaccctcatgctggcaactggcaatgaatttctgatttttttaccatggcaaataataataataatgacaaaacgaaaacaaaggaaaaaatccaacttaaagggcagactccaaagggcctgagagggactaagctgaggggcagtcttctcccatcagaaccagcgtcattgtgtgacacgtcgttgactgatgttttgataaccaacaagaggtcaatgtatagaaatccg

SEQ ID NO: 203154 - DNA, 456 bp, Homo sapiens
agtaagtttaagaatggaaatttggtttggtttaccttttatgatgtgtcccttttgccttttatctttttgtgtatttttcttcataggaagcagattcactaatacagtatacctgataaccgtagttgtaaatttcaaattcttattgttccagctggttggaaactgtcttagactgtcatcatgttctttatcaacttggatgttgctcataaattacttcaaaactaatttatactagaaagataaatttctggctaaattatttattgtcctatgattgcataaaatttctttctccaaaatttcgtgtgtcagaactgctatttatggtaaatatttggatgttactgaggcatcaacaggaagaattggtgcatttgtgtctttagcctgcacttacatttgtgacagcctaaatatttcagatatttgtcattgcaaaaagtgaaa

SEQ ID NO: 203155 - DNA, 381 bp, Homo sapiens
ggcaatgttctaggtgttttccctgaattaagaactattatccccattttacagaagaggaaattgagacacagagggcagttggtacatagaagttgttcagtaagtgggagttatttttactattaccttcacctgagtccctgagtagtttccttgttttctccaaatgtgtatatttcttgcacattaggagtcacaaattatggcccaagggtcaaaaccagcctacagacacatttggtttgggctgtacatggttttagtaaccagagattttcacataaaaatgcccttcacatgtgtgcacccacccccttgcccctctaaacttcctaaatcccacctatttttcaaagcaaagatcaagtgccttcccac

SEQ ID NO: 203156 - DNA, 338 bp, Homo sapiens
tagaaagaacacattgcaatctatagatgatccatggcagctatcttcaaatgctgaaagcttgctcatgtagcaggagtctgtgctgttttagaaaacgaaaaagtattaaaacagtgatggtggggatgtaatttttttacatttaactcccaaggaatgtattaatataaataagttgtacagaattatgctaaggaatagcttggttaaagcaactaatattttgaaagatgccctttaagattatttatggtaatttgcttttcaaatctagaagctttagactttttaagaatatagttcaaagtaggtgatgctggaacttgttaacattt

SEQ ID NO: 203157 - DNA, 377 bp, Homo sapiens
tcttccctttcatttaaaaatgtgtttaaatgatatttttagttcagacgttcccgagggttttacttgatgggcatgtgactctaattaacatccaagacccacataattcaatcacagtatgggtcaaaattaccaattcaattttttaatcttaaaattgatttctatgtctgtgatgctcagagtgaatttcagcagtatccaaagcattctatttttccatgctctctgccttatcatactggcctttgctaacactacagtagttatttttgaatctttgaaaagtcagtgtttaattttttagtttacttttcccctttctacctttccagtttacctttaagaaaaaaaacacactgccgttttcttcc

SEQ ID NO: 203158 - DNA, 374 bp, Homo sapiens
cagagaaacatcttcctaagatgtcaggaggccacagattctctctagcctctgcataggagtcatgaccacagtttaacactctccatgcttcatgaattatcagatgaagaggggccttggattcccctggactgaagaggagggtcacatccaaagcccagaccttcctttttttaatctgaatatttttgtgtgggtcatttcagcttagttagcagtttcgaaagggatctgtacgggtttagtatttaatttcttgaaaaagtaaactatttttactttgttttgttttaaaatgtttaagtttttaaatttatgtaattccaaacttacagaaaagtaacatgaacaatacaaggaacacctatatt

SEQ ID NO: 203159 - DNA, 167 bp, Homo sapiens
ggtcgatgttccacataagaagaatatgccttgtctgggtagaaagaactttaccctggcttttaaaggaatgggatacactgttttttctttactacttccatctctctttctcgttgacttctttgtctcttcctctctttctgactctgactttctgtgtctgt

SEQ ID NO: 203160 - DNA, 200 bp, Homo sapiens
tgccagctgtcctgcacccgctgcttttttgtctcacccttgctatctggatttcctcatcctacctgtggctccggctgcacccatctccgctcaccaccagcctcttatctcaggccggcgtctgccttccagcctccagaattcccagatgtgctcaccaccatctctgcagtgggcctgaccggagagagaaggct

SEQ ID NO: 203161 - DNA, 285 bp, Homo sapiens
aacttctgtggtgcataacagagcactctgcacacaattagcaatcagtacatatatttgagggtaatgaatcaacaaataaattaacataagtattaagaagtgggagggagtctcttcagattcttaaagatggtgatagcttcatatttgctaagcagagaaaaaacaaggagaaagctattcaagcagggcttgtagttgagcctgaagatcacaaatcttttaggcaaactcctgcagcttttctctgcagggaagagatcatgagggaaacaaacaaac

SEQ ID NO: 203162 - DNA, 700 bp, Homo sapiens
ccgcgagtttttaattctgccttctttctagttgggattcatgagtgtgcatgtttccacacatgcactttaggctagccaggctcaggcgtcctgtgttttttcatttgagtcttcctattgagtcttctaagatggaatggttacatttattttatgttttcattattaataatattatttctgtgtatactgtgtgccataatatttttataggtaatatcatttttaagacacataaccttttcccattttacagataaaaaaacttaggctcaggaaaggtacatcactgtctgaggaccagttgatagtgacagagctgagattcaactttcagtataacctcttataaaacttagaactaaaggaatttttaaaaattcccaccagtctaagacaaccaccattaccaactttgttagtgtaatgcctgtctcctcccacacccttcaagcagaggattttgttttctttacgtttttaaccaatctgtccttcattgcccctgtgggatggtgagtccgtgccaaggtggtcatagctcccttgcccttctccagaattgctgaggaacatttgaggaacaaatcacagttgccacctttcctggctgagaagtgaggagaggacacccctctcagtaggtgccccaccaaaatagggccctgcatgcacatctggctctcatcctcatcct

SEQ ID NO: 203163 - DNA, 631 bp, Homo sapiens
cgaccggctgtcttctgctgcttgagcggcgcccgcaccttccctaggagctcgcagcagccggctggcctctgctccacggtaaccatgtgcgaccggaaggcggtgatcaaaaatgcagacatgtcggaagagatgcaacaggactcggtggagtgcgctacccaggcgttggagaagtacaacatcgagaaggatattgcggcccatatcaagaaggagtttgacaagaagtacaaccctacctggcactgcaaaaaaaaccgaaacttcggtagttatgtgacacatgaaaccaaacacttcatctacttctacctgggtcaggtggccattcttctgttcaaatctggttaaaagcatggactgtgccaaacacccagtgatccatccaaaaacaaggactgcatccaaattccaaataccagagactgaatcttcagccttgctaagggaacacctcgtttgaatctgttgtgttgtgtacagggcttcattctctgtacaagtctgtggttataaaattagtaaaacagcttacatttgtatttattttctagtccatacttctgtacccccatttttttctcccttaggtcattcctttaaaaataaatctgttggagatgta

SEQ ID NO: 203164 - DNA, 541 bp, Homo sapiens
ctcccaggctcaagcgatcctcccacctcagcctgtcaagtagctgagaccacaggcatgcaccaccatgactggctaatatttaattttttttgtagagatgcgatctggctatgttgcccagactggtcttgaactcctgggctcaagcagcctcttaaagtgctgggattacaggcatgagccaccaagcccagcctcttttttctctcttatgcacctatgtttttaaagtgacacgggacccagttgtgatggcgcagtcctcacacctcacaccttatcccagctatcctagactctgaggcaaggggattgtttgagcctaggagttctagaaaagcgtgggcaatgtagatcccatctcaagaaaaaaaaaaaaacaaaaacctgtggtaggtggactctgggcatttggtcatggaagggtgagctggagacatccagtgtaccagcagctggggagacgagtgtgtgaccttcagagggaggaggttcctctagtggccgggacattttcctggcccatgaagctcgtctg

SEQ ID NO: 203165 - DNA, 401 bp, Homo sapiens
tgaccacttgagcccacccatggggggacgggtactttacatgtgttatatcttatctggctctctctctccaaccctgcagggcaggtggcatctctacttaaccatgagggaacagaggctcagccagcacattgaggcaccagaattcaaaagcccagtatcctcccaggactccatcaaagcagatgtgcagagggcagtagggcctgagccagaaccaacacccctgggggaggcccatgagacctttaggaaaatgagacaggcacaggaaagagatgtctaaagccaccattctgggtttgggaatgtaaagaacttcaaatcagataaatgaagactgcagaagaaagaggaagaaatggaagttgctctctgacaggacatgaatttggcaa

SEQ ID NO: 203166 - DNA, 362 bp, Homo sapiens
tcagtcatttgtttgctgatttatttagcaaacgttcaagatgcctgagtttctccctctttttcacttttgtcttctagtaattcttttgaagcgtgcacatctgggggccaccagccccacagactggccacagactctatttgccacattccctgaaggcgggagtggccggggtcagtggagaggccaggcttgaggggaggtgtgggttgggcatggtctctgaactgcctggactcctctgtaaggacagttttgtgggctctcttcatgggcacctcgtgcactgttggtgaatttctgggggaaggcatcatccgccctgtggctgttgagagcggaactggcttctcttcggt

SEQ ID NO: 203167 - DNA, 594 bp, Homo sapiens
gtgaggatggcaccaagcattcatgagggatctgcttccatgaccaaaacacctcctattagttcccacctccaaccttggggattaaatttcagtgtgagatttggaggggtcaaagatccaaaccatggcattccatccctgaccccccagatctcatccttctcacatgcaaaatacaatcatctttctcatgcaaaatacaattccaatagtccctaaaattcttaacttgttccagcaccaacttaacggttcaaagtctgagactcaaagcaagttccttctagctatgagcctgtaaaaccaaaaacgaataatttttttccaagatacaatggttgtacggtcattgggtagacattctgtgactgcagcagccaggatgtcggagcagcatgtaggacgttccaggactccttgaggtgtgccaggccagctgtgccccgggcctgtctccccaaaccatgctgtcctcctaggtctctgggcctctgatgggagagacagcctcaaagatgtctgagatgccttcagggtcttttcccattgttctgactattagcacctggctcccttttatccatgccaacc

SEQ ID NO: 203168 - DNA, 360 bp, Homo sapiens
tcccaaagtgctgggatgacaggcatgagccaccgcgcccagccaatttgttcaaatcttttatattgtcctttcttcatctttatcctgtattatttttgtgacgatggttcctgatttctgtatcacagagttttgttgtgttagttatggctactatgaatagcatatttaccctgaatccagatactttagtgaaattgattggtaggtttttaaattgttttattcattgtgtgcaatttcgtcctctacaaattatggtcatttaaaaaaattatgtctgctcagttctgggcagccacttcgtgggcagcgctgcccagaagtgatttaattgtttaatttccactttctctt

SEQ ID NO: 203169 - DNA, 2234 bp, Homo sapiens
ctccgacccgggcttttccttcgtaccctgcggccccctccgcacccctcacggagctcctcgggtcctgccccctcccagcgcttgcccgcgccgccccgcccccgtttttaaacctggcgcgcgggtaggtgagcgcgttagcccgagtggatctaggcgcgctcgtaggccggcgccgcagcaaggggcgcgggctccgccggcaccatggagcccgaagcggcggccggagcccggaaggcgcgggggcgcggctgtcactgccccggggacgctccctggaggcctccgccaccgcgcgggccggagagccccgcgccgtggcgaccttggatccagacacctggagatgctgagctgaccagaactggaaggccgcttgaacctagggctgaccaacacacttttggatcaaagggagcctttgggtttcagcatcctgtaagagtctatttacccatgtcaaagcgtcaagaatacctgcggagttccggggagcaagtactggccagtttcccagtgcaagccacgattgacttctacgacgatgagtctactgagtctgcttccgaagctgaagagccagaggaaggacccccacccctccatcttctgccccaggaggtgggaggtcggcaggaaaatggcccagggggaaagggcagagaccagggcatcaaccaagggcagcgatcctcaggagggggtgaccactggggggagggtccgctccctcaaggtgtctcctcaaggggtggcaagtgctcctcatccaaatgaatcagtctctgtctcctgggccctgctctgggacctgcccctcacgttctcttggggacacccgagccaggacactacgcatccctgctgagtgtgcagaggctagaggcttctcgggcagcccctggcctgcacactactcatgacagaaagtcagcttttacttttctttcccctggcaattcgtttttggtgcactcatgcatgcctttgagaaaggattctaggagaaagagaaggtctatgtcaacagagttgttatctcatagagccagttttcaaagctccttctgcattgtcactcactgatcaggtgatgaattcttcctagatagtcgcccactccacctcctacttaacctgagactcattatttagctatttctgcttttgtaaaaataattcagatattaaactccaattttaatctatcatccaagggtagatgtagttgcttagtagcattttggaaaaaaaagaaaaaaaggtttggtttggttttgtgacggagttttgctcttgtctcccaggctggagtgcagtgacacaatctcggctcactgcaacctccacttcttgggttcaagtgattctcctgtctcagcctcccaagtggctgggattgcaggcatgagctaccacgcctggctaattttttgtatttttagtagagactcggtttcaccatgttggtcaggctggctttgaactcctgacctcaggtgatccacccgccttggcctcccaaagtgctgggattacaggcgtgagccactgagcccggccaaaaaaaaatgtatttattaaaaaaaaatttttttaacccgccgaataattcccataagagtaacaaaaaggaccagcctgaccagcgtggagaaactctgtctctactaaaaatacaaaattagccaggcgtgatggctcatgcctgtgatcccagctactcgggaggctgaggcaggagaatggctggaacccgggaggcggaggttgccgtgagtcgagatcgcaccattgcattccagcctgggcaacaagagcgaaactccgtctcaaaaaaaaaaaaaaaaaaaaaaagaaagaaaagagtaacagaaagatagggatttttaggagacaattagataaaaatgtatgtgatgactgtataaggaggcctgtgtgtatgaatttatagggagtagaaccgtctctcttcttagttggtgactgtttggggcctggtattttaatagatgaacactacttttttaattttttatttttttaaccctacccttaacccatgaacactatttttaattaaagtatctgatgtaaaattattttgagtttttaatattttgataaacgtgtattcctgaaactttttgacttacttatcttacatgtggtgtcttcctgtatatagtacattatatcaatttctacttgaaataaatattttg

SEQ ID NO: 203170 - DNA, 2004 bp, Homo sapiens
caaagcccgaggccgcggggaccacagagggacggagaagccgggactcctcacatcccacatccggcaggggaagcccagcagccccgcgccgtggcgaccttggatccagacacctggagatgctgagctgaccagaactggaaggccgcttgaacctagggctgaccaacacacttttggatcaaagggagcctttgggtttcagcatcctgtaagagtctatttacccatgtcaaagcgtcaagaatacctgcggagttccggggagcaagtactggccagtttcccagtgcaagccacgattgacttctacgacgatgagtctactgagtctgcttccgaagctgaagagccagaggaaggacccccacccctccatcttctgccccaggaggtgggaggtcggcaggaaaatggcccagggggaaagggcagagaccagggcatcaaccaagggcagcgatcctcaggagggggtgaccactggggggagggtccgctccctcaaggtgtctcctcaaggggtggcaagtgctcctcatccaaatgaatcagtctctgtctcctgggccctgctctgggacctgcccctcacgttctcttggggacacccgagccaggacactacgcatccctgctgagtgtgcagaggctagaggcttctcgggcagcccctggcctgcacactactcatgacagaaagtcagcttttacttttctttcccctggcaattcgtttttggtgcactcatgcatgcctttgagaaaggattctaggagaaagagaaggtctatgtcaacagagttgttatctcatagagccagttttcaaagctccttctgcattgtcactcactgatcaggtgatgaattcttcctagatagtcgcccactccacctcctacttaacctgagactcattatttagctatttctgcttttgtaaaaataattcagatattaaactccaattttaatctatcatccaagggtagatgtagttgcttagtagcattttggaaaaaaaagaaaaaaaggtttggtttggttttgtgacggagttttgctcttgtctcccaggctggagtgcagtgacacaatctcggctcactgcaacctccacttcttgggttcaagtgattctcctgtctcagcctcccaagtggctgggattgcaggcatgagctaccacgcctggctaattttttgtatttttagtagagactcggtttcaccatgttggtcaggctggctttgaactcctgacctcaggtgatccacccgccttggcctcccaaagtgctgggattacaggcgtgagccactgagcccggccaaaaaaaaatgtatttattaaaaaaaaatttttttaacccgccgaataattcccataagagtaacaaaaaggaccagcctgaccagcgtggagaaactctgtctctactaaaaatacaaaattagccaggcgtgatggctcatgcctgtgatcccagctactcgggaggctgaggcaggagaatggctggaacccgggaggcggaggttgccgtgagtcgagatcgcaccattgcattccagcctgggcaacaagagcgaaactccgtctcaaaaaaaaaaaaaaaaaaaaaaagaaagaaaagagtaacagaaagatagggatttttaggagacaattagataaaaatgtatgtgatgactgtataaggaggcctgtgtgtatgaatttatagggagtagaaccgtctctcttcttagttggtgactgtttggggcctggtattttaatagatgaacactacttttttaattttttatttttttaaccctacccttaacccatgaacactatttttaattaaagtatctgatgtaaaattattttgagtttttaatattttgataaacgtgtattcctgaaactttttgacttacttatcttacatgtggtgtcttcctgtatatagtacattatatcaatttctacttgaaataaatattttg

SEQ ID NO: 203171 - DNA, 1870 bp, Homo sapiens
ctgcttctgggaaaaagcaccctctagaagcaatttaggacgaggttcaggttgattaatggtatatttgtttcttaaatattagagtctatttacccatgtcaaagcgtcaagaatacctgcggagttccggggagcaagtactggccagtttcccagtgcaagccacgattgacttctacgacgatgagtctactgagtctgcttccgaagctgaagagccagaggaaggacccccacccctccatcttctgccccaggaggtgggaggtcggcaggaaaatggcccagggggaaagggcagagaccagggcatcaaccaagggcagcgatcctcaggagggggtgaccactggggggagggtccgctccctcaaggtgtctcctcaaggggtggcaagtgctcctcatccaaatgaatcagtctctgtctcctgggccctgctctgggacctgcccctcacgttctcttggggacacccgagccaggacactacgcatccctgctgagtgtgcagaggctagaggcttctcgggcagcccctggcctgcacactactcatgacagaaagtcagcttttacttttctttcccctggcaattcgtttttggtgcactcatgcatgcctttgagaaaggattctaggagaaagagaaggtctatgtcaacagagttgttatctcatagagccagttttcaaagctccttctgcattgtcactcactgatcaggtgatgaattcttcctagatagtcgcccactccacctcctacttaacctgagactcattatttagctatttctgcttttgtaaaaataattcagatattaaactccaattttaatctatcatccaagggtagatgtagttgcttagtagcattttggaaaaaaaagaaaaaaaggtttggtttggttttgtgacggagttttgctcttgtctcccaggctggagtgcagtgacacaatctcggctcactgcaacctccacttcttgggttcaagtgattctcctgtctcagcctcccaagtggctgggattgcaggcatgagctaccacgcctggctaattttttgtatttttagtagagactcggtttcaccatgttggtcaggctggctttgaactcctgacctcaggtgatccacccgccttggcctcccaaagtgctgggattacaggcgtgagccactgagcccggccaaaaaaaaatgtatttattaaaaaaaaatttttttaacccgccgaataattcccataagagtaacaaaaaggaccagcctgaccagcgtggagaaactctgtctctactaaaaatacaaaattagccaggcgtgatggctcatgcctgtgatcccagctactcgggaggctgaggcaggagaatggctggaacccgggaggcggaggttgccgtgagtcgagatcgcaccattgcattccagcctgggcaacaagagcgaaactccgtctcaaaaaaaaaaaaaaaaaaaaaaagaaagaaaagagtaacagaaagatagggatttttaggagacaattagataaaaatgtatgtgatgactgtataaggaggcctgtgtgtatgaatttatagggagtagaaccgtctctcttcttagttggtgactgtttggggcctggtattttaatagatgaacactacttttttaattttttatttttttaaccctacccttaacccatgaacactatttttaattaaagtatctgatgtaaaattattttgagtttttaatattttgataaacgtgtattcctgaaactttttgacttacttatcttacatgtggtgtcttcctgtatatagtacattatatcaatttctacttgaaataaatattttg

SEQ ID NO: 203172 - DNA, 1936 bp, Homo sapiens
caaagcccgaggccgcggggaccacagagggacggagaagccgggactcctcacatcccacatccggcaggggaagcccagcagccccgcgccgtggcgaccttggatccagacacctggagatgctgagctgaccagaactggaaggccgagtctatttacccatgtcaaagcgtcaagaatacctgcggagttccggggagcaagtactggccagtttcccagtgcaagccacgattgacttctacgacgatgagtctactgagtctgcttccgaagctgaagagccagaggaaggacccccacccctccatcttctgccccaggaggtgggaggtcggcaggaaaatggcccagggggaaagggcagagaccagggcatcaaccaagggcagcgatcctcaggagggggtgaccactggggggagggtccgctccctcaaggtgtctcctcaaggggtggcaagtgctcctcatccaaatgaatcagtctctgtctcctgggccctgctctgggacctgcccctcacgttctcttggggacacccgagccaggacactacgcatccctgctgagtgtgcagaggctagaggcttctcgggcagcccctggcctgcacactactcatgacagaaagtcagcttttacttttctttcccctggcaattcgtttttggtgcactcatgcatgcctttgagaaaggattctaggagaaagagaaggtctatgtcaacagagttgttatctcatagagccagttttcaaagctccttctgcattgtcactcactgatcaggtgatgaattcttcctagatagtcgcccactccacctcctacttaacctgagactcattatttagctatttctgcttttgtaaaaataattcagatattaaactccaattttaatctatcatccaagggtagatgtagttgcttagtagcattttggaaaaaaaagaaaaaaaggtttggtttggttttgtgacggagttttgctcttgtctcccaggctggagtgcagtgacacaatctcggctcactgcaacctccacttcttgggttcaagtgattctcctgtctcagcctcccaagtggctgggattgcaggcatgagctaccacgcctggctaattttttgtatttttagtagagactcggtttcaccatgttggtcaggctggctttgaactcctgacctcaggtgatccacccgccttggcctcccaaagtgctgggattacaggcgtgagccactgagcccggccaaaaaaaaatgtatttattaaaaaaaaatttttttaacccgccgaataattcccataagagtaacaaaaaggaccagcctgaccagcgtggagaaactctgtctctactaaaaatacaaaattagccaggcgtgatggctcatgcctgtgatcccagctactcgggaggctgaggcaggagaatggctggaacccgggaggcggaggttgccgtgagtcgagatcgcaccattgcattccagcctgggcaacaagagcgaaactccgtctcaaaaaaaaaaaaaaaaaaaaaaagaaagaaaagagtaacagaaagatagggatttttaggagacaattagataaaaatgtatgtgatgactgtataaggaggcctgtgtgtatgaatttatagggagtagaaccgtctctcttcttagttggtgactgtttggggcctggtattttaatagatgaacactacttttttaattttttatttttttaaccctacccttaacccatgaacactatttttaattaaagtatctgatgtaaaattattttgagtttttaatattttgataaacgtgtattcctgaaactttttgacttacttatcttacatgtggtgtcttcctgtatatagtacattatatcaatttctacttgaaataaatattttg

SEQ ID NO: 203173 - DNA, 531 bp, Homo sapiens
gtggctgttcttgagttccccttatgttctgaccaccgtttaaccaccagccgggttcctgcttatcttgcctgggccgggcacctgtccccagagacagagcaggagagaacaaaaagggatactggggagttggaagaggaaatgagagagcaggtgtgcatagtaggggtgggaaggaagtggatgggacaggactgggcaggcatcattcaagagacgggctagggtgcagatggagatgtaggagcaagggtgtctatggcccttagagcactttgctattcagaattctctatctgggcatttttgtggagaaatgggtcatggtcttcatcagattctcacatagccagtaacccaaagaggttaggaagatctaagttagtcataggggcaccagaaaatggatgggattgtccagagggagtgaatgagaaagcctacggcagggaaaagaacatttaagggatctgtgaagggcctaatgtcaggaggatgagtgtggagcacctcttcagaaagggtctg

SEQ ID NO: 203174 - DNA, 422 bp, Homo sapiens
agcatgacttgtattgattgatgtaacccttcctacaactctaagcagtacatactattatcatcccaatttcccagatgaggaaaatgagaaacagagaggttaggcaacttgcccaaagccagacagctagaaaatggtggtgggggagtaacaacctaggcaccgtggctccagttcatgcatccaaccacacactatgctgcctccccaaccacgcactggttgttatggacaaagataccgaacaaacacccacaatacaaaacaaaaaagtcctacaagttttggggaggtacaaaatatattacttttataccacatagagttttcggactagtttgtacagaggtgcatttggtttgggtcccattatttcccccaagatgaactggctgtgtctcttaataaaaaagcagaaa

SEQ ID NO: 203175 - DNA, 232 bp, Homo sapiens
ccgtcaatggcattgccagcttctgaaaatgtgcacctctgactggtgaggcctgcttcacacacctgctgccaagcgaagggagacagactaggaaagtaaattcctgatggcaccacctacccgcttcagccgggacctccctgcggctttaaatggcaccctggtcagctcctagagagaggccattgaactggacttggcaggggaaatagtacctgaagcaaccaaa

SEQ ID NO: 203176 - DNA, 336 bp, Homo sapiens
gaagcatagagatgcccaggatctctatatctctatatctagagatcattctagtctaccctcatttggtaactgatgaagattaattgaaaagggatttgcagtcacaggatggcttggcaaactccaaccgttaggttcatcttaatagtatatttgtttgtattattattacacctttgttattaaatgctgactgtgtctagcccaccaagcctgcctcctggctcagtagcctgagtggaacaggcctcggcacagaggaaggagaacctgcccggaaaaaaagagtgggtggatgtcagtgagggtctggtgtctgtgccgtgaatctcc

SEQ ID NO: 203177 - DNA, 240 bp, Homo sapiens
taacggacctcaggctatccaaatgatcacaacttcctaattaggaaggtctgaattaatgaaggttcaagattgcctccttgggggctaatgtgtatgcaagctgcgacccactggtaacagctttactatttactcttccctgccaggggattagtggaatctaaattgaacagttaggtatttaaaaccactcatgtggttttaaccactaaaagggttgttaagcaagtcttcttt

SEQ ID NO: 203178 - DNA, 558 bp, Homo sapiens
cctggaggaggcggcgccggggcgagacctccagagcgcaaggccggcgggagaaaagctgaggaagtggaaatctgtggctggagctcagcagggaggatttcttctccacgctgtcctcgagggccgccctgaacatgttgtagtggagcttccgtctgtcttcagcttccgtcaacactgaaccagctcatctaagcaccagacacaagattttactgcttttgtcaggtggagtgggaagtcgcacccacgtctggccagttgggtcggctgtaactcagactttggactgacttgtcacccagctcatatagcaaggagttcctgatggcagctgggggagctgacatcagtgtcagctcagactcttaggcagttacctcaatcctcccaatagttcctaatccttacacaatatggagccaagtccctaaagatgctcattggttcacagtattagacttaatgcctaattaaggatgttttcttgtgtatacctttacacctggactcccagtatatttttgcttttgaatgaactgatccagacactca

SEQ ID NO: 203179 - DNA, 1791 bp, Homo sapiens
  misc_feature (1)..(2): n is a, c, g, or t
  misc_feature (4)..(5): n is a, c, g, or t
  misc_feature (463)..(463): n is a, c, g, or t
  misc_feature (512)..(512): n is a, c, g, or t
nngnnagagaggtgttaactgagttgagcgttaaagaatgggtggcagttttgcaggagtgaaagcagaagctcagagaacctggtgtgtttgagaggaaggtgaaaggatttttaatgcacctgtgagccaatttttggtttctgaagaggaggaaggatgcagagtaaaaggaaatgtaaaagtgttgtacaccagctctcagtaaccttagaagatttatatgatgctgcaacaagaaaacaggctctgcaaaataatgtgctttgtgacaggtgtgaagacagaggtggggaaaaaaaaaaggaacagtacagtgctgtcataattgccaaggtattggaatgcaaataagaattcatcagatagaacccggaatagctcagcaaattcaagctgtgtgcatggagacccagggccatggggaacagatcagtcctcaagatagatgtaaaagctgcancagaaagaagatagttttgggagaagacgattctagaaattcatattgncaaaagcatgaaagatggccagaaaataacatctcatgatgaaagagaccaaaaaccaggactggagccaggagatattatcattgcattagatcagaaggaccatgctgtttttacttgacaaagaaaagaccttttcatatgtatggatatacagctggttgtagtattgcatggcttctgaaaaccaatatccactcttgacaactgaaccatagtcatcatctctcatccaggtcaaactgtcaagcatggagccatcaagcatgtgttaaatgaaggcaggccaatttattgtagaccacatgaagagtcacttaatcattgaatttaaggtaaactttcttgataatggctttcccttttttgacaaactccttgctggaaaaactcctacaaaagagtaaagaagtagaagagactgatgagatgaatcaagtagaatttgtggactttgattcaaatcaggaaagatgatgctgatgccactacagtgcagaagcaaatgtgggaccattacaatggaaaagcatgaggatgataaacatcatttcagaggtgttcagtgtcaaacatcttaatgggaccagtgataatactcgctgctggcattttatgggcagtagtgaatgagcaagggactgtaatcctaatatgctcactacttgctattgttttggttttactattcaactagagtagtgttttaaaaattaaaggaagaataaatacaatttttttaaaagttgacaaggatgagcatggccaacaaacctctctccactttggcaacaaatagttttaaatttggtttccagagtaagttaatagaaggtataacacagagaaccagaaatacaaagtgctctattagtgagatatcagaagtgattattgctgattattatctgatattttataaaacaatctcttttgagatattaaatatatactgagattcataaaacggtagatacctaaattatctcatttagtaaatcagtggggctatttaatccagataatttaaaccctaagaataattttattttccagtagattgacttttacttattttatttattttcttttacataaactcagagggaattaccctttttaagaccatgtcatttaatatttccagttttaaaaagaaatagagtatttggcataatgaatgcctattttactatttgtctttatgtcatatgtaatttttcctcttaaagtttattttaaatgtgtttcaaagtccaataaagggaaccctaatcca

SEQ ID NO: 203180 - DNA, 325 bp, Homo sapiens
tgattctatagtaacagtttagttgagaaaataaatcataatttgtgatttcaaacatttaatatgtgcacatgtatattataatatactcatcctttatatttatcatgcttttttgaataaatttgccaccttattgcatatgaagaatatctccatattcttacagctgtttttcttggttgctttctaattcctttcctcccttattggttacctatgaattgctcagttctaacaatgatttgtaaattttaatactatagatatattgctgttaattattacacctaaaaataaattattttacagaggctactaagaa

SEQ ID NO: 203181 - DNA, 625 bp, Homo sapiens
ggcaacagctatacccgtcagacagctgtcccaggaacagcatataacaggagatcagccttgacgtgatacagcttattaaaccgctatagccgtcatacaggcatatacagacatacacgtaaatatagagactaacatttgctaaaaatgctataattgtagacatcttaacagatactgaataccaattttaaaacctgtaataaagtagtggctctcagggagaaaggcagggtgggacagaggaaactaggtgtggctttagtgagtgtgcatggacaagcaggagggatcctgtggtgatgggaaagttctgcatcttgaccatatccacgtcaagatccttagttccaccattgtagtacagtcttgcaagatgtcatcattcggagaatctgagtaacccctccgaatgatctaaaaatgaaaagttaaatttaaaacactgataaataagaattttgaggtatttgctgatacaattatatactgccttaactttcaaatccctatgcttttcttaggccaaccagttctgcctcttctgtgtcagatgttgactttcccaacgttcctccagctgaggaaactcatctatgcaccaaaactttgttattcacgt

SEQ ID NO: 203182 - DNA, 467 bp, Homo sapiens
aggctgtatatctttctggaaatcatcccataggtatcatttttcataactgggcttcgataagaacagggtacagtaagttcaaggttacattttctggcaagatcctaaaatgtaattatatgatgattaaagatgaatttgcatactttggcaattcaaaacagaactcttccacaggaaccgaaggtttaattatattctattcaaagtgctttgaggtcttttgattaaagcattgcctagtattgaagacagagataagatggccacactgatcctagccaagtcagaataattgctcataatgtagagtagactttaacaattaaactaaggccgggcgccgtggttcatgcctgtaatcccagcactttgggaggccaaggagggaggcttgcttgagcccagaagcttgagaccagcctgggcaacatggtgagaccctgcctctacaaaaaatattt

SEQ ID NO: 203183 - DNA, 728 bp, Homo sapiens
actgtctgaaatgtgtatgccagatagagtcatattatccattgaaactgaaattttaaaaaaggatcaaaagtagtattgtgagggaggtcttcaagagttctactgggtaaagcaagcaagctttagttctttcttgttcgcttcattcattagccaatagcatgttttcttctgccctgtttttgggttgttcagataaagtgataccttttcaggctgtgataggcatgctttcttttttctttctttttgtaacatattgataatgtgtttactatattatggtctaaagcaggatttcatagactttttcatttaagttaaacatagtggcaattgatgagtattttggtaacagctttatttgcaatgctttatgcctttaaaggttatagattactgcatttctcttttccttggagaaactgcatagcaaagttccccagattttcctgatttccatcttccattggaaaacaagttcaatatccacaataaaacaaggaagctgaatactgaaaaattaacttatttttaaggagtgatgtgaaccagactgttctgaggtttacgactgcattgtatgggaacaaaaagaagcaacggtgtcattgctgtggcaagctgtatttaaatgatgccttttattttttcaagatgtgtcgtcagactcagttgtgaagattatggaactgaaacaaatgggaaatcagtctctcctgcta

SEQ ID NO: 203184 - DNA, 180 bp, Homo sapiens
aggctgacttgaggacccgaaaatgacatataggaggtgattccatgatttttttgtcacctatgcatttcggcatctttcagttgtttaaggcagttctctacagaagagcccatttgccgttgtgcttcctgagtgcagaaggcaccctcctgtcttcctcctctgatacctgctttc

SEQ ID NO: 203185 - DNA, 183 bp, Homo sapiens
cgtatctgtgctgtccctttctgcggacagagaataatcttgccaaacatccaaactgctagaagccaaaaaagaaagaagcaaaatggacaagctgattccatttcctgtaagtggttagttccctgctttgttaaatctcttacatgtatcactgctaatgcctctgtccagggtggtatg

SEQ ID NO: 203186 - DNA, 411 bp, Homo sapiens
  misc_feature (43)..(43): n is a, c, g, or t
ccaatgtcttatctttcttaagtctagtgtacttccatatttntgaagtaagaagtaataatctcttaagaagattgaataaactccaactgaggaggaaatatttcttgttagagtaatctgagcgcttaattgacatatttggaattaatcagaaaggctaatagttatataaatatattggattgtttgtgtgagactaattcttggtaaatgaacatgaactacaagaaatggtcgacattagtgctgataaattctgaatctttacatgaagaatatgtgtcacagctgagtgcagtggctcacacctgtaatcccaacactttgagaagccaagacaggcaaatcaccagaggtcaggagttgaagaccagtcttgccaacatggtgaagccctgtctctactaa

SEQ ID NO: 203187 - DNA, 364 bp, Homo sapiens
agagaactgaagttacaggaaaaaaaaaaatacagaaatctaaaaaaatggtaggtgcctgcaggggaaaacagaatctgagcatttgattactgggacaaatgccatgaaaatcaatataaaagcaggtagaaagatttaactagaaattacaataaattgctaaaggccaagtgtgggctggcctgagaataggaatcccctcaggtttcaaatatgggggtggggttgcagccacctgcagctgttatcaataggaagccacaggaaagatcagagatcacagagaaagacccctttggtactatctgggggaaaggagtagcagctatggctgaaaatctgccccaatctacctttctta

SEQ ID NO: 203188 - DNA, 262 bp, Homo sapiens
catttaatgaacaggcattgggtgtgtgtgtgagacaagaatgagtttttggtggatcctttagaacattacagttgattgccaaaagtctcattttatcaggtacttatttttgaattggtgacatttcagtgtgactgtgtagtagtacttcacagttccaactggatattgttctttgattagatgaatatgtcatgttaaggtttcattggtttatttatacttgggattaaataggattattgggcaacctaaaata

SEQ ID NO: 203189 - DNA, 444 bp, Homo sapiens
aggtagtcaatatatcggacttggacagtgcccaaacaactattacaattcagaccatgatttctggcccaattctggaaaagtatttgctttccaagataaaaatctgtttggcagaaaagaaatgtttgttttaaaataaaatccatttggttaataattatccacccagttttaggttgctttcctcatttctgtaaataaattttcctacattgcctctcccagtgattgatgaaaagtggacttaaattttgaggaaggaacctgaagaacatatccaagtcctcactaccctgtttggtaatagttgcatctaatgtcttctatttttcttcctgaattaactagatagtatagtgtgtaggaagtacaaagcaggtattcatcaggagttacagagatttaacatgggtcattaaagtgctgtatgttggcctaatt

SEQ ID NO: 203190 - DNA, 172 bp, Homo sapiens
tagaaagtgatccttgactgagtgtggtggctcatgcctgtaatcccagcacttcggtctcagaaaaataaaagtgatccttcaccaaaaacagaacatgctggaaccttggacttggatttctagcctccagaactgtaagaaaataaatttttgttgcttaagcaaaaaa

SEQ ID NO: 203191 - DNA, 197 bp, Homo sapiens
tctgagccctcgttgcaagttggggtgggggagagaggatcctggcagcagagctgtgccctctgagagtgactacatgggctgtgtgcttgggcaggcacaaaaacatgggcacgaggttactcaaggcttggaggggcagtgggcggccagggtgggtttggagcgtctgtctggggagctggctggggagctca

SEQ ID NO: 203192 - DNA, 425 bp, Homo sapiens
ttactgaactcaagaaaatattttgtaaatttttacaagaacagtagcatcacaccaacccaaatcactacatttcttatttttcatgctcaaaacagtacatttgtctgacttgttgatatcatctggctacttgatgaaggtaaattttgagatttgatcctggagagaagacagttttctacaaagtaaggtctatatagtttcagtcctgggttagaaaagagcaacagcctcctgattctattaaaaataacactttcttgatgtattttgataatccgtaaaacactactctgtaagtactgttttagacagttagatataaagaaaaacatacattaaaacattcaaactctgtttaatgctttttactcacacactaacagtccaacccagtggttctcaaaatgtagtatctaaac

SEQ ID NO: 203193 - DNA, 622 bp, Homo sapiens
aagcagttatacagactcagtatagtctcgtccagtcgcccaggctgagtggtgacgcgatctcggctcactgcaagctctgcctcccgggttcatgccgttctcctgcctcagggtggggccctgccggcccctgcactgctggctgttgtggacacagccctttctgtggggctctatatacaagagcactttccctcgcttctctctttgggtatccagtaagagcatttgtatgtgaggctgttgagagaaatttcttgtttttttaagttttagttctgccttatgtaaatctctgtaaacttttccatgtaaggaaagtgtgtctgagtcaggacccatctgcagtttttctccctgcaagcatcgtgcagccagccagggtgtgggcagcctcagtttccccatcctcttcacagtggagtggcccctcgctgtgttgtccacagctgtggtggggaagcctggttggttcctggagccgggacagtttgatggcacagcagtggggtgcagggctgcaccgtcatgactggaccatttctgggccttgtcatctgctgatgggagcctcgcgtgggcctctgccgcactcaggaatgtctggcgccctttgagg

SEQ ID NO: 203194 - DNA, 420 bp, Homo sapiens
gcagatacttactgggtgctggctatggcgagacacttcgttgggtgctgggaagacaaagaagttaagacacagtatatgctcagcatactaagtgttcatcagaagagataaaccactaaccattatgtgctgtgacaaattaatcacttttggaatgaataatgtgctgggggagtagagtgctttggctggagaaaaaactgatagggaacatgttgagaagaaggggatggagcttagctctgagggttaaataaaatttcgccacatgtagaggtggaagagagcattccaggggccagcataagcaaagttgctgaatattaaaattaaatagcgcttttggaaatatcttgagttgtttcttgtgggcaagagaggggagagggctgaactcatctcaagaacccattcctg

SEQ ID NO: 203195 - DNA, 845 bp, Homo sapiens
gtacaatatccaaccctttttaaaggaaggaacattagaaagtatttccctgaggctttacgattacacttggggtatagaaatggcaataatcctggcaggctcctccctcttgctggaattattttggggctgaaggaagggagacactgactatttttcctctacctttcaactcatcaacatatgacggctgatggtagagttttaagcctgtgatttatctgctagcatagactgtttcaggcaagagtggaaagtgttgggggtgtcctaaatagaaacaatgatagggtgtcagaaatctagacaagttgtatattattagtgctggaactttttcttctatgggtcagaaaaagaaagctgacttaaataagttttgctattgaggaaaataaaaattgaatgattgaatgaatgctaaaagatacctgaagttttagtgtcctagaattttcaagcaccgaaagaaaaagttaaatatattttttgatagagagatgagagttaacacttccttggggaaattaggataaatttttctatttttcccccctcacactttgcaaacacattttatccccacttcaactctatgaaggtataagtatcactattcttacttgataaatgagaataccaacacctagagagcttgagtaatttgtctaagagcacatagtggcgtttgctgagatttgaacacagattatctgactaaaggtggtgcccttgatctgagcacatataatagtggttcttaaagtgtgagaattgtggactggcagcatcagcatcacctgggagcttactagctcaggcttcatcccaggcctactgga

SEQ ID NO: 203196 - DNA, 515 bp, Homo sapiens
tctgtcagaagaatgttcatggtagctttattcatagtagccgtaaaaatggaaacaacctccatgtctgtccacagtagagtagataaattttagttcattcaaacagtggaaaactattcagcagtgacgaaacaaatgcctgctataagcagcaacaggtgactctcacagataccatgttgagtgaggagccaaaatcaagaaaacacaccatttatgtcaagttcagaaacaggcagaatgaaggaatcgagatgatggaagtaagaatagtggttatttggggagaacagggaactgtcaactgaaagtgtgggacccacaactgcagatttctctttctgtctgttccaggacacaacctcagctttagtttctctccgaagtccccctccgttttccaaaacaattgactcttggtgcaggcggatttccctgggccccatagatgagagtggatgcctcctctgggctcctggaggaccaggaacttccccttggggccacttacc

SEQ ID NO: 203197 - DNA, 540 bp, Homo sapiens
cgaacatgaggcaggcatgtctggtaatgacaggaagtcaagaaaacttttcaggggattgggaagcttggctgataacagatgatgagaggagtgggaggagcggcaagtggtggtggagtgaagcagtttttttcctttctaggtgtataggacatgggtacattagctaagaagtccaaaatccatgaggttatttgttgactgggggggtgtgtgcgtgcgagagagaaagagatcacatcatattgttaacagccgcaataatggcatattttatggcaggcactgtgcttttcactcattatcctgtttggtccttttaagagttcaatgaggtaaatccattttatagagaaaacaggcttaaggtgattaagtaacatccccaagctgaaatagctagtaaatggtagtggtaggatttgaacctttgtttttgatcattaggctatagttcaagcaagtactatagaactatttatcgataagatatggcctcttctgagaaggcttctgtaaccatcctcccctccctta

SEQ ID NO: 203198 - DNA, 550 bp, Homo sapiens
gacactggatgatatggttttgctatgtccccacccaaatctcatcttgaattgtagctcccataattcccatgtgttgtgggagggacctggtgggagatatttgaatcatgggggtggtttcccccatactgttctcgtggtagtgaacaagtctcacgagatctgatggttttataaggggtttccctctccacttggttccattctctcttgtccaccaccatataagatgtgcctttcaccttctgccatgattgtaaggcttccccaggcccgtggaactgtgagtccattaaacctattaaacctgtttttccttataatttacccagtctcgggtatgtctttatcagcagcatgaggacagactaatacactggatatcaggtaactaggcacaatgatttctgagaatgtggaaaataaagtgagcctgcaattaacccagcttcctttcttgagagggtttccaagctacagtatggacaagggtacccaggtggggcctggcaggctcttcgagttgggaagacagagctgagagtcc

SEQ ID NO: 203199 - DNA, 399 bp, Homo sapiens
catagcaggaccgtttacatttcctctgctcacaggtgccgcccacaccttgcttcctatttcatgtcctcctcgtctctgtagttgagggaagagtattccattcaacagatggaaacaccattgcatctgactgccatgtctttgaaacctgccagaccaagtcttgactttcgttttgttttttttggtggagctgggaggagacagatgggccatacagtctatgtgtgggtgccttggtgtgggacacaagaaagtgaggcaggacgtggagcaccaggtcatcagagctggcagaggctgctccaccgtgcaccgaagacttggcatgtcagtggagccaggaagtctccgatgcagaagcggaagtcagtgtggccacaggagcgaggtggc

SEQ ID NO: 203200 - DNA, 368 bp, Homo sapiens
tgttgggattagaggcgtgagccactgtgcctgggctccaggctttttctatcttgatgctccaatatcctatgatgatgccctcgttcccatggttcacagccatgacacaatcccagtaggtccacttttgtcctggaatccttggaacctacacccaaagccagtttaatttcttttgggtacctgaactgatttgaggaccttctggaccatgtaaggcagcttgagtctggtatggatttatagaattaatcaagttgaacaatttctcactgcttgtctaatccatgccttaccctcaagccttctcaagtgggaaagactaataacttagccttagttgggtatgtatgacaagaatgcca

SEQ ID NO: 203201 - DNA, 351 bp, Homo sapiens
aaaaatattgtgtcatgaaaacgagaaatctgcacttaaatagcaccctaacattaaggtttggcccttcaaaccctatacaaattaaatctataaaaaggaagaaaactataaatcatcaactttaaggaaatgcacattgcaattcccatgaaataaattcaggctttcttaacataaaatattctctcttctgacttaattcttgtgcatgcagtaataatttcctcatcaagaactcagattctgatgtcagactgctggtttaaatccctgttctaccattttctagtagcattacttcagcaaacaactaagctctctgtggtctcttcactataaatggggaca

SEQ ID NO: 203202 - DNA, 639 bp, Homo sapiens
cgaaccaatcactaataagaggggtgagctcacactagcaggctggttgcaaaacctgccatagaggaagggcgggctgggtgctgggattggaaccaggacacacatgccactgtatctgcattctcttcctcacttgttcactccccacctctagatctgcgttattcattctcttatattcagtctgtctttctgctttgtattctactggacaggaagcctggccatcacagactgctgagcaatacacgtttcagtacaggcccccagagagagtcaccgcatgttctctcagcccgagtccaaaacaacccgaggagtggaggatgtctccctccggactaaccggggccgaggaaagggttcttttgacaggctcagctgagtcagatgtcccccacccacccccggccaatcagctacaggcagggatgaagtcattgctccctctgtcccctgcctctatgtcattttcgaaaatgacatagaggcagggtgatcacgaggtcaggagttcaagaccagccgggcaaacatggtgaaaccccgtctctactgaaaatacaacaattagccaggtgtggtggcgtgtgctgtagtcccagctactagggaggctgaggcaggagaattgct

SEQ ID NO: 203203 - DNA, 260 bp, Homo sapiens
atgattcagagactctgggacccactcagggaacagatgaatgtataaatgaatgattatttcttgcttggattacagcaaaagacttttggctggtcttattgcttactccccaccccctttgttttgtctcagtccggcaaccagaatgaatttttttctttttgagacagagtctcactctgtcaccgaggctataatgcagtgtgatcatggctcaccacagcctcgacctcctggggctcaaatgatcctcccac

SEQ ID NO: 203204 - DNA, 552 bp, Homo sapiens
ttattctgggccgatttgagtgaccatggctcagggtacagtctcaagagatcctgagaaagtatgcccaaggcagtcaggttacagtttggttttaagcattttagggaaatagaaattacaggtaaggtatacattggttcagcccaaaaaggcaggacatcttgaagtaagggcttacaagtcatgggtatgttttaggaattctttagttgccaattagttgaaagagtaaaactactgtctaaagacgaggttggtagaaaggaatgcttaggtgaagattagaggatggtggaggtcaaggttcttgttatatacataaagcctcatgggtagcaggcctcagagagaatgatggtaaatgtctctttttagaacttaaagtcatcagactctcaattaatctctcctagatgcaggaaaggcctagaaagggaaggcccagttgcattaacagagattctctacaaatgcaaatttcccccacaaaagatggctttgcagggccatttcaataggttagcactgtggcagccatctgaaaatacg

SEQ ID NO: 203205 - DNA, 319 bp, Homo sapiens
ctagaaatagttttatatatttcatacagttttctagtaatttgtggtaggaggtgaagtctggtgctagttactccattatagacagaatttgaaatttctagatttatattttaacaggatcactttggttcctgtgtttagttgagaataaatgtcctatgtacgctttgtaaattttactttagttccttggaggaaaaacaaacacagataaaatggtttagagcctatttgcgatttttgatgtatattctgaggaatgaggagagacaggtgttcatgctttcatggctttgctattgctatcacataggga

SEQ ID NO: 203206 - DNA, 588 bp, Homo sapiens
tccccaactgctgttgctactcctgcctctacatagaggcaggaagggcacatgcaaaggcacagaagccacagggtggatccagtactctggaaactcccaggagttgggcatggcaggtgcatcagacaagattcggggataggaggagaggcagtttcccatcttggaggagtcttataggagtctcatgggagacaggttttcagacaaaagtcttcaggagtctgattttgtcatgctaaaatgtaaatgtatgaattttgcatgaaaacatttagaaggctctgaaagattttaatatttgatataatcagtttttttgtttgtttgtttgttttttgcaggggggggtggtgggtggacagagttttgctcttgttccccaggctgaagtacagtggcgcaatcttggctcactgcaacctccgcctcccagattcaagtgattctcctgcctcagcctcccgagtagctgagattacaggcatgcgccaccacgcccggctaagttttgtagttttagtagagatggggtttcaccattttggtcaggctggtctcaaactcctgacctcaggtgattcg

SEQ ID NO: 203207 - DNA, 211 bp, Homo sapiens
acagggtaatgagctgagaaactgcccaggagcttccaagttcagtgagacagggtattaatcctatattggatagaccgggccaagtggctcacacctgtaatctcagcactttgagaggccaagggggtggggtggggggtggggagtggattgccaggtcaggagttcgagaccagcctggccaggatggtgaaaccccgtctctact

SEQ ID NO: 203208 - DNA, 640 bp, Homo sapiens
ggcacatgtggcaagcagaggctctcagtatagggagagggcacagaggcagagaggctgcggcgcacatgatgcgcagtgtggcccacatacacgtggagacacttcccatacacagtatgatccacagacacacacagaaggggccagaaagagggggagtcaggcacacatgaggaagagccacacacagtcagagactggaagacagaagtaagcagaaagaagacagagatggaaagtcacgtagaggtgacagagcctgagggtccaagggatgagaaggatagtctcagttaaaaacaaagacataaatagagagaagcccacaatatagaaagggggggataaccagatgaactagtaaagagggacagagaaagaagacaagagagcaaaatcgacaggaaaactggaaaaggaggaggagttagacttagtacagaaatgatgtgggaaccgaagcaagagaattccaaaggccaggttaaaaaaaaaagagatggaaaccaacacccaataaagtgcattagtgtggggagtggaacattaataaagaacattttagcttcataaacaaaaatgtgcgtcatcttcccagtcactaatactttctggttgctgcccacctacccctccc

SEQ ID NO: 203209 - DNA, 493 bp, Homo sapiens
agggcacaaatttccctttgtgaagttgtcacccccagactccctcccttctcccacaggagcaagaggaagtgagatgactcaccactggggacactaccgacttgaatctgcataaacaaacctcacgaaatagccccgtcttccatcagtttcccccatatatttaccgtcccacaatttactgctcctagaagcccgaagccttttcctttgtcttgtcatttctcaaatcatgtattgctttctgttaaaatggtatagaagctcttaggcttaaccatttccttgggctttcatttcttctgtgagattcccctgtacatgtaaaaattaaaatattgacatcaagtgcaagtatggccttttctcctgttaatctgcctttatttcttattttttgagacggagtctcactctgttgcccaggctggagtgcagtggtatgatcttcgctcactgcaacctccgcctcccgggttcaagtgattct

SEQ ID NO: 203210 - DNA, 392 bp, Homo sapiens
ttcttttcattatctacctagaccacatctaaatggtattgggaagcatgccctccttagggggctgtatgggcttcagaatctgccacctgcttgcaggaggttgaatgccagaggttgttttaatttcaaacattctggcaggattctgtaaactatatgtttggtttgtccatccatttcccttaacatttagaagcatgaaaagaaaaatatttggtagacatctaatgtgtttacttctagtcagtgtctcatgccagtatctgtttttcctatacacagttaccagcttgtctcatttctttgtccttatgcatctgcctctctcacctctgtggcagctatgtggaggccatctgaggcagactggttcaaaggctaccttcatt

SEQ ID NO: 203211 - DNA, 475 bp, Homo sapiens
tgggaagagcaggtgacagttgcagactggggcaaagctgtgtctctggatgctcatgggggccggcctcctgagacccgcagagcccaggctaccccacttgcgtgggtcttgtgtctcacagcgcctcctgccaccccataaaagaggatcaatgccctccaggctaggctgctatggggaggtgcaaaaggaaagggcctcccaagagaggggacaaaacagaaagtgagacctgcctgcccagactttcactttcatagcctcccagcatcatccaggtggcccgtagtccccaggcccacgtgggttgagccactgcaagcccaagacctggcccctgcatccctgatggccagaaggaaggaaaggtccccgacggcaggtgacccatggcagagccagaggttccctgtgcctctgggactgggggggcacagattgagagtgggtgctacgtggggttatgctggga

SEQ ID NO: 203212 - DNA, 391 bp, Homo sapiens
tctggtccaagcatggattttactcaaaagggaagacaagctcaaagaggtgctcaatccacccaaatgcacacggccttctcattcctctggtcagccagctataaaaccaaatgaaatttctccacttactgcacaaccctgtttgttttaagagattttattgccaattaccactgggagatctagagacgttaacaaaatcacgaacaatgggggaacaagaacttgtaattaaaattctctgtttttgttactcctgctcttcattcaaatgtcagtggagctaagtcagtagcattcttttctttctcaaatgcttgtcttggtggcctctggggaggtcattcctgttcttgtctcaggaatcaggcctgcactaccttccatg

SEQ ID NO: 203213 - DNA, 359 bp, Homo sapiens
catcatagtttgtaaaaaatgcaagcttggatggcaaaagaagggcatgtctagaacaagattaaaaaggcctattaggaaatccttgtggaaatcatgtacctgtcaaggcaggcatggttgacagtatttgaatatctaatagtaaaagcctatcgtataccacctagcaggactagagggataaatgtccttgatcagatcacaaaaccaatacaggagaaagacctagatgtggcagggggtttcaacctttctggggcaactaccacaggtctattcgagaagtaccatagtaatagaattaaaagctgctatgctgacattataatgtacccagaaggaaaaaaaaagcgaga

SEQ ID NO: 203214 - DNA, 384 bp, Homo sapiens
ccatccctcattcagcaaataatgagtgctttctgggtccctggcactgttgtagctctaggtataccatagtgaatgagacgaatggtgtatctgctctcatggagggcaacattctagcaagactgtattttcactcaggctccaggactccagtttgttcttaggtagataccaaaatatttcgtaaaatgactttctgtttacctaccgtatctcccttcagaaacaaaaaatgtaaatttggtatgacttgttctagtacaaccaggagtatatgaatgaataatctgtttttatctagggattcacattaaatgagttaatgtataataaaagtgcctggcatggcatctgactgaaaataaacatttaatacacgtt

SEQ ID NO: 203215 - DNA, 598 bp, Homo sapiens
agaattttgaagaaactacaacctggtgtgctgtgtaacaaagtctactattaccacaatctgtattcttgttctttgggcacacagctaggtcagatttcctagcctttcttgcaatgaagtaggctatgtgactgagctttagccagtggaatttgagaggaaatgatttacaccacttccaagtcaggcacaagcaagagcctgtcctttcagttgactgtactgaaagcgacctggaaggctacatgatgaaaataagaaaacaggccgagcacagtggctcacctgaggtcaggagttcaagaccagcctggccaacatggtgaaaccccatctctactacaaatacaaaattagctgggcatggtggcggatgcctgtaatcccagctactcgggaggctgaggcaggaggatcactttaggcctggtgtgttcaagatcagcctggtcaacatagtgagacactgtctctaccaaaaaaaggaaggaagggacacatatcagacagatacaataatagatgtagtaagttaggacgtgacaattctacaggaaaagaagtactgggttaaaagtgctaggcttacgtggga

SEQ ID NO: 203216 - DNA, 241 bp, Homo sapiens
atagtatagtttgaagttgggtagtatgatacctccagcttaagttctttctacttatcattgctttggctatttttcatgtctccaaggtcgacataaaaaaaaaaaagaaagaaacagaaaaggcagctagagagaaggggtaaggccacttacaaagggaatcacatcagggtaacagtgaacctttcagcagaaatcctacaaggcagaagagattgggggcctatattcagcattc

SEQ ID NO: 203217 - DNA, 172 bp, Homo sapiens
ttgatttttcactttctgcccttgattgttgagattagagagactgatatcatctttgagttctcaaaacaacatcattaaaacatgagaaattcgtagtgtcatctcattccattcgtattaaaaatgcattccatttttcctctctctctagaatagtttgaattggctg

SEQ ID NO: 203218 - DNA, 591 bp, Homo sapiens
agagagtagacttggatgccacccagccagcaatagagaagttgggaccacccagccagggacaaggccacacctcagccatcaccacccacaagcaacgcagcatgtatgagctgggacaggacaccagaaactacctcatgattgctccggaagaagcagctgcaggtgctcagccatctttatttcctgccacccccaaactatgaagacagcaaagcagcctgtggagaggctgctcacagaggcaaccccacccttacttggtgatggcacgtggaactccacctcccaggtggaaaatggaaaaattgtttccttctctgatctactgcctgagctgtcatcaggattttgaggactgacttaatgaataaaatataaaggcttagcgtgagcctgggatatgcatggtggaagagaataaatagccttttgtatatcaaagatactttctgggtaacccaatctgagaaatagctacttcagccacatctgctgttagggaaggctgagaaaatagtgactataaaatgaaatgaggcttgtaggtgaaccacatgaaatcctgtgaaccggggagaagtcacc

SEQ ID NO: 203219 - DNA, 743 bp, Homo sapiens
tgctggaaacatttggaatcttcttttctaggtattttgaaatatacagtagattattgttaactatagtcactctactgatgtatcaaacactaggtcttattcttctaagtgtatatttgtacccattaatcaacctctcttcatcttcccttcccccaaactcttcctctgataactaccagtctactctctatcttcatgagatccatttttgtagctctcacatatgaatgagaacatgtggtatttgtcttcttcacttatttcgtattcgtaagtagtgaaaagtgtgtccttaagtgagaccttttctgtcttcccagctttaatataaatacaaaagattgtgtgatactagggataaagcaacctccttattttcattccttcaaatgctagtcaaggtaacagatgaagatcagaaagtactaggaaaagaagtcaccatcacatcttgtgttgaaatttgttagggagtttcagtatcaaggaatgagtatgtcatgcagcagatgagcctctaggatgaatttgattaattcttcccagcagcaaaatctcataatcaaataatgttgcttgaggccttcttttgctttggagttagagaatctaaattgtgtaagctctagtggatttccattctgtcgtatcaagtatcgatggtctgtgtgaatggaaagagcagattttctgttgggctatatatatgagctcattggaaagagttaagaattatt

SEQ ID NO: 203220 - DNA, 282 bp, Homo sapiens
ttattaagatggtacatggtagctaaaaatctgattctgaatatacagtgagaacataaaatagaaccagaaccccacataataacaactgggaacaaaagaaagaaaacatatgaagaaaagtgataagtggatgacaggaaaaacagagcggaagcaaaagaaaacagttttgaaggatttgttaacaacagagtgttggttaagtacatacggtttataaggccaaaggatttggcaatttgaaggtcaatcatgaacagaaaacatagtgttctacga

SEQ ID NO: 203221 - DNA, 334 bp, Homo sapiens
tgggcctcagataacaccccaggtgaagatggtgtctgagcctcttccagctgcactttctcaagcttaaactcctacggacaggcctcacttttactcattcctgaatctccaagggcccagctcccaggggcaagttgcaattctgtggtttggcctggaacaccaactgctcagtgtattgaagagaatcttaaagggcatgtagacaagacccctaagatacttctaaggcgttccaagcttgcacatctgcaggaacagagagctcatgctggctcgaggcagctcattgcattcattcagcaaacatttcaggccagccaagcaacac

SEQ ID NO: 203222 - DNA, 177 bp, Homo sapiens
gtagccaattttgatgtattttagtattaaagttataaaactatattgaatttaactttgggataagctcacagatctgaagtaaaattgtcattcatacggcttcactgagtgggcctatcctgggtagatgctaatgtttttcatggaaatttgctgtgtgagtagagatggcaa

SEQ ID NO: 203223 - DNA, 265 bp, Homo sapiens
aatgggaataccaatgtcaccttccatagtctaaatgattattaagaatttgaagctggaagatgcattcacatgctcttgaaaataatgggtttgctggtgactggcccctgccttggaggctggaggtaggagcaaaggcctgcggtgaccagagtcagatcctggagcacaagtcctgctacttttatctgttcttttggggaaaggaagaacctatccagctcgtcctggggctcaacccctcctgaccattcctgcttgt

SEQ ID NO: 203224 - DNA, 1348 bp, Homo sapiens
ggcggaaaggatccccggaacgtataacatgatgaagaaactgacaggacagctctgtatttcatatttatacataaaggacttgaggagagaaaaaacactttaatatgtctctttttttagggaaaaagcacacttataaaaaatattctctgaacaacacataatacctatctaacaatatcttagcgtcgtgtacactaaaattaagacttttgtatttgttacctctgacagagaatgtcattctggcgtagaagttagtttttacgtttgcatacaaattttaagactttcattcctgctcctttctagttttagaactttttctgctgacctacccggtcagttgttaggaagcttagcatgaggtgggctctttaacaccattctgagaactgttgatttagagaggaaggtgaggattttgccttggagaagagactgataaaaccaagtgtttattcttgtaaatcgtctccaagacctacacagtcagctaagcatgaatagcttacatctcatgccagccttcaacacccttgaaaaatatccttttctgtcttgctcattttcttcttataccataagttttatttggtatcattttctcttctcacaaaatgttcctattatatagcattttctgtattcacctcaacattacttctaactatgataacatcttttgaaaacatacaaatttttcagaatggatactaagtggaaatagcagtctttcattttcacctttcaactgaatccttttttcccctaccgaattggtatttaaaaaaaatcacagtcagcaatatgtatcctttctctcaagctcagaaaaattatgtagccacctgctaatatccagcaagctatcaagtctgcattttgggaataaagtagtttttcacatttttgttcagtttatggtattataaaggaaaaaatctctatgcgtcagtggattttaatttctttagaatcattatgctgttaagagtatgccagcaaacgtttctagagctatttaatataccttctgctatttaatataccaaatgcttttcagagaaatgcaatttaaatactgtgcttaacatattttactaagaagcagaaatattgaattattgttctataacgtaattgtgtgttgtgtgttttatatctatacaatatatacccctgtattaatggagaccattgctacactagggagaggcatggcctcttcagagcccacagcaggtggccgggatgtccagttccaatgttgttcccgactctgtgactcaaagcggagcccctcactgcttggcctcgggcttctcttggtaatgtagacggt

SEQ ID NO: 203225 - DNA, 505 bp, Homo sapiens
cagctcaaaggaaagcatgaatgttgtcaggtgacctaggattgaacaataactcctagttagttgcatctggtagccatccttttcattaaagtcttgatttgtaccctgggtagtgtaagtgttaaactgagtgggagcagattagaagtgcatggcgggaggtgaaagacatgtaattactaagtgaatactcatacaggaatgagatgggaaaaactgcagttgctcatctgcagtagttttgccccacgtttctcaagtatttaatgttgggctactcttttagtcactagctttacttgttttttgaatcaggggtatatattttttttttccaaataagcaaggattgagatttatgtccctgaatccatctattatctgcaaaactggcagtaccagggctttgttatagcagttgtatttatagggaaaggaaaaggctggagttaaatgattgtcttcttttatgcattaacatcccttgaaaatcactggtcag

SEQ ID NO: 203226 - DNA, 871 bp, Homo sapiens
ggtctttgtctctccctgcagctggagctccaggtcgtctgttcactgctctctgtcttcttctcctagaggcccagcctctgtggccctgtgtcctgcaggtattgggagatccacagctaagacgccaggaccccctggaagcctagaaatggtgagagtgccggtccagcatcccgagagaggggccattgcaatttagagatgtggccatagaattctctctggaggagtggcattgcctggacatggcacagcggaatttatatagggatgtgatgttagagaactacagaaacctggtctttcttggtattgttgtctcaaagccagacctcatcacccatctggagcaaggaaaaaaaccttcgactatgcagagacatgagatggtagccaacccctcaggtaggtgtgagtgaaaatgaatacaacagacaacacagtaagaagtccaaggtcaaaaagaaagccagtccttaaggtgtgattctggaagctgtgttccaaaggaacttctgggcagctgttttttttgttttttgtttttgtttttgttgttttaaattttgctgtcacaaaggggcatattgtcttatgcttctaaattctctaaaaattctacttttctctcagtgagcttccttcacattcacagtgagagccaaagtcctcttcatgacatataagagacagcacaatccagctgctttttcattgttttggggacacacaaatatcttcctaattttgagaaactgaaactattttttagttttctttttgtatccggtctgaaatttgtgagagtagtagtttctgttgcatttttttttgttcatttttgtgcacagtccattctatttttatt

SEQ ID NO: 203227 - DNA, 741 bp, Homo sapiens
aggtattgggagatccacagctaagacgccaggaccccctggaagcctagaaatggggccattgcaatttagagatgtggccatagaattctctctggaggagtggcattgcctggacatggcacagcggaatttatatagggatgtgatgttagagaactacagaaacctggtctttcttggtattgttgtctcaaagccagacctcatcacccatctggagcaaggaaaaaaaccttcgactatgcagagacatgagatggtagccaacccctcaggtaggtgtgagtgaaaatgaatacaacagacaacacagtaagaagtccaaggtcaaaaagaaagccagtccttaaggtgtgattctggaagctgtgttccaaaggaacttctgggcagctgttttttttgttttttgtttttgtttttgttgttttaaattttgctgtcacaaaggggcatattgtcttatgcttctaaattctctaaaaattctacttttctctcagtgagcttccttcacattcacagtgagagccaaagtcctcttcatgacatataagagacagcacaatccagctgctttttcattgttttggggacacacaaatatcttcctaattttgagaaactgaaactattttttagttttctttttgtatccggtctgaaatttgtgagagtagtagtttctgttgcatttttttttgttcatttttgtgcacagtccattctatttttatt

SEQ ID NO: 203228 - DNA, 289 bp, Homo sapiens
gtagtcccagctacttaggaggtttaggtgggaggatcgcttcagcctaggaggtcaaggctgcagagagctgagatcacaccactgtactccagcctgaccatcagagtgagatcctgtctccaaaaaacaaagatgagatctcacaaaatatgggatgaggactcaaagtcattataattagaacataaaaattaatatgaccttattttacaaccaagctaatgaagaaggatcttgactagttacacaataaagttgatataagagttttgctccaaaataatag

SEQ ID NO: 203229 - DNA, 809 bp, Homo sapiens
cacgcggtgtttggttttctgtctttgtgataatttgctcagaatgatgatttccagcttcatccatgtccctacaaaggacatgaactcatccttctttatggttgcatagtattccatggtgtatatgtgccacattttcttaatccagtctatcattgatggacatttgggttggttccaagtctttgctattgtgaatagtgccgcaataaacatatgtgtgcatgtgtctttatagcagcatgatttataattctttgggtatatacccagtaatgggatggttgggtcaaatagtatttctagttctagatccttgagtaatcgccacactgtcttgcacaatggttaaactagtttacagtcccaccaacagtgtaaaagtgttcctatttttccacatcctctccagcacctgttgtttcctgactttttaatgatcaccattctaacttgtgttagatggtatctcactggatttagtatagtttcttcattcaacagatacttattcatcaccttccttctaccaggccacggagaaaaggcttgacctaagtaaacaagacatggttctgccctcatagagcttatattttattgaattataattgaaatactaaatgctaaaagggataagtagacattgctcaggaaatatagaagagcaggacctggacaagtgtggggcatgtgccagggaaagccttcttaaggaagtaacatttggtccaagctctgaaggaattgatcagaagaggtcttgaggagggaggcaaggaccagagagtggtgggaaaggccag

SEQ ID NO: 203230 - DNA, 288 bp, Homo sapiens
tttgtgcctccttttcctcctctgttcagatcacttccataatgatcttacaggtataatgtgaatatcaaataatagggcacttgtaaagtgctgagcccagtgcctggcaaatagtgaagcctcaattaagtggttaaaaagaaatttttagggccgggcccggtggctcactcctgtaatcccagcactttgggaggctagaggtaggaggatcgcttgacgcccagagagttccagtaccagctcttggccagacatagagagaggccccctacctcatacaaa

SEQ ID NO: 203231 - DNA, 395 bp, Homo sapiens
ctcccgtgtgtacaggccccaagttgccccatctcagttctgagctaattttgagggtgtcactgcagggggaaagaacactaaagtaggaatctggagacttgaactttagttcatgtgtgctgataattagttataggatcacgggcaaattcctttacctccataggcctcagttttctgatctgtatgcaaagaagcaggggaattaggtgatctctgaacttctatttaactgtacaagttttcattatatccacaatgtaacaaaatattgctcagatacaggtaaaaaaatttcccaagatcacaggtctggaaatggaggagtctcttctttcaggcattaacacaatgctcctttctttttcttaacactacaatactaacaaaat

SEQ ID NO: 203232 - DNA, 560 bp, Homo sapiens
cctttgtctattgtatctttcatattctgttcttgccttctgcactggctagggcctcctcttcaaaggtgaataggagcggtacttctaccttattcccagacaatgaaggaatattagaacattttaagtctatttacctgctccagacatatatgtcattgttgttgcacatttaattttacttatttttttttgagacagagtcctactctgttgcccaggttggagtacagtggcacaatcatggcttactgtagcctcatactcccaggctcaagcagccctccctcttagcttcctgagtagctgggactacaagcacatatcaccatgcccagctaggattttttggcattttttgtagagctgtggtttctccatgtcactctgaccggtctcaaactcctgggctcaagcgatctgcctgcctcagcctcccaaagtgctggattacaggcatgagccaccatgcctggccagttttgcagatattaaattagacatacaataaaaataagcagatacacaatacctacagaaacaatagacattacaaa

SEQ ID NO: 203233 - DNA, 273 bp, Homo sapiens
attcgaacaggaaagagaaagaagaaggcatggaagaggatggttactaaagtctgctttgttggagatggctttataagaaaaccacctaaatatgaaagactcatcaggccaatgggcttgcatttcaagaaagcccatgtaacacatcctgaactgaaagccaccttttgcttaccaatacttggtgtaaagaagaatccctcattcccactgtatacaactttgggtgttattaccaaaggtactgtcattgaggtaaatgtgagcaaa

SEQ ID NO: 203234 - DNA, 597 bp, Homo sapiens
ctctagaggatcttctgtatcccggggagaacatgcagagacagaccaataaaggcaaatgcaagaatacactagatacttaccacaagctatactataaacagtgcaactattctaatccaaaaggcatcctagttcttatgtgaaatgacctactgtggataaaccagaaagctagctatctgagtcaaagggaccacatagcactacagagtgtaaaaaggtgaaagcaggaaatgtatgccctttactgtgctgctgttgcagctgttgttgcatgctgttagttgctgccgtggctgctgtggtaagtgcgtgatgctgctgctgctactgttgctgcttcggtccacttgagaggaactagaacactggtaatatttaaatgcctccccgggatacagtgtatcccgggaagctgtcggggaggtcttaaggaataaaaaaaatcaagggctacttctcttgaggactgcgggtgctagtggcctgggaagcgctgcctggcaatggaagggccacggacgtgaatctgaagcccaattttcggtaggaccacaagcaacatattattacaatgaacccctatccgtagtt

SEQ ID NO: 203235 - DNA, 456 bp, Homo sapiens
agacaaatactacgtgttctcactcatatgtggaagctaagaaaaagtggatctcatgaaggtagagagtagattggtggttaccagaagccagcaagggtagcagaagtaggggattcaaagaagttgataaatcaatacaaatataaagttgagagaagaaataagctccagtgttcaacagatgagtagggtgactatagtttacaaaaacatactgtacatttcaaattagaagagaaaaattcaaacatttctaggataaagacaaatattaaggtgatggatatcccaagtacactgatgtgatgtatacaaattatatgaatgtattaagttatcatgtgtgccctgaaactatgtaacttattatccatcaattttttaaattgttgaaaaaatgattaaatgaataaataaaatattgggtcttggatgagccagaaaatttgggaa

SEQ ID NO: 203236 - DNA, 552 bp, Homo sapiens
ttgagagtggttcaaacgtggtgcaaggccagggaagggaatgaatctagctggagagatggaggggctaggcctgtgggctgaggactctgacagaagaaacacagatatcagacttcagattagggtgtcttcactcctggcctgtccaccagtcatgcaaaagtcgcttaggagaggggaggtaagggaaagcttcatgaaagagtgattcctggatcccttcagaactacaaagcagagtctctgagagtgaggcttgggaatctatcttttaaaaaatataagctacacccacaccccaacatttgaacacctacaagaagtcacataagggttacaagaggtgaatgtcatggttagacttgcatgcatttttatttcatctgagaatgtctttatttccctttcattcctcaagtataattttgcctattatagaatgtgtggttgagaattttctttcaactcttgaaaaatatgtgccacttccttttcttctccttctgtcgtcttctacccttctgtctctctccccttctgtcgtcttct

SEQ ID NO: 203237 - DNA, 531 bp, Homo sapiens
atcctttttttctatttctataactggatttttgttcttatgacacccctctctacattgactagttgtcactcttgggcttatacccttgccaggctgacctgtatgcataattataaatcataagtataattaattcagcacttttacttgaaggatgtttgtttgcaaacacattttattcatttacagtgattggaatagaagaaggccaagtgtgtgttttcaaacagtaattggcaactggaaaacatgtttgatcatagatttaaaaatcacttgtctataagtcttggcactacaatatgaaagcaattacatagtcataccataatagtttatgctgtaatttctttccaagaatagagacatatacagaattgtcacaaagacctctgataatcattctcctgtacgctttacgtagtagaatgcattaaatgtttgggctggttgaaatccatgattcctccccaacaaaaagtctctgacagataaatcatcaatagtttatgctgtgggtaccgagct

SEQ ID NO: 203238 - DNA, 338 bp, Homo sapiens
ttctaactacactgaacaagaaaaaaatagagagaagactcaaattagtaaaatcagagaggatattaccaccagctttacagaaataaaaagcactataagggaatactatgaacagctgtttgccaagaaattagataaactagatgaaatgggaaaattcctagagaaacacaaactctcagactgaaacttaggtcagaataaacctataacaagatattgaattagtaatcaaaaaacttcttgcccacaaagaaaagcccagggccaaagtcactggtgaattctgccaaacacttaaagaattaacaccaatcccttacaatgtccttcaa

SEQ ID NO: 203239 - DNA, 701 bp, Homo sapiens
gcagctcgcccaggcaggagctgctaaccagacgcgcattgtgaaggagaccgtggaaaatcaaaagtgggttcctgcaaaaatgtagcattggtttctgcagtccttgggcgaagtgcaaaggagaattcagtgacctcgtttttgagtttgtaatgagtcgttcattttggagataagacgggctgagttgtacagggtaattgctagaggatttgccaagtgcgtttgtcgactgctcctttctctgggaggggaaaaaaggcatgtgaaaaatgcgtggaccattaggaggcgtaatcattttgacactttaaaaaacggattttccatgtcggtgttttaaccaactgatcttgtttgtcaaactaagcacttgctgcgttttataaccaaataattcatttttaaaaatccgtaggtgggatcctaggaggcgcacttagtatagcctctggaagggtaattttttgttgttaggtgctctgaagcaggatctagtggccctttctgttgggatggctctctgcttcctgttgaaatgttaattccattgttggatgccacagctgtgagcattactcatgggatcaacattctattagcaagtctaatcttcgatctgagcctatagcactacctccacctttttgatatatatcatttagacttggcgggctgaaatgtccaaagtaagcctt

SEQ ID NO: 203240 - DNA, 881 bp, Homo sapiens
aagggggagctggctgtccctccacctcccatctgccattccgaggcatcatctaacgtccccggcgtcccctctcattctggtgtcccctgtgttctagaggaagcatggactgtgtctccaggatgggctgtgggagctgtggggctcccaggggggcaggagccctcaggggagaggggtggggcacgtgggtgcgcaggtaggccgtcctggagcagagcagtgtagggccaagccctgtgtcttctgctgcttctcactggctctggggcaggtggcttcctcacctgcacgatgggaatgaccctggagttctggggaacttggtgagatcaggaccttcccccagcagtgccccccaggtgcctgacgtactgttgtgctgttggtggtattattaccacctcgggccatgcgatgacccttttgcttatctgcaaaataaagcgggtttggcagcaagaaaatcaaagtgaaactggtgaagaaagggccggcctcacgagaccccggggactcagacccagtgagcgcacctcttgctgcctcctgcatccacaccgccaccccgcgggaaggcaggacgagctgcttgccaggtgacctcccgtgcctcagtttcccccatgaccacgaggcggtgagagctccgccgagctgccccagggataactgagctgggcttggtgcggctgcggccagtacgctggtcctgcccctcttgttggtcaaatctcaagcagacttgtcccaggaccctgggtcctgtgtgtggcagatggtcctccctgcctgccccggcccccgccttccccatgggcctacggccaggactggaggacttgccccagcctaggttggccctctggccaggggac

SEQ ID NO: 203241 - DNA, 574 bp, Homo sapiens
gaagatgctcacagccaacatcacatgcctatcagatattttatgtacatcatctcatcaactccaggaggcagagactaagagactagccccagtcacagagctagaaattggccaagacaaggttcaatctgaggactgtcaaatccagaactggaatttcttttttttttttttttttttgagatggagtctcgctctgtcacccaggctggagtgcagcggcatgatctcagctcactgcaacctccacctcttgggttcaagcgattctcttgggactacaggtgcacgccaccacgcctggctaattcttgtatttttagtagagacggggtttcaccatgttggccaggatagtctcaaactcctgacctcatgatctgcccgccttggcctcccaaagtgctgggattacaggcatgagccactgcacctggccttagaagcctcagttcctgatggcagttgggatctgcctttccttccctggactgcctacctcttgtcttttaggttacatatgagaaaacaaacctccaattcaccaaaactattgttatttggggagctg

SEQ ID NO: 203242 - DNA, 359 bp, Homo sapiens
taattgttcttaagagatatatgatttagtgtttagggttgaagtgtcatgatatctgcaagttacttcccaatggctcagcaaaaaaatctgtgtatgtatatatacatatatgtatatagtatttagaaaaagagataagccatatgtagccaaattgatgccctgatgaatctaaagtggtcccccctcatccacagtttcagttacccatgattaactgcagtctgaaaacagtaaatggaaaattccataaacgactcataagttttaaattgcacaccactgtgagtagtgtgatgaaatctcatgtttgctccagatgtgaatcatccctttgtccagcacatcaacgctgt

SEQ ID NO: 203243 - DNA, 561 bp, Homo sapiens
ctatagttaactgaattcaagctgcatcttaagaattatggtttcgtttttgttttagttttaaattacttttatttttgacatttacaagcacaaggaagacgctataatctctcttgagttgtcacccatctctaacagttttcaactcatggacaatcttttggcgtaactaggggagagttagagacttaaatcccacacatcatttctttccccagtgaataattcaatgtttattggatttctctgtcacctatacctagtttatgttcattttgcctgtgttattgtgaatgtctttttatagtatcctaaatagggctcatatattgcatttggttgatattccttaagctttattttgttgttgtgtttttgtttgtttgagacgtagtgttgcactccagcccaagcaacaagagcaaaactcctatttcaaaaaaaaaaggaaaaaaaaaggatggtaacttacaggtgggtccaaaggaattgcccgggattccggcgggggagaaccaaaaaccggggggggcacaggacttcaccatttttttactt

SEQ ID NO: 203244 - DNA, 607 bp, Homo sapiens
ctatagttaactgaattcaagctgcatcttaagaattatggtttcgtttttgttttagttttaaattacttttatttttgacatttacaagcacaaggaagacgctataatctctcttgagttgtcacccatctctaacagttttcaactcatggacaatcttttggcgtaactaggggagagttagagacttaaatcccacacatcatttctttccccagtgaataattcaatgtttattggatttctctgtcacctatacctagtttatgttcattttgcctgtgttattgtgaatgtctttttatagtatcctaaatagggctcatatattgcatttggttgatattccttaagctttattttgttgttgtgtttttgtttgtttgagacgtagtgttgctctgtcaccctggctggagtgcagtgagccgagatggtgccattgcactccagcccaagcaacaagagcaaaactcctatttcaaaaaaaaaaggaaaaaaaaaggatggtaacttacaggtgggtccaaaggaattgcccgggattccggcgggggagaaccaaaaaccggggggggcacaggacttcaccatttttttactt

SEQ ID NO: 203245 - DNA, 397 bp, Homo sapiens
ttggcatcggctcctagttctctaaacagaaggatgtcctgcctcaggccttcgtacatgctgttccttccatctgcacaccattcctgagccccacatgactccctctctcccattgtcctggtctctgttcaaatgtcacctaagggccaccgagctgcacaacctctggagtgccgtgcccatcacccttcaccccctgcctcagctggacccattcctcacaagccagaggaattttactctaatggtggaatttcaggccaagtagaaaatatattttgtgtgtatgaagaaaggggaaaaagaacccttctctgagacctcaagttattatttaattgattaatttttagtcattgattaaattattaaataacaaatgaaatcaattgta

SEQ ID NO: 203246 - DNA, 947 bp, Homo sapiens
gccaaggagaaggagcagagccccacggcagaaaaggatgaggacgaagagaacgatgcctctctggccaactcctccaccaccactttggaggacaaaggccctggccatgccacttttggccgcgaggccaccaaatttgaagaggaggagaaacctgacaaggcctgggaagccagacccccacgagagtccagcgatgttccccccacgaagagaaataactggatctttattgatgaggagcaagcctttggggtcagaggacaggcccggggccggggccgtggtttcagagagttcacttttcgtggtcggcctgctggcggaaatgggagcggcctctgtggtgggggggtcctgggggcccgcagcatctactgcagcagtcagcgcagcggccgtggccggggcctgcgagagtttgcgcggccagaggactgccccagagccaagccccgacggagagttgccagtgagacccatagcgagggctcagagtatgaagaacttcccaagcgccgccggcagaggggctccgagaacgggaatgaaggctcgctcctggagagggaggagagcaccttgaagaagggcgactgcagagattcttggcggtccaacaagggttgctctgaggaccacagcggtctagatgccaagagccgaggccctcgggcctttgggcgagccctccctccccggctgagcaattgcgggtatggacggagaaccttcgtctccaaagagtcaccccactggcagagcaaaagtccaggcagctcttggcaggaatatggcccttccgacacatgcggatcccggcgacctacagacagagactatgtcccagattcctacagacaccctgacgcatttggtggccggggctttgaggacagccgcgcggaggacaagagatccttcttccaagatgaacacgtggc

SEQ ID NO: 203247 - DNA, 113 bp, Homo sapiens
cagttgaagcatatgtcctgcgagcttaggggtgctacaagttgaccactgcagcagtaaagatgactctgaagaatggcatgggatggatcctttcgaatgcacttgagcag

SEQ ID NO: 203248 - DNA, 974 bp, Homo sapiens
aaacaaacaagcaaacaaaaacaaacaaacaaacaaactccaaatactttaaatgctattacagattataaaattacaacactgcagacttggcagaaggaaagatttagatttcagaaaacatacacaagtcatttggtagaaggcccagggatatgaacagatactacacgcatgagaaaatatcatgagtaaaacaagtacagaaaactgtacaaaacagtgccacttttggcatgttaacatttgatattctattttttttttttttttgagacagagtctcgctctgtcacccaggctggagtgcagtggcgtcatctcggctcgctgcaagctccacctcccgggttcacaccgttctcccgcttcagcctccccagtagctgggactacaggtgcccgccaacaagcctggctaattttttttgtattttagtagagacggggtttcactgtattagccaggatggtctcgatctcctgacctcgtgctcctcccgcctcagcctcctaaagtgctgggattataggcatgagccactgcgcccggcccaacatttgatattcttatttaaaaatggaaatgccaaatactgttacagatatgatgaaatagtacccctcatagtttgttgtagatattataaattggcactgttcttaagataattataagttaaaaaaagaaagttcatggcccacttacactctactgagaagtgaacaaaagaaacaatctcgagtatgaaaaagcttatgcataaaaacagctcaaaatattatttgtgataataaaaagttgaaaaaaaatccacaccatgaaatattaaatatcttttaaaacagtggccaggaagcctatgagccacctgggaaatgcttctgaaataattttaattagataaaaagctccaaaatagaacatgtgctgcgattaagtttatcttaaaaagacaaattcagaggtgaca

SEQ ID NO: 203249 - DNA, 384 bp, Homo sapiens
ggctcatttacgtggctggaaggttggtactggctgttggcatgaagctctagttcctgtccaaagggctgttttgagtatcctcacagcatagcagctggctttccccagagtgagcaatccaagaacatgacaagaagtgtaatacttttatgacctagcctcagaagtcacctcacatccacattctccctcaaattctttccaagttccaaggctgaatgcttacaaagtaaatatcacgtgtgctttactgaccattatatcccatccactggcagacaaatgggtaagcaaaatgtggcatacacctaccatggggtattattcagccttaaaagggaaggaaattctaacacatgctacaacatagatgaatctcga

SEQ ID NO: 203250 - DNA, 422 bp, Homo sapiens
tggtttgttttggtttgatttttgttttattttacaaaaaaaaaaaatttcctcaaaatcacaaagtagttggaattcccagtttgttgttcaggctacagtgtgtctgagtggggattcgcttctgagttctatgacaaatgtgaaaaaaaaaataataataaaaattgatttcattatttcttaatactattgagctcagtttgttgaaatatttataatatgagggttacagatcaatttgcacttttacctctcaccattcaactttgaatttgtgccatttaccccaaagaaggttcagtggaaatgcatgaagctatcttcttgaatcgaacacttcaactcaaggaataattcaaaacaatgctccactgatcaagaaaaatgtcactagttcctattttgattaaaaataagga

SEQ ID NO: 203251 - DNA, 496 bp, Homo sapiens
aaagaaaacggtttccagattgcacaggtagtgtttttgggtattgccaattccttctctgtagtatccagcctccaaattgtcccccaataatctctgcttctcaatactcatacctttgtgtagtcctctcacattgtagcaggcttcgtctctgtgactagcagaatgtggcaaaaatcatgttaagtcactgctgaagtttgggttacaaaagaccacacacatatggaatctcactggagtccacacagtgaaagcaatcttgaaaaagaagtttgttgggtagggcaaggtggctcaagcctgtaatcccagcactctgggaagctaaggcaggcagatcatttgacgtcagaagttcgagaccagcctggccaatatggtgaaaccctgtctctactaaaaacacaaaaattagccagtggtgagctgagatcatgctattgccctccagtctgggcaacagagcgagacttagtctcaaaaaaaaaaa

SEQ ID NO: 203252 - DNA, 353 bp, Homo sapiens
gggcccaggggaaggagaagatgggtgacctggagaaggaggggctgcgaggctgagaacacgttgccctcaggtggagggcacaggctgtcactctactccatggaccaggcatccaagccatcagtgaaaaacagtatgacaagagagccagtcccaggggacagaggccacatcccttgcccactgaggatgagtccaggcctcccatgtccatcccagaaaagccaccagaccactcgtctctcctgacccagttcaggagtaaagccacaaactctagctctctttttctcctgtcagctcagctctacaaaaatacatctagctttgttcacaaagggcaagaaaaa

SEQ ID NO: 203253 - DNA, 162 bp, Homo sapiens
cattgacagggcctgggtacccacttccctttagctgcacagaatgggcagaggcagccaggatcatccctaggtgcccttgagcctccattttacagtctctggtttgaaagccccagactacaactatagctggcccagaggaaaagcacctaacaaaca

SEQ ID NO: 203254 - DNA, 549 bp, Homo sapiens
gattatgattaggcaaccaaattagagattaaaaagaattgcatgaaaatgtcatctctagattaaaggattatatgtgcttgctgtttattatgttctttgtacttttctcgtttctttccaggttttctataatgagcagttataacttataattagagaaaacccattttggtttttttttagctagttgtatcgacgtctgtagcataaatccactttgaggtgttcactatgatcctttgaaatttttataataaaagtctatgctaaaagtttttattggccacttttttaatctttaaagattctattgactgctagttttcatctctcactgtaacctcatctcccacctacccgtatcagaatcactatcagagatccgtattaagcgtgtcaagctctgacaaaacattaacatcagctttatcactaaaacctctaagatacccgcactcacgtgcactcacacacactcctcaaagccagtgatctctaccctggaggaataatctcttgggcagtttggcatccacctaaaagtac

SEQ ID NO: 203255 - DNA, 146 bp, Homo sapiens
atgttctttctattttattcacatagcattaactaataatctttctattttattcatggtaccattgacatcatcaacactttattgagtgtaactggatttattataattaatcacaataaactgcacatgtttaaattatataa

SEQ ID NO: 203256 - DNA, 740 bp, Homo sapiens
cttacagaacaggcgaggcacagcccatgccactggtctgtgaaataagctgaaaaaccagctggtgccctcactaacatctaaagtgagctgtcatcacatcccatgctacattcctccctaacacactccctaggatccttccgggtcagctcccttgccaaattctagttaataactctgcttgcaccttgtacgggctcatgcaatggcttgaccctatctacccacttttattcacacacaccacactgtcacttctttacacacctgttcctcctagaccacgaagtcatctctaaaccttgtgggagaggtatacataaaataccagaactccttatggccaagcataatgtcttacttgcatcccagcacatgccattagccactgttccttcaactccaatttctcagtagctcaactttgatgaagggcagcggacacataggcagcacgtcaagacttcccttatccaactgttcaaaacagagaaaaatggttccaatagtaagaagtgtcctgtttcattcagaaacgtcatgtgggaccatctgcaacttgcttagttagcatttgcggcctcctgtaacaaggtgacaggagcacttcaggtcagcatctaaattgcttatttttttttaattttgaggccaggcatagtggctcacgcctgtaatcccaggagttcaagtttagcttgagcaacatagcaagaccttatctctaaaaaaaaaaa

SEQ ID NO: 203257 - DNA, 338 bp, Homo sapiens
gaaaagttgagggtaaattggataagacattctctaaagttccttccaatgcaaaatgctattcttccagatttgaggctccctaaagacaagaatcctattttatcattcctcattatgtgcctctcatggccctggctcatttctaggtccagagaacatgttcatgtcaagcttattaaatggatcaaagaagtcagtcttacaatttctatgattttgtttggagcccctttcctaaattttttttgttgttgttacaagcatatttaggctgatagtaatacttttttgttttttaagagacaaagtcttgctctgtcacccaggctggagtg

SEQ ID NO: 203258 - DNA, 540 bp, Homo sapiens
tgctcttgtttttccatttatgaatgcacagtggatctagtttcaagctagtttccctttaactgtttaattcccctattgacgttcatcaaaattgtttcaagtgttgtcccccaaaatttgcagagtactaacttccttttgtagtttaagtcctggttacaacaaccttgaagagtgacaggtctaccccttattaaatcatctgggccaggtgcagtgactcacacctataatcctagcattttgggaagccaagttgggaggttcacttgaggccaggagttccagaccagcctgggcaacatagtgagaccctgtctctacgacaacttttttaaaaacagctaggtgtggtggtgcgtgcctgtagtcccagcttctcaggaggctgaggtgaaaggatcacttgagcccaagagtttgaggctgcagtgagctatgattgtgccactgcacccattgtgacagtatgggtgacagagcgagaccctgtgtcaaacaacaacaacaacaacaacgaaaaaaaacccataagtg

SEQ ID NO: 203259 - DNA, 416 bp, Homo sapiens
cagcgggcaatagaaggaaaccttgaaaagaaaaaagaaaagaaaagaaaagaaaaaaagaaaagagaaaagaaaagaaaaagaaaaggaaaagaaaaatgtgaccatacatcatgctggtaaatgggatgttgagattacattttgatagaagaatgaaattatctaagaggacatgttagcaagataatatggtaagataaacattttatatgaaataaaaaaataataatttgattggtaaataaggcaaagaaagctaaaagattttttaaaaaacaagctgaaacaataccagcaaatgcatacatgaagaataaaaaataatttggctaaaagaaaatgttagaagaataaaaaggatcaaatatagtgatacacaaagtcaattaaatgtatacatttgacacattaaa

SEQ ID NO: 203260 - DNA, 627 bp, Homo sapiens
aaaatggaaagaagcaaacaaactagaagcttaaaagctaccacttaaaagtccacagctaggtggtccaggcatggctttccatagggtcaagaacccgagttcttctttctggctgtctggccggcttggctttcattccagcatgccatcacccacattggcatctcatcgacctcccaggcagcagaaagatggaaaagacaagtctttcctgtaaggacacccatcactttcacctgcatctcattgaccagactactgcctgtagcctcacagctccaagagggtctgggaaatgcagatttccttctgggaagccatgtgcccagctgataaccaagaagcacggtagaagacactagtggaaaatgctgaatctgtgcctcactacaccccttgagagccgccgtgagtggagtttgtgaacattcttagaggcaacaggatggaaatctcaagaggccttatcattggaagcatattgccatggtgttttgacattcctgaggacagaaggagagggcggtgaggaaaataagattgttagcctggttctaaaagtgtccactgtttgtggagtcccgtatgtcagagaagacatgaatggtgagaggagggagtggt

SEQ ID NO: 203261 - DNA, 456 bp, Homo sapiens
cctctgttattaacaggcatttgcaaaagcttggaaaaataacattttttaaaaattcatgaagaaataatatagttgtttatcattaagaggcaagaatatttggaagacagtagagtccagtataatgtgagcatggttttgaatctcacttgtgtcatttgttaattatatgagcatggacaagtgacaaacttctctgaaacacaattcagtaaaatgggattagtattacaagatgaaattcagctacttaggatctctgtctcaggtctgttcaggaggaaaagttgggattcgttatttcttatccaataacataagtatttttaaagaagaaatatatgcagggaatttcaaagaacaaatgccaagtgcttttcaatcctaagttaggaccgtactatatgtgtataaatatcttaaatatacattaaacgtttcccaaagtctaca

SEQ ID NO: 203262 - DNA, 236 bp, Homo sapiens
ttatttccacacagaaacacatttccttgtagccaagtcttctgtgtccctcagcagtattctgtcattttcttcatataaatttgacaaatctctagttttactcctaagaaccactgcattcaaatacctgcccatcacatattatgctttgagatacactagtttgatttgcaaattttacttttgggattcttgaatatttctggataatgctcctgttaacaactgcctga

SEQ ID NO: 203263 - DNA, 354 bp, Homo sapiens
cctttgtgtcatattccacagtatcggtcattaagatgtggggtgagacagccgagacaatggcattctcttgtaattagagcattttatttttctaagaactttatagtcttccctttagaagcaatactttaaaaaaatgcagtccaccatctgctatacacatagaaactgaagagatggtcagcggggacccagctgaaaaccttttatggctgaaagcccgtttatttcccagggaactggtatacaggttaatcaccacataatacatacatttgatttaattgtataagatatcaaactttaaaactacccacagaaatgcctaaatcctggagcaatagctgattg

SEQ ID NO: 203264 - DNA, 385 bp, Homo sapiens
acttggttgttttcagtaagtggcagggagtttaaaaagagaacggatagctacattccaaatcgcaaaaaatgtaaaaaatcatatgggcatgaataacattcagccacaaatatttatgaagcttctgctgtgtgccagacaaaatggctgggtattaggactatgacagtgaagataacacagcccttgctctcaaggatttacagttgatgagaaaggcagacaaatccaggaggcattataatccaccatgacagctgctgagctcttctgtgggaatttgcagcagtggcacccacatatgtgggcatttggagaaagtggggaaagcttccaggaggaaatgatgtcttaactgggacagaagcaagaagagtcagcc

SEQ ID NO: 203265 - DNA, 359 bp, Homo sapiens
ctctcagagatcccgcagttcatacagactcagctttagaatagtcactgtgaagtcatgtggggtttttgttgttgttgttgtttttaggccaaggaagctatccaagaattttgtgaatgaggctgagagttgaccttgccagaattcatggggaagatgtgtttcttgttttgtgtggtcaaagagagtttttcatccaaacattgccctcatttcttctcctttttctgctgagttttttttttcttttgattttttaagtgtctagagactttaacttctttaaatgttattttttggtagagttttattttcagtggtttatcttgggataagttgagtaagaggttcagatt

SEQ ID NO: 203266 - DNA, 449 bp, Homo sapiens
aaaagatgcctatacaactatctacagtacaagacagagagtgatcaagaggacagaagataacaaaagcacttaacatgctgcctggtacatagtaaatgcttcataaatgttggccactattatcaccattgtcattgatggagttcagaggagggagaaatgacggttacttgtctgtggggattagctgttttttagagcagctaaaatttaacatggcccttgaaagatggaaaagattagaacatgtagagttgagaaaaaggtggaccaagaaaatagcataagcaaagacataaaggagaaaaatacaaagaatagagtaccttaactgaactttgagatatatatggtggtattttaatgcttgcagatccttatgaggctcaaatgagatcgtaaatataaaaagactttgtgaactacataaaataatttgctgagat

SEQ ID NO: 203267 - DNA, 1128 bp, Homo sapiens
accgtacagtgtcatagaaacaggaaactcgagaagataaactgccaggctgtattttggagtcagtattttaacactgtcaccatctcaagcatgatctgtgggactcatcgctgtgctctttgacttgaacttctttaaggttagtgggaaaatgaagctttagagaagatgggactggcctaaggtcacactgcatgtcagaagtgtggtggagggtccaggtcttctgaccattcagtgcaagccaaattgtgctaatttccaatttttctccctttctcttggtgagctatttggtgctacttctactcctcatgaccaaagctggctttcatggtttactcatgtacttactgatgaaaccctgagacttggggccagtgactgttcagaggtccatgtgaagatgcgctgaatggtataaaggacagagcagtaaagagtgctggctgaatgcctgggctggcaatcaggcatgttggagtttgagtcccagtctgccactccagctctgtgaccaagaggaagtgaagtcatgtaccctttctaagtctctagcccctcttctgaaagacgaagatgccaccaccaaccatgttagtggttgtgaatgccaagaaagtccatgtgaagcacatagcatagtgtctgccatgcgttaagtgttccaaaaatggaagctatgactatttcacagagtacacttcccatcacttttcagttcattttggccttctccctcaaaagcactccagtgttctgatccagctgataaaacaccaaacattcacatagtgctttaaaagtgacccactgtttttacagactgcattacatatgaccctaacaaccactgcaatatagaaattcgcatctccattctccagatcaggataccgaagctcagaaaaattaaatgatttgcccaggatcacatagctagtaagcagcccagccagatcctgtgttaacttgttcatccgcttcctataagaaaacatccattcaaggcacatggggcaacaaagaaggacttagagctgtgtggcccctcgtcagggcagtaccagttgcacccatagtccggcctgaatactcagcttaggactattgtgtccaatgtcc

SEQ ID NO: 203268 - DNA, 472 bp, Homo sapiens
agtttatgtaagaagctatatttgctcattctgcttgccagcagaatgtcagagaattctttggcagctacatttcacaaatcccctaactcagtgactaagtgcagcccctggaagaatgcccctgaagatgataacatctcttgcatgaatcttttcttgcaaaagttccaggatcctaactcatgcctcttcctgtacataataagataatagctgataggattaatgattatgcctctacaatctataaccagatgtacccttgaaccccacccttgatgagattttgctctaatgtaactgctgagctcatttgatgtaactgctgagcacatctgatgccacttcccatcacatgccaccacctgtacctaagctttggagcagtctcacagaaagtctctgaaagactctccggattgcaatccttagtaagacatctgaataaaactaatattaattatttaaa

SEQ ID NO: 203269 - DNA, 266 bp, Homo sapiens
tcctatttcttccacttaacatgacatttctgaaattttatccatattgtagcatggattaatagttcattctttttattgctgaacagtattctattttgtgaatatactacaatttgtttatctatccaattgttgataaataatttattgttcacagtttggggctattacaaatacgactgtatgattattcttgtaaccatcttctagtggacacatatgatcatttatcttagactgatacagtagatatatgtagggca

SEQ ID NO: 203270 - DNA, 432 bp, Homo sapiens
ccagagggtggagccccccccagggaccccatccttcttcctgcacttcccggcccccctcctatttcactgtcactggcaaggagcgattccatttgcctggggaaaaggtgttacgtccttagtagcatggtatcagcatggttttgagaagataattcttacaggggtgcaggatggatctaagtgagaggacctgggaatgaggagactatacacaggctgtaggaaggcagccctccctgcctggccaggccaggtggaaagggaagcagcatctccctgcaagacatcaaccactttcctatcctctttcttcctaactgtggggtaatctttggcttctccgcagtgtttagataaggaagaaaacccagtcggcctccctcccccatcactctctaagatccaggtccagatacacaatggaag

SEQ ID NO: 203271 - DNA, 129 bp, Homo sapiens
ttgcctccacatatatattttagaatcagcttgttgatttcatagaaaagatcattgtgtattagtacgtggaaagccacggtattagttttttgtttgtttgtttgtttgtttagacaaagtctctct

SEQ ID NO: 203272 - DNA, 364 bp, Homo sapiens
cgtaagtccatcactcacctgtgtggagacagctccctcggggtgatttgttctccagcatcagagcaagtcaccactgacttgaggatttctgtgatgataggtggcagcacatgctcatcatagtcctctctgatactgatgaagatgtgaggaagctggctagagacaggctggaagaggatgtgcagttacactgacattctgtaaatttttgctaccagtgatgattggcatgttgtgtggtcaagagtgaaagtcaaagatcattggtttccgtacccaggggatgagaaagtgagtccctgtctctaccggtgttgtgtgctccatgggatcggtcaaagatgatagctctgtaccc

SEQ ID NO: 203273 - DNA, 350 bp, Homo sapiens
tcttagatcccccaagctctatcatctccccaatcaacctttgttataaaagcaccagctgttcctatcttctgtagtatgtagttaatggttatcaggaaatgacaaggataacatctcctgccaaattaagtgctaccttctagtaaaaagctcacataaatattattatacagctatggaaatgttcatttaaaaatgtctgccacatagtatatccatttattgactcacttgctatcttttttatagaaatgtttctttaagaaattgatattttaaacattgtgctatgcactcagataagaaaaaaaatcacaaaattaataacatcacctcaacttgccatt

SEQ ID NO: 203274 - DNA, 327 bp, Homo sapiens
aggagacttaaaaaatacagatgtctagtttctactaaataaaaaactctgttaaaagtctggttttgttttgtgtttaagtttcatgggtgctataccatccaagaaccatttatttttatcttcagctttcattgagagttgataggagaagaaatagccatattaatatttttgtatattttataccatttgataactcttactaggaattagtagaagaaaataacatctctctctctcaatagttaatacgcaactcttcattttcccttttgctttggttaccagagagctcagagtaaaattttgcactcagttttgaaa

SEQ ID NO: 203275 - DNA, 456 bp, Homo sapiens
gacttcagcgatatcataggatctctgttttgatctgtaaaataggaataattatgtcttcctcacctaactaatatagtagtaaagattaaatgggctaatgtgaaagtacattgtaaattataactaattggaatataaaaatataaggaatgaaggtaatgcaatatctaatacctttttctgctttgggaatttgttactatatgaacatacaatatggacataaaatataatttcatcttttatgaaaccgtagtttatcaaagcatgaactactgtgcagttttcgttatttaacaattatgacattatgggacctggtagaaaagtccagatatgaggaactgtgatcttcagggaacaggaggaacttctgcataagaccaacaaaatcagtacagctactacctacaccaaaaggaggttggtcttctgcgtaagaccaacaagatc

SEQ ID NO: 203276 - DNA, 500 bp, Homo sapiens
ttcttaaatgtggataaattagtaactatctcataggattaatagacttaaaggagcttgtatttgtaaagtccttagagcctggcacaaagaagtgctgtatgagtgtgcagtaataaaataaatacataagcctaaagacaaaactcttcctcatttcaagaaataatttctccagaacaaagcaatagaaagtgagttaagcacctaatttttgtttacctcccacattgcacctgttcttgcataacaaacacattctatttcaagaagttgaaatcccttcctttttgtccatctaagttgtctattatttctgtgccacgggtcattaatgaaaggcaggattctctctgaaattaaacagtggggaagtcaactggaaagagagaaaagtgcagcagaagtgactaaaagtgaaataaaagaagcagaagaaaacattaaaaaaccccgtaattaaaagcatgcacagagtcctgttaacctcggctgactcc

SEQ ID NO: 203277 - DNA, 460 bp, Homo sapiens
agagtacatgaagaaagtcaacaacaaggtggcaaaaactgtacctcagattttgtgtggattaaaaaagctaatgtcctaggtactttcagatgctggatgaagaacattattataaccaggaagcctacaattaattcttcctttaacaacaacattgactactttgaaggtcagactgcattttaaaatcacagggctctaagtttctacaggacagaaaactataatttcaacagcccaaaacttgaagaaagggagacacaggaaaaaaaggtagagcctgccagttccttagggagagactcagagagaaaggaaacatgtccctagccataaaacatacttctctgtcatctagatagacctctgacacctgaaactagtagagcctttttggagggcactttgacattacctctttagatacactcttaagttgtctgagtttacttacaaa

SEQ ID NO: 203278 - DNA, 618 bp, Homo sapiens
catggaatgtgtttccatttgtttgtgtactctcttatttccttgagcagtggtttgtagttctccttgaagaggtacttcatgatttatgagagtttttaaaaagtttttgtctgctaagtccaacgtctgggcttcctaagggctgatttccatcaatttattttgttattttggatacgttcctttgtcttggcatgatttgtgactgtcattgaaacatggacatttgaatattgcaaggtagtaactctggcatttagatgatacttctcattgtttgctatgtgtctgtgagtgagtgtgtttttaatcattgaaggctgtagtagtacatacatttagtgacttccaaactatttttgcaaagatttatcattttcatgtgtggtcactgaagtctctgattcttttagcttgtgttcagctcacattttgatagagatttccttgaatactaggagctaaaaatggaagaaaacacctctcccagtctttgaagtttgcctttgcaccacagcttttcttcagcacttagctgggcctgcactgaccctcgtaatcaggccaaggtgaaagcttaggtctttctgagcgagcatcctgccctggacaaag

SEQ ID NO: 203279 - DNA, 507 bp, Homo sapiens
ccatacaattaaaagcaaaaatttatatgattaacacaatagatgcagaaaaagcattcaagaaaatccagtattcatttatgaaaatattctctaagcaatgatgaaacatacctcacaataataagagccatctatgacaaatcctcagctaacatactgaacagacaaaaggggcatgcatttctcattagaaaaaaaataagactatctaaacaattctatttaacatagttctggaagtgctggataaatctaacaaaatgaaaaaataaatggcatccaaataggaaaagaagaagtgaaattaccttcactcatgatataattctctacctagaaaactttaaggattttaccaaaagactcctaaggttaaaaatgacttcagcaaagtctcaggatacaaaattgatatacaaaaatgaatagcattgccttacaccaataacattcaagctgagaacaaaatcaagaacagttttctttacaatagccataaacaaa

SEQ ID NO: 203280 - DNA, 390 bp, Homo sapiens
acccccgagtgtgctgcatagttactagactgatttctaaaacctatcatttacaaaaggaatatagaaaaatctttctgctaaaaacttgtgggggaggtgttcacctttgctaggtattattttatatcataattattaattattcaaagattcatattactatgtattaatttgtgtcaatcagtttgttcacattcacaatactgtatacgtaatacagtttccaatttctccaagtagattttgaaattttgttagtaacataatcaagaacctatataacaatgttttagcattcttcgtgaatcaaatcagaaaaaaaaggtagtttttttcaccatcagcaacctgcttgcatttgttaatccggaaatttctaaagtttga

SEQ ID NO: 203281 - DNA, 634 bp, Homo sapiens
ccgctggcgaatatgtgtgtaactctgaaagaattaatgataatggagaaggagccatggtgtgggtgatccaggagagtgggcaatcccatacgttaaatgaaagtcttcacatataatttaataactgagagttacagaagtacgttagacatgatctcatgcaaagtcttcatttaagggagaaagaaatcagctcttagaaaaagtaaacgtgtcattggtgattgcagcagttaagagagtgggccccgggtatcctgattccggcacttgcctgctagtcacctgtgtccccgatacccaacaagccccctgcggtctggcttaagttgaaactcatgctatggacagttgagagttgtggataccagaggcttacccagggagtaagcatatacaggccttaccttaatcttttgaggctctttcctaactcacctttgtcattatttgtttttagtcacttggctgtagttacatttcttcccttctgcttctgtttgacggtcacttttctaactttgaaggccttatgtaaatacggtgttttttcctgggaggtgaaggttgcagtgagctgagatcgcgccactgcactccagcctggtcgacagagcgagactctgtttca

SEQ ID NO: 203282 - DNA, 403 bp, Homo sapiens
taaatatttgttgaacctatgaatggacattgtaatttgacagatattaatatccctatgttaggagatgaacagattgaagttcggataaggtaaagtcaatttccttaggtcagacagctaataagtgtggcaaactcatcatttgaataaagattagcctaattcaaaatactatgttcttttttttaagtcaatactgtctgcccgtcatattgccctaaccttggtgaagacacttgtcaaaatgaacagcgacacatgcttctgactcttaaagaactaacagcggatcctggagatggaagctgggtagtaatggaagctactctcctatacaactgagaattctgatgcgagacgcccaaatataggaatacatgagctactgaaccacaaaacc

SEQ ID NO: 203283 - DNA, 597 bp, Homo sapiens
ttgcaatagtgagtgaattttcatgagatctggtcatttaaaagtgtatgtcacctctgcccacactctctttcttgctcctggtctcaccatgtgatgtgcctgttcccccttcaccttccaccaagcttcctaaggccgacccagaaggcaagcagatgctggtgtcatgcttcctgtgcagcctgcagaaccatgagccaattaaacctcttttccttagaaattacccagatgcagatttttttttatagaaatgcaagaattgcttaatgcagaaaattggtaaaaaaaagagtggggcatttgctgtaaaaatatctgaaaatgtggaaggaactttggtactgggtgatgggcagaggttggaagaatttggagagctcagaagaatatgggaaataagggaaagtttgaaacttccttgcgactcattaaatgattgtgaccaaaatgctgatagtaatatggacagtgaaatccatgctgaagaggtctcagatgcaaatgaggaacttattgggaaccagagcaaaggtcatgcatggtatgccttagcaaagaatttggctgcattttgcttctgcccttgggatt

SEQ ID NO: 203284 - DNA, 625 bp, Homo sapiens
ccacctgggctcctgcaaacaccagacgtgtaattagaggctcctgggctgggatgatgtggtgtgcagacaagtcttatcacgcgtctgagccgctgtgggtgcctggagttgcctctgcagcccggagcggatgagcggaggctcccgtgactcacccaactgcaggaactgtcaactggcttctgcccagccaagaacttttatcaatcactaagtagagacactgtgtacaaggacaccggttcatccaagaacatcaggacagccaggaattcaaaacacaaaacacagcttcctgcatgttgcaccccaggcggctctgaggctcagcccaaggaaggtttggggctcgggccagaaagacacgattcactctgacttacacaagaggggagtgtacaaaagtcatgcagtctcaggggaaggcactgggctaaaccctcatgactgtaaaatgaagaaataggcatgaagcatgactagggtgtttatttgacgaggacccagagttatgtccaaggaatgaaggcgttgcctttctacaacagagcaaaatgtcaagttaactgataacatgtacattcctcaggactggtccctcagtgagacagcgtttttagcg

SEQ ID NO: 203285 - DNA, 402 bp, Homo sapiens
gcagccttgaactcctgggctcaagtgatcctcccacctcagtctattttgagaattgtaaataattacagtttttgctttatgcagcattatgcctcagcctcccaagtgggaatgattttctgcttttagaaaataatgcagaggccagtatctaataaatgttatagtgacttgatataaaacttacataggacttgtcaaaatgtcctcaacttaaaatacttacccacagtatgatgcagtagtaaaagtgctgtatctagagtcacagctctggggctcgaggtatcactgctctagagtgtgaatgtagtcatatttcttactttctctaaacctcagatttttcaaatgtaaaaaggtgatgatattttactaggtaattgtagaacctagatg

SEQ ID NO: 203286 - DNA, 368 bp, Homo sapiens
caggttgacctacccaggcactacgtaccatgatttcatagtgctctgcagccagcaggctcactaaacgctcatcacggaacataccacaaatggtgctgatcaatgacacacgggttttcatgcttgtgacacagacagacagcaaaacaccacggcttattatcttcccattgtgtacaccactcacaggacggtgacagtccaggtattgcactggacctcggctttgcttaacagaaaacaaccctgctacggttggaaagagttgttaggtctacctggccaggtagacctaacttagtaatcgatttggaatcacatcacaggattgatctcaccttcttagagtaacctgtaagtaaagt

SEQ ID NO: 203287 - DNA, 447 bp, Homo sapiens
tctttctgccagtccctagaaaagtcagtcttctctcctgtgttgttagtcatgattagtcacttctaattctgttattgaatacaagagtaggatcttgaaagtaaaatagggaggagtagaagctcccaggatggcattatcttgaagtagagaatctgaaaaaccagtgttcttttattattgcaaaagatgatttttattaatttttaaatttattctagaatatttataaattcactatgttgatcaataaaagagctggtaatacagcatttataaatttatgttcccctaagaagttattctcttgtgtcctcttatgttaaaagaatgactcctagtccatcctgggctacattacaaaagaccctcttcataatcttggtctctgtattgtaggttttcctttattaatctagccattgtaggtgccatgatatgtat

SEQ ID NO: 203288 - DNA, 359 bp, Homo sapiens
agatggaaccttctaactgtgttctcacattgtagaagggatgaacaagatctctcaggcctcttttataaggacactaatcccattcatgagggcagagcccccccagaagttccaccatccaacaccactgcactggggattaagttttaacacatgaattttgcggggacacaaacattcagaccatggcaagtcccttccttatcactatattgtaaacataagaaaaaaagtcaagatattttaagcacaatttttttcgggtctttatgtcagtggttagagtcagattgcccaagtcttcactattcctatcaatcacatggtttcatagcctcttttccttccctcctcct

SEQ ID NO: 203289 - DNA, 235 bp, Homo sapiens
tggtgttgcttggcattatgattttatatagtcttgtgttttaaaagtacagtcactcacatgaaagaaaaatattgaagagcaacagtgctttgcaaataagcaaaactattacacttaaaagtaatagaaaaatttgctcaaggtaatgttctcttataattctgtctttttaaaacttggatatagctttattctactgagatttttctgaatgataaatattttttaaatt

SEQ ID NO: 203290 - DNA, 448 bp, Homo sapiens
aattatgtctagtactggcccaagcatgctgtcgggattttttgatgatgatgtagtgattaagagtggcaatgatgggtctagatcatgcaggcgcagctctgctaaccacaaatatttcttttgataggtagggtacagagtaactcttgtctttaaaaatctctaatgaaatccttaaaaccatggaatataattaaattcggagtttttcaggtgatggaggttgtctgtgtgaataaacatgtggttcaattggaccaacttaaaaattccttggttggcttgtctgtgtttgctcttggctgctttagtgctttaaaatggtccagttaaatcagactgtcaaaatggtgaggttcctgtttgatttactcatgccacacaaacccacacagagtgttatgaatgccacatttgagaaaatctcccatttgtgaaaacatat

SEQ ID NO: 203291 - DNA, 259 bp, Homo sapiens
aaacacaggggaaacataggggtgttcagaaatagttcccaggttactgcctgtttcaatatgtacagtcctcggccccacccacaagattctgacttggcaggtgagagttggagatgggggagctacctggttacgagggatcccagttcattttgaggcagctggttgttagactgcattgtaaaaattaccccccaaagattggaaaggataatttatgtatttttaatagagatagggtttcaccatgttggcc

SEQ ID NO: 203292 - DNA, 2650 bp, Homo sapiens
agatcgcaccattgcactgcagcctgggcaacaagagcgaaactccttcgccaaaaaaaaagaaaaaaaataaaagctaattacaaatacaggaaaatggataggccatgtgtttataagtttgagctcttgagccagtgacttccctgcacgttcagctttctcctttgtgaaatggtaatagaagcacgctgcacttgggattcttgtggattacatgtgagggtcttagaaacacttgatgtgtaagccaactattatgtattactgtatatggaacacaagggatgtagccaaaactaaatgcaagtttgtgcctcagatgtcttcctatcagaacagagtcaaatccagattttgatgcttaaatgtgacagcttattcagatttagaaaaacttttggtatgggccaaagaaaacatatccttaaggggatatggcccctaggccctcattttccttttctgtctgagcaattaaaaaaagcattaagtaaattccacaaattctttggaatacctagagataaaccagatatcatgttaactgtatgataataagttagaatacttgcaacaaaatgcagagttttctaggaaaacaagtaatcattcagaaataagaatatgaatagttcctcagttctccccctttgtggaatttgtgcagtaaatgctgctccaaagctctgtggaaaacagaagcttcccatgaaaaatctgacaagggtatctctcagaaagagagctgtaatcccagcactgtgggaggctgaggtgggagtattgcttgaggccaggagttcaagaccagcctgggcaacgtggtaagacccccatctgtaaaaaaaataataattagccacgcgtggtggtgcacacctgtggtcccaattactggggagactgaggcggaagaatcgcttgagcccaggagatggaggttgtcgtgagctaggatctgccactgcactctagcctgggtgacagtaagacccttgtctcaaaaaaaaaaaaaaagaaaaactgcagattggtgactcttacgaagatagatggaaatgttctaaataaaacacacttaggatctggcaatatatatatttaatgtactattctgaccaaatggagcttaatcagatagcttgagaatgatttaatgttacgaaatctgttaattgcattatctcaataatagatcggtgaataactttattattctctcaacaaatcctgtatttgatttacaaaatggatgggaggtttcagggagagcagttggaagcctgtgtgctcacctgttaggaacgagagtggcaacagcagtggggaggagtgctcggctcctgcacctgtctcgatggcagagcccacaggcttggctgacagacgtgggatgaaggaaagagaagcctctcactcttcccacagcattgtagtgcgatttcatgcagaagtccaagcaggttccaggacaattgtgtaagaagctatggacaagaacgtctaagaaaacggaaaatgacatagaggatttgcactgtagctaagacttcacgcaaggctgtggcagctgaaagcatgttctggtgctggggctgcgtggcagagccaggagcccaggatccagcgcactgggcaccgacctgggacctggtcatctttgcgtgtggaaaagatggcatttccagttattgacaggtgaatgctggccttttagggaaaaaaaaatattagaattccatacagaataaagaatgaagatgagaggttaaaggtttttctaaggcatgaagagctgtgggggcagcctgcccttgttctttttgtcgtgtgtccttcacatgcagtaactctgttcacgcctcacaaaaaccctatgaggtggagacctgccatcaacccttcctgcacgggtgccactgaggccccaaggttaaatcatttcccagagtgtatcagcagaggcacagccacagagacacgtccgcacagagagctttccagatcaccagtaacagcgtgagatcatggtgcagaaggtcatgaggaggatggcaacgagcgagacacagccggttggtgctcacaaggacattggtagatctgactgagggccaggtcggctaggccttcccaggtgacaggagcccagtgccggccttggtgcacacagcgcgtccttgtgctttctcaggagagcttcactggggacactctgtgatgtttttggagggtcatttggtaatgtgttcaggagccaaaaaatatgcataatattcagtcttacaattacattttttgaatttatctcaaggaaatcccagggatctgtgtgaagctgcacatgctgctgctgctcagtgcgggactgtttataatatttgtaactcaaatgtccagaagaactgtacactctgtgcatgttttcagtaagttcatatttgtaagaaaaagtgggtgtgttgagagacaaatttttgtgtacatttacctggaaacaagcagtagtacacatatgcatgcatgaagtggtgttttcctgagtgttaagattgtgaatgttttattatgatcatttctactttttctattggaaaatactttgtgtaattaaaacatgaagatggagctaccatcaaaatggtga

SEQ ID NO: 203293 - DNA, 397 bp, Homo sapiens
agatcgcaccattgcactgcagcctgggcaacaagagcgaaactccttcgccaaaaaaaaagaaaaaaaataaaagctaattacaaatacaggaaaatggataggccatgtgtttataagtttgagctcttgagccagtgacttccctgcacgttcagctttctcctttgtgaaatggtaatagaagcacgctgcacttgggattcttgtggattacatgtgagggtcttagaaacacttgatgtgtaagccaactattatgtattactgtatatggaacacaagggatgtagccaaaactaaatgcaagtttgtgcctcagatgtcctttgaatatttatagaaattaaatggaacaaattagggcatcaggaaaactatacaaaagtctttacca

SEQ ID NO: 203294 - DNA, 521 bp, Homo sapiens
agatcgcaccattgcactgcagcctgggcaacaagagcgaaactccttcgccaaaaaaaaagaaaaaaaataaaagctaattacaaatacaggaaaatggataggccatgtgtttataagtttgagctcttgagccagtgacttccctgcacgttcagctttctcctttgtgaaatggtaatagaagcacgctgcacttgggattcttgtggattacatgtgagggtcttagaaacacttgatgtgtaagccaactattatgtattactgtatatggaacacaagggatgtagccaaaactaaatgcaagtttgtgcctcagatgtcttcctatcagaacagagtcaaatccagattttgatgcttaaatgtgacagcttattcagatttagaaaaacttttggtatgggccaaagaaaacatatccttaaggggatatggcccctaggccctcattttccttttctgtctgagcaattaaaaaaaggaaaatgaggcctaggggccatatccccgtcgta

SEQ ID NO: 203295 - DNA, 2364 bp, Homo sapiens
caaacagaggtttccactcttgaacaagatcatccaggttcttaaagtcctccccacttccaccgcttgctgcgagaaaggccgcaatgccctccagcgagttcgcaaaaaccaccgctcccgcctgaccctggagcagcttagcgacctgttgacaatcgctgtaaacggaccgccaatcaccaactttgatgccaagcgagccctggacagctggtttgaggagaagtctgggaacagttacgcgctgtctgcagaagtcctcagtaggatgtctgcgctggagcagaagccagcactacagaccatggaccacgggacggagttttaccccgacatttagggagctggcgctgcagagttcactaagctgttgaatatttttttaatctatactcataagctttgatatattatataaatatatattatattatattatattatattatatatatatatatatataaactcacactgaaaatttttaaaaaccaaggtgacgcgtccaccagaagccactgggagatttcagaaaggaaaaatgttggaaactgactcttgtctacaaaatttggcagctgcaacatacatggcaactcattttcactcacagaagcacgtgctggggcctcctgtgttcccaccttactgtccaccaacagcataagctaaaatgacaggtctctgtcatcacctttaggtagctcattttgtttatgttttcatttgcgggtggcggggctctgggtttgggtttatgttcttgccttttcttttttcatttggttttatgatgggagggagctcctcagcctcctcattgacattctggtccggctgaatcagatctctgacttaagtcagggtgggttgtctgtctgcatttgggaggcaggggggttgacctttctccctccccacctgacttcagcttgagatctttttttattcatttcctgatgagggttccttcactgtcctacaaacaaaagtgtcggtcaaactgtgacactgccacacctcacctctgttgcctcgtccatccctgggttgtggatcccttccttccagccccccctggaaactcacaatattacccattatactgaaggcaacattgcctcaccgctgagcttgaaatcctggggaagggagaaggggtaagcttttagcattcctgtttttacgaggtggaggataaaacaatataattccattccaatccagggcttttggggagatgaagagccaagaagtccagaccccaacaggggagtgatttttggctaaaaaacaaggaaaatgaaaagtacatattcgagttacatggattatttatactttttctttataatcatatcatgtgttgagggtattttttttcctttaataatcaagaaatgcctgctatagttcagtggcaggtagtgtcaatgcaaattgtgccctaagttatgcataactcaaatgagagtctgtagagatgtggtcctccttttgcaacaaggctgataacatgctacatggtcataggaaactggggaatgtgtctctgcctgtaaactcttccttttttgaacagggtagagatgtcctaaagaaatggagaaaagaagagaggactctcaaggcatcagcctacacagacacacacacacacacagacacacacacacacacaatcacaatatacaatataagctttagaaatagccacttgcctattccctggggcaagtagtggtttaaactagaggagtctgatcaatgctctttcattcatttaactaccggtatacctcgcaagggagttttaaaaaatgtgcgtgagctgttaaaaacttctgttcatgttcctacatctgatttatgcatattttatatgcagagatcctatcacgtggatgcaggtcattttgggggagggaggaagatctgaattatatacatgtggtcagttctgctgagagcttcatctcttggttggcagagggtggtgttatctggccacaggcaaggccccaatgtcttcagcctgcttggttcagacattataaaactgtggtggcttccttccttcttggtttatgttgtctctgaggcctcatgccaccgttgagaaccatagtggaaatgtcatcaacactgaacatgttatagccctttcttggttccaccagtcccttcatcccctaccaatcccttccccttcacctccatggtcttggtgctaagataactttagaatcattgctgctagtcaatagcttttcattatataaatatattatatatattatatattatttttgaaatatttttgtttgttttcaacagtgatgtagcatgttaaaaaacaaa

SEQ ID NO: 203296 - DNA, 450 bp, Homo sapiens
ctgagtggatggtgctgtgatatttttaaggagcctttcaggcaatgtttgcatgttagccagagggagaaaaagtgcccttttgggaggaaaatggtacgcccctccacttccatctggcactcccttcccccccaccacgctgctgaaccattttcatgtcaatcacaaaggaaaaataagtggggatggggggaaatacctaggagtctattatcacatacatattaatatgttaatactttctttaaaaaaaacctcttgatgttattattttgcagactacgctttatagtacctgtgtgacgggacctagaacactggatacaaatagagctatgttggtttatcataatatgtacgcagaaactttctttttgtcatattatccttgtaatgtaagaagattgttaataaaagcatttaaatttactcaccactgttgaattg

SEQ ID NO: 203297 - DNA, 2344 bp, Homo sapiens
ctgagtggatggtgctgtgatatttttaaggagcctttcaggcaatgtttgcatgttagccagagggagaaaaagtgcccttttgggaggaaaatggtacgcccctccacttccatctggcactcccttcccccccaccccctcaagtggtatcaccctggaaatacctatgcaatccagtctccctaggagagagtgcatggaagcaggggtatgtgcagtgtagaatacagatgctacagcatatatgttgtatatatggacatatacagtacgtatacacacagagtaagagagtaaatcacgtctatatatctataaataatatcctatatatttatacatttctatgttttaaatagatataaaaatagagtctatagagctgggagagcagtgggaagcctggcgctgtgctgtgcaaaggggaagggagcacggccttcggagagggagccggggaaggccagcaggcagggttggctggcaagggggcctcctacccggagtgttggagaggagagtggctgggtcccggctcgctccatgcactttctctccttttccacaggcttggtctgaggttggaaggagataccccctgagctccagctgaggtgccccctacctctccccacccccacagcccacgcttaggcggtcactgctgcttggcagtaggacgtggtctctgactcctggtggagggaccactgcacaaactccttcaaaaccctcccccaccaggactgagcagcgtcagtggcaataggaaaggtccaaactggatcaagagctggtccaggaaagataccgcccctgccctgttagatgcttctgctgcccctagaggccaagcccctgaagtgcagccgtcctggcctccctcacttgctcaaccactgtcaggaggagaggatgtgggcagcatgagcatcgccaggcagcgctgcccaccatccacaggctttctggccagggcagggggcatcagctagcaggaaacggtgggagagacatatctgcacactcataaattcaatggctactccagtccagaagcagggctttggcccagcccgctccgcgcagcagctgctgctggctgtactcaggacaacgctgttccccctccctcacagaggccccgtggcccctaccccactcccgccgtaacaggcaggtttagttcacatacactgttcgcattctgtgacttgaggcagaggctgagctgggataccccaagctcatccactttcgttggggagggcccctccctgggtttatcaccagctcctagcccgggccgggcggggatgtctgggggccacgcgggggcactggtgcaagctggcagcatgacagagggcttgtgcagccctgacgggacccagaagcccatttgctcgcagtttcctctctctgtttttttcctcctggaggtaggagagagggcctgaccaggcaccagatgatggagcaagggcagctgcatgctccctctctccagaccagccttctgcttttggggtccgaaggggcatttgctcccatcctgagcctcctctgcccctgtcttgctcttccccaccatcctacaagtacctcagtctccagcaggcccacccctccacctgcagcccagggcgggtctgttctgccaatgcccacctccttgagccacagttagctgccaactgggtcttgggacaccctccagtacctggctcaagagagaccaggccgggccgagccttcttcccactgcagtggactagacccacggccaggggatgggcatccccaggtagcaatcccacaatgcactgtacctcagagagagagcacgccaggggcaccaagggaccgagccctctgtccagagggggacagcggtcacaatactgctcaccaaaagacaaaggccaggctgccctcgggcacctctcagtcttcacttttgtctctccggaagaaccagcagtctgattccgtctatttcagcccccgtctctctcttctccacccccacgctgctgaaccattttcatgtcaatcacaaaggaaaaataagtggggatggggggaaatacctaggagtctattatcacatacatattaatatgttaatactttctttaaaaaaaacctcttgatgttattattttgcagactacgctttatagtacctgtgtgacgggacctagaacactggatacaaatagagctatgttggtttatcataatatgtacgcagaaactttctttttgtcatattatccttgtaatgtaagaagattgttaataaaagcatttaaatttactcaccactgttgaattg

SEQ ID NO: 203298 - DNA, 1460 bp, Homo sapiens
accaggcatagtcgaattgtgctaatgaacacagtgactgatcatattaagccaatatgtagattccttaaatcttaacataatgtgctgggctttactgaactgtgggtgatgtgactggtcattcaaaaagctgagtcttgctgcacacattttcacacacacacacacacaatcacaatatacaatataagctttagaaatagccacttgcctattccctggggcaagtagtggtttaaactagaggagtctgatcaatgctctttcattcatttaactaccggtatacctcgcaagggagttttaaaaaatgtgcgtgagctgttaaaaacttctgttcatgttcctacatctgatttatgcatattttatatgcagagatcctatcacgtggatgcaggtcattttgggggagggaggaagatctgaattatatacatgtggtcagttctgctgagagcttcatctcttggttggcagaggggcttgtgcagccctgacgggacccagaagcccatttgctcgcagtttcctctctctgtttttttcctcctggaggtaggagagagggcctgaccaggcaccagatgatggagcaagggcagctgcatgctccctctctccagaccagccttctgcttttggggtccgaaggggcatttgctcccatcctgagcctcctctgcccctgtcttgctcttccccaccatcctacaagtacctcagtctccagcaggcccacccctccacctgcagcccagggcgggtctgttctgccaatgcccacctccttgagccacagttagctgccaactgggtcttgggacaccctccagtacctggctcaagagagaccaggccgggccgagccttcttcccactgcagtggactagacccacggccaggggatgggcatccccaggtagcaatcccacaatgcactgtacctcagagagagagcacgccaggggcaccaagggaccgagccctctgtccagagggggacagcggtcacaatactgctcaccaaaagacaaaggccaggctgccctcgggcacctctcagtcttcacttttgtctctccggaagaaccagcagtctgattccgtctatttcagcccccgtctctctcttctccacccccacgctgctgaaccattttcatgtcaatcacaaaggaaaaataagtggggatggggggaaatacctaggagtctattatcacatacatattaatatgttaatactttctttaaaaaaaacctcttgatgttattattttgcagactacgctttatagtacctgtgtgacgggacctagaacactggatacaaatagagctatgttggtttatcataatatgtacgcagaaactttctttttgtcatattatccttgtaatgtaagaagattgttaataaaagcatttaaatttactcaccactgttgaattg

SEQ ID NO: 203299 - DNA, 3261 bp, Homo sapiens
caaacagaggtttccactcttgaacaagatcatccaggttcttaaagtcctccccacttccaccgcttgctgcgagaaaggccgcaatgccctccagcgagttcgcaaaaaccaccgctcccgcctgaccctggagcagcttagcgacctgttgacaatcgctgtaaacggaccgccaatcaccaactttgatgccaagcgagccctggacagctggtttgaggagaagtctgggaacagttacgcgctgtctgcagaagtcctcagtaggatgtctgcgctggagcagaagccagcactacagaccatggaccacgggacggagttttaccccgacatttagggagctggcgctgcagagttcactaagctgttgaatatttttttaatctatactcataagctttgatatattatataaatatatattatattatattatattatattatatatatatatatatataaactcacactgaaaatttttaaaaaccaaggtgacgcgtccaccagaagccactgggagatttcagaaaggaaaaatgttggaaactgactcttgtctacaaaatttggcagctgcaacatacatggcaactcattttcactcacagaagcacgtgctggggcctcctgtgttcccaccttactgtccaccaacagcataagctaaaatgacaggtctctgtcatcacctttaggtagctcattttgtttatgttttcatttgcgggtggcggggctctgggtttgggtttatgttcttgccttttcttttttcatttggttttatgatgggagggagctcctcagcctcctcattgacattctggtccggctgaatcagatctctgacttaagtcagggtgggttgtctgtctgcatttgggaggcaggggggttgacctttctccctccccacctgacttcagcttgagatctttttttattcatttcctgatgagggttccttcactgtcctacaaacaaaagtgtcggtcaaactgtgacactgccacacctcacctctgttgcctcgtccatccctgggttgtggatcccttccttccagccccccctggaaactcacaatattacccattatactgaaggcaacattgcctcaccgctgagcttgaaatcctggggaagggagaaggggtaagcttttagcattcctgtttttacgaggtggaggataaaacaatataattccattccaatccagggcttttggggagatgaagagccaagaagtccagaccccaacaggggagtgatttttggctaaaaaacaaggaaaatgaaaagtacatattcgagttacatggattatttatactttttctttataatcatatcatgtgttgagggtattttttttcctttaataatcaagaaatgcctgctatagttcagtggcaggtagtgtcaatgcaaattgtgccctaagttatgcataactcaaatgagagtctgtagagatgtggtcctccttttgcaacaaggctgataacatgctacatggtcataggaaactggggaatgtgtctctgcctgtaaactcttccttttttgaacagggtagagatgtcctaaagaaatggagaaaagaagagaggactctcaaggcatcagcctacacagacacacacacacacacagacacacacacacacacacagacacacacacacacacacaatcacaatatacaatataagctttagaaatagccacttgcctattccctggggcaagtagtggtttaaactagaggagtctgatcaatgctctttcattcatttaactaccggtatacctcgcaagggagttttaaaaaatgtgcgtgagctgttaaaaacttctgttcatgttcctacatctgatttatgcatattttatatgcagagatcctatcacgtggatgcaggtcattttgggggagggaggaagatctgaattatatacatgtggtcagttctgctgagagcttcatctcttggttggcagaggggcttgtgcagccctgacgggacccagaagcccatttgctcgcagtttcctctctctgtttttttcctcctggaggtaggagagagggcctgaccaggcaccagatgatggagcaagggcagctgcatgctccctctctccagaccagccttctgcttttggggtccgaaggggcatttgctcccatcctgagcctcctctgcccctgtcttgctcttccccaccatcctacaagtacctcagtctccagcaggcccacccctccacctgcagcccagggcgggtctgttctgccaatgcccacctccttgagccacagttagctgccaactgggtcttgggacaccctccagtacctggctcaagagagaccaggccgggccgagccttcttcccactgcagtggactagacccacggccaggggatgggcatccccaggtagcaatcccacaacgctgttccccctccctcacagaggccccgtggcccctaccccactcccgccgtaacaggcaggtttagttcacaaactccttcaaaaccctcccgcaccaggactgagcagcgtcagtggcaataggaaaggtccaaactggatcaagagctggtccaggaaagataccgcccctgccctgttagatgcttctgctgcccctagaggccaagcccctgaagtgcagccgtcctggcctccctcacttgctcaaccactgtcaggaggagaggatgtgggcagcatgagcatcgccaggcagcgctgcccaccatccacaggctttctggccagggcagggggcatcagctagcaggaaacggtgggagagacatatctgcacactcataaattcaatggctactccagtccagaagcagggctttggcccagcccgctccgcgcagcagctgctgctggctgtactcaggacaaccacgctgctgaaccattttcatgtcaatcacaaaggaaaaataagtggggatggggggaaatacctaggagtctattatcacatacatattaatatgttaatactttctttaaaaaaaacctcttgatgttattattttgcagactacgctttatagtacctgtgtgacgggacctagaacactggatacaaatagagctatgttggtttatcataatatgtacgcagaaactttctttttgtcatattatccttgtaatgtaagaagattgttaataaaagcatttaaatttactcaccactgttgaattg

SEQ ID NO: 203300 - DNA, 2992 bp, Homo sapiens
caaacagaggtttccactcttgaacaagatcatccaggttcttaaagtcctccccacttccaccgcttgctgcgagaaaggccgcaatgccctccagcgagttcgcaaaaaccaccgctcccgcctgaccctggagcagcttagcgacctgttgacaatcgctgtaaacggaccgccaatcaccaactttgatgccaagcgagccctggacagctggtttgaggagaagtctgggaacagttacgcgctgtctgcagaagtcctcagtaggatgtctgcgctggagcagaagccagcactacagaccatggaccacgggacggagttttaccccgacatttagggagctggcgctgcagagttcactaagctgttgaatatttttttaatctatactcataagctttgatatattatataaatatatattatattatattatattatattatatatatatatatatataaactcacactgaaaatttttaaaaaccaaggtgacgcgtccaccagaagccactgggagatttcagaaaggaaaaatgttggaaactgactcttgtctacaaaatttggcagctgcaacatacatggcaactcattttcactcacagaagcacgtgctggggcctcctgtgttcccaccttactgtccaccaacagcataagctaaaatgacaggtctctgtcatcacctttaggtagctcattttgtttatgttttcatttgcgggtggcggggctctgggtttgggtttatgttcttgccttttcttttttcatttggttttatgatgggagggagctcctcagcctcctcattgacattctggtccggctgaatcagatctctgacttaagtcagggtgggttgtctgtctgcatttgggaggcaggggggttgacctttctccctccccacctgacttcagcttgagatctttttttattcatttcctgatgagggttccttcactgtcctacaaacaaaagtgtcggtcaaactgtgacactgccacacctcacctctgttgcctcgtccatccctgggttgtggatcccttccttccagccccccctggaaactcacaatattacccattatactgaaggcaacattgcctcaccgctgagcttgaaatcctggggaagggagaaggggtaagcttttagcattcctgtttttacgaggtggaggataaaacaatataattccattccaatccagggcttttggggagatgaagagccaagaagtccagaccccaacaggggagtgatttttggctaaaaaacaaggaaaatgaaaagtacatattcgagttacatggattatttatactttttctttataatcatatcatgtgttgagggtattttttttcctttaataatcaagaaatgcctgctatagttcagtggcaggtagtgtcaatgcaaattgtgccctaagttatgcataactcaaatgagagtctgtagagatgtggtcctccttttgcaacaaggctgataacatgctacatggtcataggaaactggggaatgtgtctctgcctgtaaactcttccttttttgaacagggtagagatgtcctaaagaaatggagaaaagaagagaggactctcaaggcatcagcctacacagacacacacacacacacagacacacacacacacacacagacacacacacacacacacaatcacaatatacaatataagctttagaaatagccacttgcctattccctggggcaagtagtggtttaaactagaggagtctgatcaatgctctttcattcatttaactaccggtatacctcgcaagggagttttaaaaaatgtgcgtgagctgttaaaaacttctgttcatgttcctacatctgatttatgcatattttatatgcagagatcctatcacgtggatgcaggtcattttgggggagggaggaagatctgaattatatacatgtggtcagttctgctgagagcttcatctcttggttggcagaggggcttgtgcagccctgacgggacccagaagcccatttgctcgcagtttcctctctctgtttttttcctcctggaggtaggagagagggcctgaccaggcaccagatgatggagcaagggcagctgcatgctccctctctccagaccagccttctgcttttggggtccgaaggggcatttgctcccatcctgagcctcctctgcccctgtcttgctcttccccaccatcctacaagtacctcagtctccagcaggcccacccctccacctgcagcccagggcgggtctgttctgccaatgcccacctccttgagccacagttagctgccaactgggtcttgggacaccctccagtacctggctcaagagagaccaggccgggccgagccttcttcccactgcagtggactagacccacggccaggggatgggcatccccaggtagcaatcccacaatgcactgtacctcagagagagagcacgccaggggcaccaagggaccgagccctctgtccagagggggacagcggtcacaatactgctcaccaaaagacaaaggccaggctgccctcgggcacctctcagtcttcacttttgtctctccggaagaaccagcagtctgattccgtctatttcagcccccgtctctctcttctccacccccacgctgctgaaccattttcatgtcaatcacaaaggaaaaataagtggggatggggggaaatacctaggagtctattatcacatacatattaatatgttaatactttctttaaaaaaaacctcttgatgttattattttgcagactacgctttatagtacctgtgtgacgggacctagaacactggatacaaatagagctatgttggtttatcataatatgtacgcagaaactttctttttgtcatattatccttgtaatgtaagaagattgttaataaaagcatttaaatttactcaccactgttgaattg

SEQ ID NO: 203301 - DNA, 386 bp, Homo sapiens
ctcgggttgctccgcctgcattctgcccctgtggaggagacctctggttctgcaactgcctgggagagtctaagtcggtgatggagagttaactggcctggtggacacatacctaccatgtcctgcaatccagcttaaagcttacactttaagaaacagaataacaagaatagattctagagctgagtttaaaccctggctccaccactgataagctgtgtgaccttgggcaagttgttagctggcacccagacacattgagaagatggtcatctgaaagccaggaaaagagactgctccagaacctgaccatgctggcaccctaatctcagatttccaccctccagaactgtgagaaaatacatttctgatttttaagcccccaa

SEQ ID NO: 203302 - DNA, 758 bp, Homo sapiens
ctcgggttgctccgcctgcattctgcccctgtggaggagacctctggttctgcaactgcctgggagagtctaagtcggtgatggagagttaactggcctggtggacacatacctaccatgtcctgcaatccagcttaaagcttacactttaagaaacagaataacaagaatagattctagagctgagtttaaaccctggctccaccactgataagctgtgtgaccttgggcaagttgttagctggcacccagtaagtgccacataagcatctgttaaaatctccatctgtctacattctttatctattcctcagttagttcagaacctaaatgggaaagaaaggtgttatatattgcccctatgaaagcccaacacaaaataatttacaccttatatttttttaattctaaagcatggggtatgcaatggattgaatgcttgtgtccccttaaaattcatgggttgaaattcttactctcgatgtgatgctatttggaaatggttttgtgggaggtaattagggttaaatgaggtcatgaggatggggcccttatgatgggattagtgccctttgaaggaagacaccaaagcgaactctctctctttctctctgccctatgaggacacattgagaagatggtcatctgaaagccaggaaaagagactgctccagaacctgaccatgctggcaccctaatctcagatttccaccctccagaactgtgagaaaatacatttctgatttttaagcccccaa

SEQ ID NO: 203303 - DNA, 590 bp, Homo sapiens
tggaaatagtaccactctctttatctcaatgggccttttcattgtaattattagaacaaatttttaatggctctggggtttgtgtaattagctttggttaccagaaaatagagaaataagtgacaatgaaagctcaggaatggtggcagacataaaaaaatgcttgtgctgcaaaacagccagaggacctggtcaatggaggggttgtgaaaggggatttcagcagtcatttgggtctccaggtgttcagttctctgaacagggtcagcatgttctgcttcatatcatgtttaaggttagtgatctataggaagaagctatgtgtgggttacctggatcgtaacatgctcagagttcctttcctgtggcaatattcctagattggaattcactgtatgtgtagcagtatgtatgtatgttctaatcaattgtcagagtgcaatacttttagtgttgtttacagctaggcagacattctcatttttaaactgcagtggtatgtgtgtttttaaaaaataaaaatgaaactgtttcctttgggtatcagaacaacaaattatgaacaataaatgaataactatttccttgag

SEQ ID NO: 203304 - DNA, 858 bp, Homo sapiens
gagtactccatgaccagtttcagagtatagatgatgtggggcatgagttgctttagcctttctgtttcatcttgggctaagctatccccaggaacagagcaatgagaagttcagggtgcctcttaaatgtgtctggtgtcaggattttatagcagcttttcatggttcagcctttttggccagtgcatgagtaggacatttttaagccctgtgctgctgactatttgttgataccatacaggtgctacattatctcctttcaggattttcatatctgcagattgatttttgttgtcttgtccagggcatcatatttttggattgaatgttttctgtttgtaaaatggttggtgtggacagacgataagctccaccattacccctgaagcttgtggactggggccatttgggtgaggggcttgttacacaccgactcattgtctgatctttcacaataaatagcagacaggtgaagagctttttagagaagtggaacgttggtacccttggatttgcctggtttctgattttcttttgttgtctttaagtggaggttcattaagttcaacaaatagagcatctggtgtgtgccaggaacacagttgacaagattaacaaattagtttggtttgttgcttaaaaactattttgttttaaaattgtttttaatagaaattttaaaattttttaattcaaattttagtttttaaaaataggcaatacattcacatgatgaaagaaaattttttaaaggcacaaaggttaactagtaaatacatctgtgtgtacccctgacccctgatcctcagagcaaccagtattagcgatttcttcatcctccagatattcaggtccctg

SEQ ID NO: 203305 - DNA, 652 bp, Homo sapiens
  misc_feature (52)..(52): n is a, c, g, or t
  misc_feature (76)..(76): n is a, c, g, or t
  misc_feature (293)..(293): n is a, c, g, or t
actctagagatcccccctgaaatttctgggaccactgctacagccttcattnacacagtgctgtgtggtatcattngacttcacatgatgctctcatatcttttctgcgcgaagttcatctctgtatttttctctatagtggggtttacctggcttcaattcatcagaaattcacatacaaacgggggaggcactgagacgacgtgggtgcaccttgatattataattaggtatcccaacattccaggacaggcttgtaaaacattttcaattatcattaacacgaaaccaanacgtctgagtttgtatgtgaatttctgattttcttttgttgtctttaagtggaggttcattaagttcaacaaatagagcatctggtgtgtgccaggaacacagttgacaagattaacaaattagtttggtttgttgcttaaaaactattttgttttaaaattgtttttaatagaaattttaaaattttttaattcaaattttagtttttaaaaataggcaatacattcacatgatgaaagaaaattttttaaaggcacaaaggttaactagtaaatacatctgtgtgtacccctgacccctgatcctcagagcaaccagtattagcgatttcttcatcctccagatattcaggtccctg

SEQ ID NO: 203306 - DNA, 387 bp, Homo sapiens
cttacttgggagagccacctgaccccaatttttagtgtatgtacatcaacttaatgtgggaggagtgcaagggtgtcactcaacccaagcctggccagtcagaggattccatcaccctggccataaagtttggttcaggaggggaatataacttcagatcagtgagatgccatccagactgtctcctggaacaattggggaaagataacctttttcctttgggcatgtgactattaagatgtaagttcagagactctgctagccatcttgctgctaagaagggaaagcctaggtaaaaaagaagccaacagagagggaaagatagctcataattggagagagaaatattcctgatggcatctctggtgtgcttggattgagccatac

SEQ ID NO: 203307 - DNA, 250 bp, Homo sapiens
atttatttgctgctcttctttttctaggatggagcctgctagaatatacaaccaaaataccacaaatttaaagataaaaataattgaaataatacaaattttccttcaaaaaaaaaaaaaattatcaaaaaaaagaaaaaaggccagacatggtgttacacacctgtagtccagctactcaggaagctggggcaagaagaccactttagcccaagagtttgagcccagcctaagcaacacagcaagatcc

SEQ ID NO: 203308 - DNA, 1411 bp, Homo sapiens
gaaaaagagaaattgaaaggttgtttgaaaaataggcttaagagagttactgcttttggatgagaagatttcagtggttgatttgaccataaccatcttggtagtatgagctcaggaatgcgttacttattagtgatgtgggaattacatggatttgtccccaaagcacaagcttttagtgggctgcttctatactggatgtgctaccttttggtgtcattaatcctttctccaccacaggcttactcattttttaacagggaatatttttcactgggaattggagtctctcggctccatgtaagaaatcaagttggtaaaggctcttgtccctaagagaggtataatacatacattttgttgtcaggatgattttgctaagttttggaagagtaggttggttccactaacctgcatttaagaaatgattgattaggctgggtgctgtggctcacacctgtatttccaacactttgggaggctgaggcaggaggatagcttgagctcaggagttcgagaccagcctgggcaacttagcgagaccccatctctacaaaaaaaagcttttaaataaaaaattagctgggtgcggtggtgtacacctgtagtcccagctactcaggaggctgagatgggaggatcacttgagcccaggagtttgaagctgcagtgagctatgattgtaccatctcactccagcctggatgacagagtgagattctgtcttaaacaaaaaaccccaaaagaccatccagagtgcttgtctcggtagcatatatactaaaattggaaggatatggagaagattagtatggtccctgcgcaaggatgacacgcaaatttgtgaattgtttcataattactatttaaaaaaaaaaaacctctgtaggtatttctccaaagaagctaagcagatgcccaataaacatatggaaagatgttcagcatcactaataattagggaaatgcaaatcaaaaccacagtgagatgttattttgcgaccatttaggatagttataacaacaacaacaaacgacaaaagcaagtgatgaggttgtagagaaattggaaccttggtgcattgctggtgggaatgtgaaatggtgcagccacagtgagaaacaatagggtggtttctcaaaaaattaaaaatgaaattaccatatgatctagtgatctcacttcgagttatatccaggataatttaaatcaaagattcaaacagggccaggcaaggtggcttatgcccgtaaatcccagcactttaggaggccagattacttgggctcaggagttcaagaccagcctgggcaacatggtgagatcctgtctctaccaagaaaccccccaaaattagctgtacatgttggcgcatgcctgtagtaccagctgcttgggaggctgaggtga

SEQ ID NO: 203309 - DNA, 616 bp, Homo sapiens
gggtgctggggtcccagttgggtccattcactcatgccacagctatttactgaatgcccactctgtgcacaggatcctccagttggtgagaatgggctgactgggctcgcagagggcggatcagttttctcgtgccaggaagtcgtggaatcgggaggtcatctggctcgtcctgcgctgagcatttgaacacagggctgtcaagggagaggtgagagcattctagggtgaggcagcagcaggcctgcacccagagccctggtggcctgacttgtcctttcctcccctctacacccacacagccactttctgactctcctgctctgaaatgtttattcctgtcagtaagagaggcaagaaaaacagccttccttttgttttgttttgtttttttttttccttagtttgaaaaaaagaatcagcgaatcctgtggcctttctgtttcttccactgaaaaggctggcagatgctctgtggctagttgagcacctgccgtaagccgggactttgagctgctcagagttgcatggagaagtcagacacataagcagatcattacagttctgagtggtagctgcttaatagagctccttaatggagtaactaatactgcgt

SEQ ID NO: 203310 - DNA, 415 bp, Homo sapiens
ttaacttctacgctgatgtgggacatgaaatgggggtctcgctatgttgcccatgttagtctggaactctacccttcagcgctcctcctgccttagcctctcaaagtgttgggatcacaggcattagccactgtacctggcctaattggcatcatggactcaaagactcccgatcaggctggctggaactttgttagcgccgtgctttgatctgggatgcctgctccctggccctcactccgtcctctcccagatgtcatcacagtgggaggctgtccttgtctactccagcttcctctcctttgtccatcacagacgatttccccaagaaagagatctcttcatgtctaattttatcttggtttggaggactcaaaccaacacaaagaataaatttcaatcttaaagatattat

SEQ ID NO: 203311 - DNA, 857 bp, Homo sapiens
gtgtatgttttagaagcaaaccatggcagaaatgtgtatggaattggaggggaagaaaattgaaagcagagaagccagtcagaatgtcattaccatgcccaaagcttgcagtctgctgaggggaacatccaaaactatctgaagccccgggctgaaccaggctctgcagacattggtggtgtcctagaaggctcttgctgaggtcttatgtctgaaaagaaaccctcggaaacccacttgagtctgtcttgcatttcacatgaaacaaggcttcattctgcaaaaatatctgggaccttcaaattcacaagtggattttctgctcaggggagagctaccaatcggttgaaaggtatgttacagctctaagaagctgcatccatttcctgtaggatccatagtttctggttctggttccagggaactccttcaaatgaactggtcgccatatgaattgatgctacactttgagcgttgccgcagtcaggtgaattcaagctacagagaagaggcgattcacattttttccttctgtcttgtattattcctccggctcaagaacctgccagagatggaatctccctatgttccccaggctgatcttgaatttctgagctcaagcgatcctcctgccttggcctcccaaagtgccaggattataggcgtgagccaccatgcctggcagagagcattttagtaaggataaaaagttttattggcctcaggctgaagtttgcaattatattccaaatacccaaagtgggtatatattgacgttgtcctgagagagggacagaaaggttgactgtgttggttctttggagtcagttttggggctgttaaggattacctggaaa

SEQ ID NO: 203312 - DNA, 549 bp, Homo sapiens
taaaccctaatgcctagcatgtatttagcaggactcaataaaatatttctgagtaaaacaaagactgtttttacaaagatgatgtgcaagactctcccctgcagtcttggagcagaggggacagacgtggaggaataatgtacagtttaggtggtcaagatgcagtagaaaaatcagtaaagtactaaggcagcctcaaggaaggaggtacctgtttatttggggaaagacatgcagaatcaaggaagacttcatatagcattgtttcaaaagatgaaaataaggccaggtgtggtggctcacacctgtaatcccagcactttcagagggaatcacgaggtcaggagatcgagaccatcctgtccaatggtgaaaccccatctctactaaaaatacaaaaatcagctgggtgtggtggtgcttgcctgtaatcacagttactcaggagactgaagcaggagaatcacttgaaccagggtcgcggaggttgcagtgagctgatcacaccactgcattccagcctggtgacagaggaagactctagctcat

SEQ ID NO: 203313 - DNA, 429 bp, Homo sapiens
ggatattcaaatgctaggaaagattattgtttttctaaatcatttgaaacatggaaggggattcaaacatataaatagtaatttgtaaaaccaagtttgaaaataataatttttctagatgcaagatcaaagataaatataaccagatgtagaaaaccagtaagtatctgaggctaatagaattttctgaggggaaaaattgttttctcgggaagtaaacattatttcaggtattttttcccagaactttaagaagtttatagtaatgtgtttcattcccagaaattaatgaaactaaattatacaattcccagaaaatatggtttaaaagttgcctttatagaaataaaatactctattagcaactattaccaagagaattcattgccttgagtgaagaagaaaactgaagttcacaaactttggaat

SEQ ID NO: 203314 - DNA, 589 bp, Homo sapiens
ttatcttccctagccccttaaagcattacataagactcgtatgtctagttgcttatttgtggtgctcaaaacagaactcttgtcctctacactccctggcccacatccacctgaatgctccctcagtgaatagtgttgccagtctatctgtctattcaaactaaaaacctaaaaatatgacttgaattcctctctctctccttgtcctctggtcaacatggtgaaaccctgtctgtactaaaaacacaaaaaattagccgggtgtggtgatgggcgcctgtagtcccagctactcaggaggctgaggcagaagaatcgcttgaacccgggaggcagaggtttcagtgagccaagcttgagccactgcactccaacctgggcaatagaactagacttcgtctcaaaaaaaaaaagaaagaattaaagcagagtgatgtgatagagtaatgagaatagagtggtgcttctatagatggcctgctcaaggaaatttctgaggaggtgatgttggagctgacacctgagtggagagatctcagcaagaagaagcctgaagcttgaaggctgaaaaaagacaaggggaaccacg

SEQ ID NO: 203315 - DNA, 237 bp, Homo sapiens
ttcttagggttaccactattctgacttctaacagcataaattagtttgacttgtgttctactttatataagtggaattatgcggtatatactctgtgtctggctttttattaaatgatgtttgtgtgatttattcatactgttgtgtgtaattgagatcattgctgtatagtattccattgtatgtgcaaatataacactgttttctactattgatggacatttttgtacttttcag

SEQ ID NO: 203316 - DNA, 512 bp, Homo sapiens
agcatgtaaaaatttagaaatgttaaaatggtcaagtgtttaatggaaaaatctttttgaatcatgaggacttttactttaccctcagagaagctttgaaataaaattttctgagaaggtgctttaaattttaggggctgcaattatccaccgttaataaaagtcactgttaagctaacagtccaacaagtgagggtgagcctgatggattatatatcatatggtagaatactttactgccattaaaaaggtagagtaagaggataagcaaaaggtagttcttatgtaagagtaataggttagaaaaagtaacattgtaaatctcattaaaaatgtattttttatgcattgcaaaaagattaatcatatttaccaagatgttgactgaggttattatgaagtggtgggttttataggtgtttttaattattttcccatggttctgtcatatttttttaattttctatattgaatgtgtatttctttggtaataaaacaaaattttaaataac

SEQ ID NO: 203317 - DNA, 395 bp, Homo sapiens
gcaaaatcaaggtgcaggcgcgtccccgggccagggctgcctcccgggtagagccgccaccttggggtctctgggctctcagtgtcctgggcttcgtcctcaaagtaagatcttcagagtaagaggacggagcccaagatggtgtgaagaccaccattcttgtcacacctttggggacctgtaggagccctcttgtccacacggctggcccagatgctcctcagggaaacctcctggccggcgagggtgcggcctgcgtgggctcattgggcccagcccactggcccagccttctctttctggattcttggcactgttggtgtctgcggctgccaccctggtgtgcccagggcagccacgcacctcagtcccgggcagggtgagggttggggagc

SEQ ID NO: 203318 - DNA, 531 bp, Homo sapiens
gcagagggaggggacagagagggtgatgggattttgcatcttgggcttctgagactttaatgattcttttaaattaaggaactggaaaacactcagcatggtcctggaagtgtgggaagttcagtaaatgttagttctctccccagtgccagaaatcaggaactcaggcagagaagcagatgggaggggagggggaaggtggaggtgctggcactgtattcaggtgatgagacccagcagctggctggaaagagcaggagcagagttggcaagggacagtggcgagtgccaccttcacagagtcattgttgaaaacaagggagagagaagaggcttgggtagaaccagggaaccattcccctttcagggtaagaggaggaaaagtgagaggcaagtgcagaacagtcagagataaaggggaaaggcactgagaggatggtgccttgcagtcctgggttcataagacaggtcttcctgctgtagaggtgaaggataagagggctgttggtggcctgtgggtgggattgggtc

SEQ ID NO: 203319 - DNA, 479 bp, Homo sapiens
ttcatatgaaaccagaaaaagaacctgaatagccaaagcaatcctatgcaaaaaaacaaacaaacaagaaaacagacgtagaggcatcacattatcagatgtttgccacaaggctgtagttacaaaaatagtgctggtataaaagtaggcacatagagcagtggaacagaatagagaacccagaaataaagccaaatacttacaaccaactgatcttcaacaaagcatagagaaacacaggctgaggaaaggacaccttatttaataaataatgctgggaaaactggataaccacatgtagaagaatgaaactggatgcttatcccttaccttatacaaaaatcatctcaagatggttcaaagatgtaaatctaagacatgaaactataaaaattatagaagataacctaggaaaaactattctggacattggcttaggcaaataattcgtgagtaggaccccaaaagcaaatgcaact

SEQ ID NO: 203320 - DNA, 393 bp, Homo sapiens
tacgtgtgccaggctggtctcaaactcctgagctcaggtgaaaccccatctctattaaaatacaaaaaattagctgggcgtggcagcgtgtgcctgtaatcccagctattcaggaggctgagacaggagaattgctagaacccaggaggcggaggttgcttgtgagccgagatcgtgccactgcactccagcctgggtgacagagcgagactccatctctaaaagaaaaaaagaaaatgaaaagaacaataaaatcactcaggagaaaaagaaggcacggcataggaatggaaggaggacaacctgtaggtcctacagatgcgaaaaggagaagagaatacgataaacaacgtgccacacagaaattcactcatttgaaatggaaaaaattat

SEQ ID NO: 203321 - DNA, 121 bp, Homo sapiens
accatactcacttttctgtggcttacggggagatcaaagtgtggcagagcaccttggtcaggcagacgtgtggatattctcctcttcctcttcacgcaaggatcatagaactttttttttt

SEQ ID NO: 203322 - DNA, 486 bp, Homo sapiens
gcccaggatggtcttggactactgccttcaggagatcctcctgcctcagcctcccaaagtgctgggattacagacacaagccaccatgcccggcctcttttttgttgttgttcaatagtagctgttctggtgtttgtcagatgatatttcatcagggttctgatactgcgttttcctaatgattggagatgtcaagtatcttttcatgtgcttattggccatttgtatgtctttggagaaatgtttgttcaagtcctttgcccatttttgaatcaggttatttgtgttttattgttgttgagttgtttaaagacttgttagtgggtgttttcaagcatacacaaaaagtagagccctcagtatccatcactgtgtcactagttatcaacactttgccaatcttcttccctgccctgcccacacctctaagtttttgtcctgcactattttaaagtaaatcccagacatcagatcttttatccgtaa

SEQ ID NO: 203323 - DNA, 247 bp, Homo sapiens
gtagtttaccctaggttatgtgggtaatagcacagctgtgattcaagtacaggcagtttgactatatagtctactgtaatgtcatttaaagaaaacagttatgtaattatttaaattttgattttagtcattgtaaatgtggcattcttcagttggttaggaatttgatctctgttattccttagatcttcaccaaagtgatgaaatgtgtgtgctcatttctcatccttctctccttccactctct

SEQ ID NO: 203324 - DNA, 691 bp, Homo sapiens
tgaccatggactttatttctggttaatgaaaatgtttgtcctgggcacacatgaagttttgcatgtgggttgccaaagtaataaccccaaggggcacccctcgcatgtatgatctgaatggcacccgtgggggtcatgccatgcatggccctgtgaagctggaggtaagtattatctctttggaagttggcatcaaaactgtgagcttcaaccaattctctgtaatcaaccaaagagaaaaatcagaaaaaagtgagagctctaattctccataacctataattaggttgtcatccttcaaatttggaagttaattctatagtgagcaggaaaaagtagtagagttgtaattctgtcaccaacacctatcccccaggaacacagggagaaacatgtaacaatctcatttatgccgtctttctactcatattttacatggaccaacaaatatagcttgctttactagcatatggctactgaatcattggcagtaatattctaggagtattctatagaagagagcctaacctaggattttttttaaatcctagtagttgctacagatgcaactactagattttaataattttctggactgctgaaaacatatttttctgatgatttatttttttcaacttgcctgaaagatgatttgctatgatttgtagaaacaactgaatcatgatctctc

SEQ ID NO: 203325 - DNA, 252 bp, Homo sapiens
taaaagtgcactcttctatatctacgaccatttgtctcaaagcaaaaatcttagagtcaatcctacttattttctttgtcaagaattgcacatcccacctttcagtgagtcttgctgcttgctctacattcagaatctatccaaagttagtcactctcttagtctctcccagaaacagatcccagtaaaaacattcaatcagaagtaatttgggatgtagagaaaaactatattctttttcttccctcagcc

SEQ ID NO: 203326 - DNA, 593 bp, Homo sapiens
tgacccgaggagtggtattggaagtttgagaccgtacatcccttgctaggtgagaagggggtcagagaggtcaggcacagacagagaagggaacgcaggctcctggccactagcctctctcaagacaggtgaactttgtgttaagcgaactcatttaatattttgggcctaatagaagttatttgtattttctctcctctcttttcctccccgggatactgtatcccggggagttggggagctaggcaggtgcagtggctcatgtctgtaatcccaatactctgggaggccaagatgggaggatcacttgagcccaggagtttgagaccagcctgggtaacacagggagaccccgtctcaaatatttaaaaaattagtcatgcgtagtggtgcatgcctgtggtcccagctacttgggaggctgaggtgcaaggatagcttgagcctgggaggacaaggctgcagtgagctgtgattgcaccactgcactccagcctgggcgatagaatgagaccctgtcttaaaaaaacaaggcagagggacacaccagtgtagtaatgacgcagaagcacacaaattttttcacaaatttt

SEQ ID NO: 203327 - DNA, 381 bp, Homo sapiens
tattttctcattcattctgaactcccccagtgatgttaagcagtactcagcatgacacttgatactacacagcagtgtggttaagagcaggggagcctcaagggcaccaacatgcatctgctagccaaccttggtgctggagctgggtccttgatgcccctgctgggctggatattaaccctttagttgctggctcatgagcaggtccttgggttcctggggaaggggcaagggaggcctggccggtggtggtggacacataggaggcttcaagcagcagctctccactaagaggcacagagggacttccacattttaacaactagtttggctgtatgtgtacaattagccctggtgaaaagtgcaagctttggaattaag

SEQ ID NO: 203328 - DNA, 130 bp, Homo sapiens
tttgccttgtacaatacagtgtccaccaattggagattaagcttaatatttttctgtacttcctatcaccatcaaagcagatgctgatgatctccagaactcaaaggaaatcccccaaatgaaagtgtaa

SEQ ID NO: 203329 - DNA, 407 bp, Homo sapiens
caaaagcgcatactagaagaatatcaagtatacttatattccagggctgaaccatcaaatatgttagccactaactacatgtggctatatagattaatattttaataaaattaaaaataaacattctgttacttaattgtactacccacatttaagtgctcaatagtcatatgtggctaatggctactgcattggatagcacagatatttgacattttcatcatcacagaaagttctattagacagtgatattccagaattatgttcttacaattgtaaaacttacagtttattgtaatgcaaagccatttacattagtgaatactcaatatttacttatcatatgtaaataaaatcagtgtaaatatttgtttaaaatacaataaatcaatttatcagaacattca

SEQ ID NO: 203330 - DNA, 172 bp, Homo sapiens
caattgttgccattgaaaaccctgctgatgtcagtgttatatcctccaggaatactggccagagggctgtcctgtatttaggggcagccactgcaaagttattgatgaacatgatctttagctgtatcatggcactgggtggagagcaggtttgaaaagggtgagactggaa

SEQ ID NO: 203331 - DNA, 301 bp, Homo sapiens
gctcaagacattgttctgccttgatttcatcatacagcagggtgaaactcataaagcctgcaggaaagctccttatagtacatggagggggaagatagattttaagaactatattctgagacacataatttttaaaaacatgtatggattcaaaaccattcaaaaccaattgactgtgacatgtaagaaacagaacaactttgccatgagttttaaacttgtaaatggtgtgaaaaattctgagccactctgttttgctgttgtgagcagttaaagagaataaatgagaaaacacttcaaa

SEQ ID NO: 203332 - DNA, 193 bp, Homo sapiens
cataaaatgaaataaaatacatctgagaagaaaaatgaaaacaataactgtgcgctgctgtggaggccctccaggagactgtaaatgccaaaagtaaggtacttcagtgtacctggtaggctatttttcatttaagaaagaggaaaaaaatattgaattgcatttgtttatatttgtataaagaaattacaga

SEQ ID NO: 203333 - DNA, 457 bp, Homo sapiens
  misc_feature (22)..(22): n is a, c, g, or t
gaaaagtacaaaaattagccangagcagtggcatgtgcctgtagtcccagctactcgggaggctgagggaggagaatcacttgaactcaggatttcaaggctgcagtgagctatgattgcactactgcactgcagcctgggcagcagagagagactatctctgaaaaaaataagatgctgggattacaggcgtgagccaccacatgcagacttagtccatcttttaatcatctctgcagtgtagtgatttttcttcctttgtacttctttggtgtgctgggtaccagtctttgctgtctctttaacatggagggtgttaattctataatagtcgattaatatataccaggatgcagtttattttcatgtttttaaatcttattttcatgtttaaaatctttaaattttaaagctgctaaaaattgcagcttttaaagttgtcttaaaacatagtctt

SEQ ID NO: 203334 - DNA, 301 bp, Homo sapiens
tctggtgggtggtggctgtggggctgcagttagtgcgtccaggccctgtggcttgttgggcatgaggcagcattcgtacaccttccagggtggcttttcttgctcagtttctggaaaggaggaggaaatgctgcagcttccacagtacttttgcttaagacaaagccagggatctggaatttcaaaagagctggggatagaaggtttgagctggccccacccagccctccatttgacctccaaagcaggctgtttcctgctgctggctgagtagaggcggccttcctggagggaagggaga

SEQ ID NO: 203335 - DNA, 266 bp, Homo sapiens
ctggtggctgctggctctccttacattttaatgtagaggattagcctgctgaatcagagaggatgctccagtctctagataccatgtttctgtctttgaagataagacaataggagttgatgtcagtagcctctgaggttgacttatattggtccctcctgtccttattgaacagccctgggattgtccgtttttatgttgcaccagtgtcaacttgggggtctatctgtgccaaagtaaaatctcagcattgggaccgtggctgg

SEQ ID NO: 203336 - DNA, 498 bp, Homo sapiens
tttgacatccaggagtttccatttatcctctgaaatctaggtggaggttcccaaaactcaattcttgacttctatgcactcaaggcccaacaccatgtgtaagctgccaaggcttgaaccctctgaagcaatagcctgagccgtaccttgaccctttttagccatggttgggatgcaggacaacaatctctagactgcacacagcaggggtgccctggacccagccaaggaaatcattttttcctcctaggcttccaggtttgtgatgagaggggctgctgtgaaggtctctgatatgccctggagacatttttctcattgtcttggtgattatcattttgctcctcattacttatgcaaatttctgcagcctgcttgaatttcttcccagaaaatgagtttttattttctactgcatcatcaggctgcacattcttcaaacttttatgctctgcttcctcatgaacacttcgcctcttagaaatttcttcctccaga

SEQ ID NO: 203337 - DNA, 222 bp, Homo sapiens
aatgtgagttatcgatcacccctggaaaggattaggatatgccactccaaaatatgccacgtttattttgcactgaaggcaattgagaaacagtagacacaggaagagctctctgcttttcccctttttacctaaaagcagagaataaatttccttttggaaagatgacatacattttcctttataaaggtgttcccttctcctctaccaggaagatctgag

SEQ ID NO: 203338 - DNA, 542 bp, Homo sapiens
atatctatatatatcctgaccccgggttggctgtgtgttaaaaaatcaaactgaaatcgcctccaaaaggaaggcagcactgaatgacagtaaagtaagggctgggcctggggtcagcagcctggcgtccagccctgccagccactagctgtttgaccttggctgagtcatttcctctccctcatctcatttgccttgtttataaaatggtatccagccaggcacggtagctcacttctataatctcagaaggcgggaggatcagttgagctcaggagttcaagaccagcctgggcaacctagtgagacctcatctctatgaaaaaaaaaaaaaaagaagaaacaaaaaagaagatgtagactgtgtgatctctgaaatttctccatgttcaaaagtctaaccttcgaagacttctaagagttttagaagaaaagtttgagctgctagaggagaaagaggaaacagtttaaaaattaagttagagagttcttgcaaaggagatgtttttgttagagacactgaaaattcttctcttaaaacc

SEQ ID NO: 203339 - DNA, 670 bp, Homo sapiens
gaaaaaaaaattatgaaagcaagtagctgtgccccgcctgccgcacctcctacccatgcctgagcgcactttaccaccaccttttaaagtccagacgtctgcgccattaacttcggagtggtgttcgcaggagcatttgtcgcagtggtctttaattgctttaagtcgctgtccattttgagaatctgataactggacgatctcccagggaaaaagaaaagggggggggcagatttgcatacaatgcggggagaggttttctgaagcccatttccaactttcccgtaaagaacccctggctttgaagagccaagtctttcgagatttaactccaccaacatttagagttcagatgtttttgtaaaatcgcttttttctaagtttgagtggggatttgctttctggaattgactgtctcctgtcttcagatgactgccccgtgtcagcccggcggcaatcgttagtctccgggccaacccaggacgatgctttttggcgttttcaggcaccagcgctgccacctgctggcaaaaactttctctttcggttgtgagggggaaaagcaaaaagcatcaagaacgtaagttgccctgagctaagatcgaaccactgcactccagcctgggccacaaagtgagaccctgtctcttatttaaaataaaacaaaaca

SEQ ID NO: 203340 - DNA, 510 bp, Homo sapiens
cagggtgttcaggaactatgcattaaaaacttagtgaatatagcaatgtctccgggcataaaattaatatatgaaaaccactgtgtttctatatactcgttttttaatagaaatggatgaggcaatttttaaaatttatgtggaaatgccaggacttagccaaaagaatcttgaaatgaaacaaagctgcactacttaacactagctgacttccagactcagcacgaaactactgtaatcaagactgtgcaggattaggataaagacaagtagatcaaaggaagagaacagagttcagaaataggccccacacttggacaaatggctttcaacaaaggtaccaaaacaattaaagagcaaaaggaaaaaatagtcttttcaataaatggtggcagaacaactgaatatccatagggaaaaaagtgaatcctgaccccaactttgcacataaaaatgaatttgagatgcaccacagacctaaatataaaagcaaactgtataacactttca

SEQ ID NO: 203341 - DNA, 438 bp, Homo sapiens
gtagtctgaggttacctagacagtggttcttccagccactgtaggttagagggatccgagttcaggagggcattgtagagcttgggcaggtcacttaaccactttggacttagcatttcccatgtgcaagaagaggcagcttgcattatcttcagggttgcaccaaggaaacgcttcagcatgacttttttgagtgacgccgagtgagaatgcaatttgtcatttcttgtgggagtgactaagccgttgtctgtgtgttataacagtgaattaaaattctaaccctgtttctttggttctttgaatgtatatcaggttcaaagcccatagacttcacaggtgagccactgtgctaatggaaaaaggctactcatctggtagattcttcatataaaaatccatgaagaccctggtagagaaacagtagtacatctgatt

SEQ ID NO: 203342 - DNA, 847 bp, Homo sapiens
agaagctttcagtaaaactaaagggaccttttctgatcaaaccctgtgtatggctgatatatgttctgccaatccagccttgtttgagtttaagggtgccttctggcctggggtcaatttctctgtgattggtttaatgtcatttgcccataagcatacattgcagggtgctgcccaagggcaagtgcacagcttaggtacatcatctcatttacaaatcaccatccggccatgtctatgagcactgagatatgaatcatcattatttatacactttagtcatatttgaagttcttcttactaaccctataaaactctcaaatgaattagaatcctcaaattcacataactatcctatccatttcctgtaggcagagccatatgcaaaactaacccattattgagaggtgcttggtaaacataggcacagaacagactctaatcacgtcttgtaaatctggggtccattataaataataaataaagttttattgaaacaccattatgcatattcattcatttactgtctgtgactattcttacattacaacaatagagttgagtggtaacaacagtgatctacagctgaaaaagctgaaaatgtttactatctggcctaggccagaaaactatactttctatcatgtgtccttgccgtgtaggcaggtgacttatggagaaatgggatgaaaaaaatggacatggtgagtcaatcatcagtagagttgaattgaaagaatgccattagttggagtcagagtcatggcaagagagagagagtgtaaggtaaagttgtgaggaagaagaaaccatgcattaagaagagaaacctggtcaggagacagaa

SEQ ID NO: 203343 - DNA, 296 bp, Homo sapiens
atccatgggaaatcctgctggctctaccttgtaaacaaatctactggttattcattactaagaggaaaaggaaaggttcttgacatggttacaccttaaccaagcgatccaaatcaccatcacaaatgacagaacaaatagacctcaggagtcccctgaagggatgtccttaggaggcacctcgagtctgtggtgttcccgccaaacatgttcaacatgaatccaatcggggaagcaatcaggagactccagacatcgggacacactatcaatcagaggactggctccaatgtcaa

SEQ ID NO: 203344 - DNA, 391 bp, Homo sapiens
gaactcctggctacagtaggaccaagtaaagtcattaatgggaagatcggaatactagagccataagagacattaatgatcatctagttcaacccctcatcttccagaggacaaaaactgaattctgtttccccatcaatcccctatctttctacctcttttgattcatccttcatacagatgcccagcaatgtttctaagaacagttgtgatcattttactcttaagattaaagctctccatcacagccttcaggatctagttcaaattccttaatataacccagaaggcttttgatgatctgacctctgcctttctttaagctgtgcatatttccatgcccctgtaacacacgcatgcacacatgtacacaaacactcccccccacaca

SEQ ID NO: 203345 - DNA, 358 bp, Homo sapiens
taacaaaggcagaaaatcctaaagaattgtaacaattcaatgttcccaaaagacaccatggaccacactccattttatatgacacttatatgacattccatacatgtgtctaacatgaagattgagcagataaaaagtatcactttagtaatcatcctcaatcaacaccagataacaaatgaggggcttttgcttatggaaattctcacatattgagctgaacacttttaccttaattaattaatttatttatttatttattttttgagacagagtttcgctcctgttgcccaggctggagtacaatggcccgatctcggctcaccacaacctccatctcccaggttcaagtgattct

SEQ ID NO: 203346 - DNA, 197 bp, Homo sapiens
caggaggaagaaataaaattttttaaaagcccaagatttaatgaaaatgggaacaaatcatagtggaatgcagtttcaggtatgagctacaagcacattaaggaacattgaagttgagtgtgctttatattcctaatgtcttgagcacactgtgatttaaaatagctattaaagattatgcaaaatgtgcaaaatta

SEQ ID NO: 203347 - DNA, 553 bp, Homo sapiens
atatatgtgtatgtatatttatgcttatgtatgcatttagaaatctgtatcccaaatgttaccagttgatctctggtgaggaggcctcccagaggcctttggtttctgttgcttatacttctgggtgttagagcattggcaaagagcacgtaatacccataataaattccaggaatgaaagaggtacatttgaacaaagggcagcctgtcgtctaaataaagcgcttcacaacgatgctactttggcattcaagtttgagcaattgtgatgcagaagcaatgttcgtgtagagattttgaatctaagaggttctgttggctgaaggttccccaagtgggggcgtggcagagacaggaggggaacattactgcagtagaactcatacaagagaattcagttttctgctgctggtgggtgaaatgatgagatctgtgactgctgtttctgtagtactctgcaaagaaagtcccaaggaatgcttgtcaattaactgagagcaagtcagttactccagattatcaactcagcaatttctgatttgtactttctttt

SEQ ID NO: 203348 - DNA, 512 bp, Homo sapiens
atgggtttgcacttgagaatagactgtttccatgtgcccaccttcacctctcatccaccgtacttcatctttttccccaaacctattgcctgtccctgaaatggacttgctttcagacatttcagaggaagacccctttggggaggctgaccagatcacactagacagcttagagcacctttccacaggtgaaatatcggagcagggggattctgaagttgctatgcctgatttggtcttggattctgccatagccccttctcagcctgactgtccttctcccatccatgggaagactcttaaagcagctgacgacagtgattctgagtttggttacttctccttcagtttctccaaatgttttccctccggcttcccctcccttcttgatgaagatggatatcttgctttccccagcctccccaaggtctgggtctccttcctccccgctggtgtgcagcactatgtcccaatcacctccccttcattcattccttcccttatcctcatct

SEQ ID NO: 203349 - DNA, 375 bp, Homo sapiens
ggagcagagggagtggggcgagagatggagaggaggggccggggcaaggaaggatccctaggtctgccttcctgtccacagcactgcccgccagccacagctcctgagtcaaaggctctgaagcaaagttgtatgatgaaccttggatttcctgtacaatttggctaactctagggtgatctctaataaagacaaaggccaggggacagaaatatctttcttttgctcctggcaaatcccattttgattctatctcaatctaactgtccagaaaattggattgaaagcaggacaccgccgggaggtaaatcagattagggcttcctctaccacagcctccagcagacatttcattttgcagtgtgcgtccctcat

SEQ ID NO: 203350 - DNA, 526 bp, Homo sapiens
ttgaactagggccaagataaaagttcgtcaagtgagaagggctctcctaaattctgtgccaaaatttatagtaaaattctgctacagaagctgaaagatactgaactcatttaattgttttttaactcagcaaaactaaatagattcttgggtaccaattctgtgtatagctgactactgagtaagaaacgccagcaagctggtctttttaaaagcaatgaaatcaaccttttaactttgatgaagtgcagtgagtttttttgtttgtttgtttgtttgttttctttaaagacaggatcttggtctgtcatccaggctggagtgcaatctcactgcagccttgacctcctaggctcaagcagtcctcccaactccagccgagtagctggatatacaggaatgcaccaccacacctgcctactttaaattttcttgtagagatgaggtgtcgctatgttgcccaggctggtctcaaactcttgagctcaagcgatcctcctgccttggcctgccaaagtgctaagat

SEQ ID NO: 203351 - DNA, 519 bp, Homo sapiens
ccaggaggcggaagttgcagtactgtactccagcctgggtgacagagcaagactctgtctcaaaacaaaaacaaaacaaacaaacaacaacaacaacaaaaacccatgcgtaaatgtttatagtagccttatgtatcagagagaaaaacaggcaacagccagctgtccttctgtggggtaacggttacacaaatggtggtgcatccataccatggaatatgactcagcaataaaaagaagtacttgcaaaaacttggtgattctcgagagtgatgctgagtggaaaaaaagccaatcccaaaaggttgtatattgtacgattccatttatatgatattcttgaaatgataagattatagaaatgaagactatattagtaagtggtttccaaggttaaggaagggctagaagtagaaagaaggggatgtggttataaaagggcaaccagggggatccttatgatgcatcttgattataccactgtaagtatcctggttgtgattctgtactatagctctg

SEQ ID NO: 203352 - DNA, 398 bp, Homo sapiens
agaagaaggtaaaagagcttctacttggtatctgagtagcaggaaagtaaaagagaaacgaaaaagctttcagtgcctcaagagcagttaacaaaccctgaaagggaaagagaagtgggcaaaactgcactgcctgaaagttttattgagagaaaagagaaagagctttatacacagggtgaagaaatggcactcttggtggttagaaaagatgataatgtcagttataggtaagagctggtggaaatagtactactcacaagtttttatagaaatctgcatgtagcattcaacacgtaatgaattacaatggatttttaaaagagatcgtagttttaaaatgtagctttggggttggggagatactgttcaaaggatacaaaacctcagataggagg

SEQ ID NO: 203353 - DNA, 488 bp, Homo sapiens
gcatgtttgtttgtgtgtgtgtgttccattttattttaaaaattttttaaatttttaatttttgtgggtatgtagttagtgtatatatttatgggttatgtcagatattttgatacaggcatgcaatgtgtaataatcacatcagggtaaatgggatgtccatcacctcaagcatttatcctttgtgtttcgaacaatccagttatactcttagttattttaacatatgcaattaaaatttttttttactataattatgctactgtgctagcaaatactaggtctttttcattctttcatcctgaatctttgtgctatgatgccggttgagtcagtacatggagatgctggagaactcctggaagccattcctacagtggaatgactagcgaagatgaactataatggaaattgagtgcaaaacacatacatatatcccattaattacaaaccaaatgcattgccaacaacctccctcttagctggag

SEQ ID NO: 203354 - DNA, 750 bp, Homo sapiens
gggcagaagacattcctgtgtcctactagatggagctctgagctagccttgtaggtggggaagatccagattcctgagggactcatgatctggcgctgtcttcactgcatacctgaattccaggttctggagtgggcaggggttgctgagaaccctcgccctttggcctctcccggggaagtgctgctgtgtggtgcgctcactgtcagcagggctgtctgggcagaacaggccctaattcctgctggggagtgggaggggaccctggtgggggcataaatacatctgcattaagctgttcttgcactgctataaaggaatatcagagactgggttatttataaagaaaagaggtttaattggctcacagttctacaggctgtaccaacaggcaccagcatctgcttggcttctgggaagggctcagggagcttttactcatagcagaaggcaaaacatgaacatacatgtcacatggcaagagcaggagcaagggggtggggggaaggtgccacacactttaaaacaactggatcttgcgagaactctgactatcgcgagaaaggatagcaccaagccatgaggtatccacctgcttgacccacacaccttccaccagaccccatctccaacactaggattacatttcagcatgagatttggcagggacagatacccaaaccatatcaacatctgagtctgacttatcaccagaggaatgcaggctgtggcaggaagtgagtcctcacg

SEQ ID NO: 203355 - DNA, 327 bp, Homo sapiens
ccatattggggccatcatttcaatcaggaattaccagctctgtatattccaaaggttatgagggggcctgtaacatggcacattttcattttttcttctgattcttattctttcagaagtagctaccttttgaccattatcaatttttaaaaattgtactttgcacgtttaatccatttttaaccatacaataattacactcgtgtggtggtaaaattatgtgtcgttggggaatgcatataaaaacttgatgttaaacataccatagattcactcaattttttgatgggaaattttctgagcaaaagctgtctaaaaatggttctg

SEQ ID NO: 203356 - DNA, 366 bp, Homo sapiens
cggacgctgggcggcggggcgtggggggcgtacctgggggtcaagctggcttcaacaaaaatgtttaccacttatcgggggcataacttttttgaggtaaagatacatttcatcaaatctaagactccatcgactgagacacaccactgtttatccacaggtgacatcactgcctgttgagagactgcgtggtgcacaaggcagtcacaccggcctcatagacgtctcctctattccaaggagtctggctctctcctgacttcagttgcacggctttgcttccaacaggtaatccccttgcttgtggctcagtaataaagcaaagcaggactcacgacaccgcttcaggggccgcccttgctcaga

SEQ ID NO: 203357 - DNA, 931 bp, Homo sapiens
ttcagtgcagctgaaacaaaagtacaaggggagctggtgagaggagaggtgggtgcagggagggagtagctgcccccagtgtcaggctaaggagttcggcttttaaaattagtccaatgtctagcatacagcaggtgctcaggaaagctggagacagagagtcatcagttagtttggggacatggaagtgggtaggcggtcccttggctgcaaagctcccgggtagacagtcccttggctgcagagcttggagctgctagtgacccaggagactacgtctgatgtgaaatgaaattgaaagtcgagcagagagtctggctaagaccttctaagaggcggaaaatgatgtggaggcagggagagggaaccaggcccccagagtcagaataggcagcaggaaggacataaggcctgctgcttacggatctctcatctctgtccacagtcacatttggcaaaggctgcatttctgctctgacgtgtggggctctctccagcaaaatgatgttatcgcttttcctcccagcatggtgacggccctggtgatgctgtgatcagtgtgtaattaaaggcagccgtgcatggctgctctcagactgttgctgagggcttctgatcattgggaaatctcagtggtgtaggttttagtggaaactgtatccagccaggccattcatagcttctacaccatagagggaatgttggtcattatcagagggcatgggtttcacttttttatgtctgcagcctgagtcgggtgaacctttctcttaccctagggaagcactagaataatgcctgcctgcctacctgactgccgtcctgccatccccgtctgtccatccgtccatccatttatccatctaaggtgacagcaaagatttactgtagaaaatctctttcccacagtaaaaacctcttttctacagta

SEQ ID NO: 203358 - DNA, 504 bp, Homo sapiens
tagcaaagaaaatctataattacctggaaaggctgttaaagatattccttctttttgtaactacatgtctgtgtgaggcagaattttcttcatatacttcaaccaaaacaacatgtcacaacagattgaatgcagggatagacaggagaatccagctgccttctattaggccagatgttaaagagatttgcaaaaaatgtaaaatgatgccactctttttgctaacttttttttagaaaattatttataaaagtgttgtttatattaacgtaatgggcttattgttttaagctagtaagtatcttaaacatttctcagttttaacatctgatatgatacatattaatagctgtcaccccctaaaacaaaactcttttgggatcttcaccaattttgagagtgtaaaggggtctgggagctttcaagttgctgaacacatggaggttcctggaggatggtgtgcccagggagggcgtggaagctcctcgcccctttcctcatcaa

SEQ ID NO: 203359 - DNA, 346 bp, Homo sapiens
taacaaaactataaaatatactccaactatatattttattgtaagaagctgagtttatattaccaaagatactatattattaggaaagctaactttaaatatgactattaattccatgtacatgagggacctagagtagatgaattcagagagacagaaagtagagtggtggttgccagaggctggaagagtggggatgaggagctgttgtttagtgggtttagtttcagttttgcaagattaagagttctttacaacaatgtcaagtacttaacaatactgaactatacacttaaaaatggttaacatgggccgggcacagtggctcatgcctgtaatcccagca

SEQ ID NO: 203360 - DNA, 621 bp, Homo sapiens
tctctaaaatgtgaaagataaaagcataaaaatttttataaacatctgctaacataccacatagaaaaatacaattagcaacatcaccaacaaaattgagaacaaatgtaatgagaaagaattgttgaatgcaactgaagtttattttttaccaggttaaaatatattgttgtatcttttagaagttttatgtaatctccaaggtacaagaagaaaaatacctgtatagatacacaaaagaaaataagacagaaatgaaagcatatcggtaaaaaaaataaaaaagacacaaaggaagacagaaaaaagaaaatgagaaagatgtaataaacaatgaaataacattagtaagtctttctcagaaaattacttaaatatatataaaattaacttttggatcaacagatatgcttttttttttttttttggaaagggggtttaaccttaggtcacccaggctaaagtgcaagtggcacgaattcaacccatgtgtaacctaaacctccgtggttcaagcaatcctctggtttaagcctcccgagtagctgggattccgggtccccaccattatgcccagctactttgggtttttaaagtaaagatgggtttccactttggggg

SEQ ID NO: 203361 - DNA, 731 bp, Homo sapiens
catctcctactgaaccaatataatagcctcctaattaatctccctaaatctattcttgccctctccctgaccctttctctacattgcaaccactgacattggtccaaacgcattactactctgctgaacttctgccttcccaatggcttcaggataatgccctatttgatctgacctgtctaccttgtcaagaattttaactctctccttcacttatgtttcttcagttacaatggcttttttggtgttttgtttagttggttggcttagctggttggcaggtttctcaaacatgtcaaattctttccaaccttaagagtttctgcatgtgctaatcactctgcatctttgcctggttacctcctagtcaccctttaggtctcaacttcaaagcctctctcaggaaagtgttctctaatgtttctatctactactgaagtctagattagctcactctatcatatactgttactgcagcctatgtttacctttgtagccctttgtgtaactgtaattaacattactagtatttgtttaatgtctgacttttccaccagaccagaagctccatgacagagggaccatacctgttttatccattactgtaagccagagcgccctacatggtatctgaacatggttaaatgcttagtattattttctcattcctaccttaggactttgcattgcctgttccctatacctagggccccagacctggtccccagaac

SEQ ID NO: 203362 - DNA, 632 bp, Homo sapiens
cctgcggccactgttcctgaagtggcctctttctgccttcccaatggcttcaggataatgccctatttgatctgacctgtctaccttgtcaagaattttaactctctccttcacttatgtttcttcagttacaatggcttttttggtgttttgtttagttggttggcttagctggttggcaggtttctcaaacatgtcaaattctttccaaccttaagagtttctgcatgtgctaatcactctgcatctttgcctggttacctcctagtcaccctttaggtctcaacttcaaagcctctctcaggaaagtgttctctaatgtttctatctactactgaagtctagattagctcactctatcatatactgttactgcagcctatgtttacctttgtagccctttgtgtaactgtaattaacattactagtatttgtttaatgtctgacttttccaccagaccagaagctccatgacagagggaccatacctgttttatccattactgtaagccagagcgccctacatggtatctgaacatggttaaatgcttagtattattttctcattcctaccttaggactttgcattgcctgttccctatacctagggccccagacctggtccccagaac

SEQ ID NO: 203363 - DNA, 426 bp, Homo sapiens
tatttaataaatatttaatggccatattcccaattcagcacctttggtcccattatcttttgtcctttcctcttatgctgtttaactatttaaatcttttccacccctcaagactgagctcagttctccctctttgaagtctatcatggttttgcaacagttaatctttcttctctaaaattttatagcatttattgccagtaccaccttgtgttcatggaaaatcacactatcacatatcttattttacctagttgtatcaaaagcttcttattttctcagaaatcttgtagcttgttatgccagtacccctcatatttttggttaacttgaccagcttctattaatatcttaattagctaatttgactggaagcttctcgatcagaagctgttttagctaatgccctcctcagttattttcact

SEQ ID NO: 203364 - DNA, 833 bp, Homo sapiens
tcttctctcgccttctctcctccctcctctccagcatcctggggtccgttggtccagatgaaggtacttgccaaggagggagcccacaggtcgatggtcgcgggatggggtcagtggggtcattgtctctcttggctgggaccttaccagtcatgtcagcttgagccacctgtcacttcgtggtggtgctgggcccagaaagcagggcagacctccagcctattaggtcatttctgatttgggattcgtcctactatatgtggctgaccttacaccccagctgtgtcatcctgcttgtcccaaggcctggggtgccatccatctctctgaaaccccatcagcccagatcccgagggctgagatggtacctctgtaggatagcagagtccctacaatcttactctcagtcccagcagcagggacatctttgcctagcctgggtgggggatggaactggagaaaggttttgattggctttgggcctgcagacggcactcacagggaaggggcagagctagcctaggaagaactctgctcccagctgggggcggtggctcacgcctgtaatcccagcactttgggaggccaaggtgggtggatcacctgaggtcaggagttcaagaccagcctgaccaacatggcgaaaccctgtctctactaaaaatacaaaaagtagccgggcgtggtggcagacacctgtaatcccaactactcgggaggctgaggcaggagaatctcttgaacctgggaggtggaggctgcagtgagccgagatcacgccattgcactccagcctgggggacagagtgagactctgtctcaaaaaaaaaaaa

SEQ ID NO: 203365 - DNA, 837 bp, Homo sapiens
cagagatccccccgaatatggggaagatctgagcaggactggagcctagagaataaaccagatgaaggtacttgccaaggagggagcccacaggtcgatggtcgcgggatggggtcagtggggtcattgtctctcttggctgggaccttaccagtcatgtcagcttgagccacctgtcacttcgtggtggtgctgggcccagaaagcagggcagacctccagcctattaggtcatttctgatttgggattcgtcctactatatgtggctgaccttacaccccagctgtgtcatcctgcttgtcccaaggcctggggtgccatccatctctctgaaaccccatcagcccagatcccgagggctgagatggtacctctgtaggatagcagagtccctacaatcttactctcagtcccagcagcagggacatctttgcctagcctgggtgggggatggaactggagaaaggttttgattggctttgggcctgcagacggcactcacagggaaggggcagagctagcctaggaagaactctgctcccagctgggggcggtggctcacgcctgtaatcccagcactttgggaggccaaggtgggtggatcacctgaggtcaggagttcaagaccagcctgaccaacatggcgaaaccctgtctctactaaaaatacaaaaagtagccgggcgtggtggcagacacctgtaatcccaactactcgggaggctgaggcaggagaatctcttgaacctgggaggtggaggctgcagtgagccgagatcacgccattgcactccagcctgggggacagagtgagactctgtctcaaaaaaaaaaaa

SEQ ID NO: 203366 - DNA, 452 bp, Homo sapiens
cagacaaatacatattattttcaagtgtccagggatcatataccaagacagacgatgccctgaccataaaacaaaacttaactcattttaaagaattgaaataatacactgtatgttctctaagcccaaaggcctcaaactagaaatcaataactgaaaaaaaacaggcaagtatccaaacaattgcaattgaaagtaacacacttctaaatcattcatgtgtcaaagagaaaatctcaagaaaaattttaaaaatcaaattgatcaagattgaaaatgtacaaatcaaaacatatgagactcagctaaagcagagagggaaatttatgacattaattgtttacattagaagagaaaaagttccatatcaataatataagcagatcaagagcctaggaaaaggagaggaaaataagcctaaagcaagcagaaagaaggaaataatcagagca

SEQ ID NO: 203367 - DNA, 389 bp, Homo sapiens
tgtgaagagatcacatggctaaagaggaagcaaggaggggaggaggtgccaggccgttttaaacaaccgtgttcctgtgcccagtttcaaaatagccttcagccaagctattgaagcagcctttgtgaaactggacacaccagctacttcagatcccttctgtggtaagggcagaggctggagtgcccagggttgtcaaacacacatgtactgccattcccactgggatccagtggcagacatcactcatcagctctttcaggaatgaatgcgagaataggtctcccatcccccagggagggcattaatctgttcatgaggggtccacccccatgacccatacatctcccattaggtccccacttccagcattggggatcagattttaa

SEQ ID NO: 203368 - DNA, 895 bp, Homo sapiens
tagtttcactttgagaacccgtcagacaggttcaacagcaccaggtctattatgacagccagcaacgggcctggccagccactgctgcatcagagctgcacagaaaacctgccagcttggtgttggtgttggtggagatgaagttcctcaaggccgtggatgaaacacgcccagtgccaccggctggcagaggggcccaggacaacctagacgtgccatcttacctgctttgctgagccctgggccttctgccttcactttgctggcatcgtgggaagggtcaactttgactctgaaagggctggcggggatttcctgtagcagagacacagtcttagtaggaaagcccctgaagcaacagccagagctcagggagccttcaacaaagggtgaaccttagcatcactctgacttagcgagtggtgagcagacttctattaccacaggtaaacagaagggtaagataagccaaaagggcccagcattgggaaagggccttctataacaggtcactctctaatgcctggatccctgatgtcacaaacaaacccgaggactttgagcctttaatactgaatgttgagtactcaggatgaaaaatgccaacaagaataaaaccaaaaacgacaataatacatggggctgggggaaggaaatgtcctccagggacagctgagagctaaggtctggggaaatgcaagaagtgatcagagacagaatgattataattcttcaaaaagaatgttgcagactattggaataaaggcagaagaggttaaatggatgtcaagaccactacctttaggcacagaacattctactaagatttccatttttatgtaaggttaattttaatccctaggatttcaaaattctctctttcaggatcctgctc

SEQ ID NO: 203369 - DNA, 607 bp, Homo sapiens
gcacatcatacccagccaacccattgtggacatggaatgtaagaaatcaaccttggttgctaagctgctgagactctggcgttaatttgttaccgcagcataacctagtccatcctgatgcatgcagcatgcaaaccacttatgttgacccttagccatggtaagtgctccacagatgttggttacttttggtaggaagatagattgcctctgaaagttttgttagctgatctcatgatgccaatgttgctattttgtaattggataaattggacttggctctccttccggcatgtgggagagaaagatgactgagagacaataaggcactattatcttcagtttgtgtccttggatacccttggtggcaatgaacaatgcatgcccctctgagaaaactggacctaaaggagaatgggagatgataccagaattgggaaagtccaaggccccaggcattccctggtctggagacaactttgagtccttggtgggaagattctccaagggaacataaatgcttctactatctagtttgtctctttgagaattaaaactttttttttcattccagtagcttttggggtacagttcggctctttgagaa

SEQ ID NO: 203370 - DNA, 131 bp, Homo sapiens
tacaacatagactatacttcttgagcaaattagccaaacattcagtttagctaagtttctcttagaaatgttgcaccaccatataaaaatcctgatataaccccagtccaagcaatctgttctataaatta

SEQ ID NO: 203371 - DNA, 450 bp, Homo sapiens
tcagaattacaaggctagtaactaagcagttgtggttttgcagtagaaactggatttgaaaccagaactttgtgacctcaaaacttctccttaccacgtgtatacaatgccatcttataggttatacagtgccctaggaatttttttttacacagaaaagaattatatccctactctcagatacacactagatataaattcctgtaattagtgatagcttctttattttttaaacattcttttgctaaaaaggaataatagcaagaaaagtaataactagttttgctgaacaagaatagtaactgatctgaaagtaaagaagagagaatatgggccgggcgcagtggtttacgcctgtaatcccagcactttgggaggccaaggtgggcggatcacgaggtcaggagatcgagaccatcctggctaacatggtgaaacactgtttctact

SEQ ID NO: 203372 - DNA, 681 bp, Homo sapiens
  misc_feature (306)..(306): n is a, c, g, or t
agagacccaaattgaaattagaagccaagaactttaaaagaactattataagaatatataggaaaagaggctgggcatggtggctcacgcctataatcctagcactttgggaggcagaggtgggcagatcacctgaggtcaggaggtccagactagcctggacaacatggtgaaaccctgcctctactaaaaatacaaaaattagctgggtgtggtggctcatgcctgtagtctcagctacttgggaggctgaagcatgagaattgcttgaacccagaaggtggaagttgcagtgagccaaaatcngcgccactgcactacagcctgcgcgacagagtgagactctgctcccaaccgccaaaagaatatataggaaaagatggtttggctgagtaaatatgttggggaattttagaagagaaagtgaaacgcctgaaaaagaaccaaatggaaattatagaacttaaaaataaaatatgtgaaattaaaagttcatggttgtttcttagctgttaatgaataatgctgcattgaacatgagaatgctaatatttctttgagaatcctgttttcaattattttggataaatacccagaagtaggattgctggatcatatagtggttctattttttattttttgatgaacctcattgctgttttccatctcagctgtaccatt

SEQ ID NO: 203373 - DNA, 331 bp, Homo sapiens
tgctttttgacttaaagtttatttgtgtgacttaaagtcacttaagtctgttattagtgtaactacccgagctttcttttagtactatttgcatggaatatctttttgcatacttgcattttcaacctatttgtgtcttccacatatcataatgtagttgaatcatgttttttaaatgtatattgccaatctctgtcttttgattggagaatttaatccgtttatatttgaactaattactgataaggaatgacttctgccattttgctatttggtttccaaaaaatttttcttttcctccaataaagccctttgtgtttattttcttgta

SEQ ID NO: 203374 - DNA, 916 bp, Homo sapiens
tagctaattcctgttcatcccttgcatctaagcttaggtcttatttccactggcctgtaagcctctcaaataaaaatatttaaaactcctaaatggaaagaagattaaaaataatggaaatggccaatgatgtaccaggagcaagaatataatattgatactaaataaaataaaacatacttcaaacctcaaggcattaaagggacaaagaggaatattatataatgataaataatcaaaacaacagtccaattttcaaaaaatggacaaaacttatgaaaagaaagttcacagaaatggaaatattaacagttcttacacatatgtaacggtactcaacctcattcataaggcatatgtactttaaaattacactgagggctgggcatagtggctcatgcctgtagtcccagcacttaatgaagccaaggctggagaactgtttgagcccaaagttcaagaccagcttgggcagcacagggaggcattgcctctacaaaagataaaaataaaattagccaggcttggtggcatgcatctgtagtcccagctgtttgggaggctgaggcaggaggattgcttgagcccaggggtttaggctgcagtgagccagctgtgttcgtgccattgtacttgtactccagcctgggtgaccctgtctcaaaaaaataaaaattaaaccctggttgtttcggttttccctctaatagatgcggcccttacacaaattgcgcgcgttcgaaacaaaacttcggggcggcgcggggggtcaccctataacccaacttggggggcgaaaggcaaaattgggccagggttgacaacccggcccagggaacccgtctctcaaaacaaaatcgggggggggcgcctccccccacacggggggaaaaatagagacgggccacaccacccg

SEQ ID NO: 203375 - DNA, 715 bp, Homo sapiens
tagctaattcctgttcatcccttgcatctaagcttaggtcttatttccactggcctgtaagcctctcaaataaaaatatttaaaactcctaaatggaaagaagattaaaaataatggaaatggccaatgatgtaccaggagcaagaatataatattgatactaaataaaataaaacatacttcaaacctcaaggcattaaagggacaaagaggaatattatataatgataaataatcaaaacaacagtccaattttcaaaaaatggacaaaacttatgaaaagaaagttcacagaaatggaaatattaacagttcttacacatatgtaacggtactcaacctcattcataaggcatatgtactttaaaattacactgagggctgggcatagtggctcatgcctgtagtcccagcacttaatgaagccaaggctggagaactgtttgagcccaaagttcaagaccagcttgggcagcacagggaggcattgcctctacaaaagataaaaataaaattagccaggcttggtggcatgcatctgtagtcccgagtagctaggactacaggcacttgccactacaccccactaatttttgtatttttagtagagacggggtttcaccatgttgaccaggctggttttcaactcctgacctcgtgatccacccgacttgacctccgaaagtgctgacagcagatcgacctgagtcaggag

SEQ ID NO: 203376 - DNA, 541 bp, Homo sapiens
ccggtttattcctcaaaagacaacagagttgaactcattttatgagcttgaaacattagcacaactggtctgtgtgttcatctgcatgctggttgtcaagaaatctcaaaagaaaagaattggttgggcgattttaatcttatttattcctcccccaccactcttgctatagtaggacatgagtaataaattatctaaaaagaactcaagatacagaatctagccaggctctaatgaagattttctataaatctcagctaatgcatttctccttcagacctgacacatatccattctggaattccactgctcctgggcgacagctataactaatagctctggaaagttcaatgaactttccaggaaagatggagggtggggacggggacagatttgttctcatgtctggaatccctagggagaaaataaagatctatccaaaacccagattttctcctaccatgtttctaccaccatcataatgtggatggggaggtagtctctttactttatacaatagttgtagaatgtaatgattaaa

SEQ ID NO: 203377 - DNA, 192 bp, Homo sapiens
gggaccaggaagggcagtgtggaggcgttctgtgtcctgagtcagtgccaatgtcctggtggggaggctgcactacaggattttccaagatgtcgtcacaggagagaactgtgtaaaaggcacaaggaacctctctgcattacttcccacaactgtatgtgagtctaccataactaaatgactaataataaa

SEQ ID NO: 203378 - DNA, 220 bp, Homo sapiens
taattgaattcaggtcctctgttctgctgtcagaaggcattctttacaaaagcccacctctgagccatccttaaggacacagggagaactccatggctggggcacctgcacggcgcctcttcacactccctctccctgcccaaagccttgggccactcctcacttggcatttcttccagagcactcacaactctggcacttccctggacagtatctaaca

SEQ ID NO: 203379 - DNA, 418 bp, Homo sapiens
ttgatcggcagagataggtatccaggtagaggatcaaagactaggatgagaaaagaataaggccagttctgtgaatacccagtgactaacacaaggctaggagaaaaggagtattgattgctattataaagcattaccattaatatgtaatttcagctagctatgaactcaaatacgtttatgaagtaatgagatattttagcatttttttctcatgtgctactcctaaaagttactcttaaaacaacagggttgacaaatatgtttaatatatggcaaaatagacatagatttaaaaatgcactttagtatcttgctatttgattgtgtggtcctcagatgagcagcattggcatcacctgtaacttgttagaaatgaagctaatgcaggatgttggcccccaccccaaacctaaca

SEQ ID NO: 203380 - DNA, 498 bp, Homo sapiens
ttgctttgctttgtgtgtatttgtttgtttcattttgccaggggcatttggtgctcagcccttaccccctatgttttgtgaagcatatcttattctccaggcatgtcttattctccctcccttttatcttgtcctgaacacaggctagggggatgacatggtttccttttaggttttagaagaaacaggagtcttatttgattcctcctttgaaagaactgctgccatgggtgatttcctcattgatgcaaagaaactatgctttgccctacctttgagagcatttacaatagaaagtctacttactcttccagtgaactgatatatacttagtctctgccctgtgtctgggacgctgtgagatgctggtgaatttgctagctggcgtgatggattgtccccttacttctctgctttcactccccaacagatgattattgttctcctgtgcaaaggactgtgaggacactttgaaataaaaaggtagtttctgccctc

SEQ ID NO: 203381 - DNA, 298 bp, Homo sapiens
tatgcatgcacataaagatttcacctggggtttcttttctttaatagaacatttgtgcattttaatggaccagtcatgaactttgcttaatcaccctttgtggaccttaatattggataagtattcaaagcacatttctcttgggtgatatagactggagaagttcaggaatgtttcccatccatcaagaaaacagaggatagaacacattcagttgccatatagggaacaactggccccattctccctgcctttgactgccctttctgatggtgagagtgaatgctttgagtgttcc

SEQ ID NO: 203382 - DNA, 376 bp, Homo sapiens
tccgggcggattttaaagattcccgtgactctcgccgattaagtgtatgcttacagatagcattttaaaattaatagaaaacaggatgttaattatctgaaagttcatgttttctttcatcagatactccgacttcgttgttcatgaaataggaaaagatggacggatcagccatttgaatgacttgtccattccagtggatgaggaggtagaagtagctctttagcaaatgtcaccttctgtataaaaaatagcatttcctagagatttagaaatatagagctttattaaacttgaattctatgtatgattcattgtgagttctcatggttattttaaaggacccttcagaagacatatttacagttttgacagc

SEQ ID NO: 203383 - DNA, 428 bp, Homo sapiens
tccatctcaaaaaaaaaaaagaaaaaaaaaattaactccatgtgattttgcactgaagattttttaaaattccttgttttgcataatagtaaggcttgctgttgatcaactttatcttaaaattaatagaaaacaggatgttaattatctgaaagttcatgttttctttcatcagatactccgacttcgttgttcatgaaataggaaaagatggacggatcagccatttgaatgacttgtccattccagtggatgaggaggtagaagtagctctttagcaaatgtcaccttctgtataaaaaatagcatttcctagagatttagaaatatagagctttattaaacttgaattctatgtatgattcattgtgagttctcatggttattttaaaggacccttcagaagacatatttacagttttgacagc

SEQ ID NO: 203384 - DNA, 366 bp, Homo sapiens
gccagacacaaaagatggcatatgttcactaactcagcagctctctaaacccctttgtttagaagattttatagaggttttattacataggcatgattgattaaatcattggctgttggttattggcccaatctccagcccctctgccctccccagaggtgggaggaggggtggggctgaaagttctgaacctagttgcatggttggttctgtaacgagactaaaaagagattccatgaattgtgtataatagtgcggtgactggtacagagtaaatactcagttacatgttagctgccattactgttactgttactggtttttgaagatcttgttatgttacagtaatttatagagaaagtggct

SEQ ID NO: 203385 - DNA, 255 bp, Homo sapiens
gttactctagccaggagcacaggcatgcttgtagttgcttggctagactaaggcatgtctgctggggatggctcatagggctgtttctcagccatgtatttaggctcatggctgcttcaacagtctgcaatgtttccaccaggggtggcctacagcattgtttctcagacccttgttgaggatgtgagggggttgggcaggacatgtcttgggagggaagagggcactgtgtttctgaatccctgagtgtgggca

SEQ ID NO: 203386 - DNA, 486 bp, Homo sapiens
tctcagggtattcttacctaagtgattgaaggaccacacttagactgcatactctatatctaactcagtactcatggcttcagctgccatctatgtatattgatgacttccaaacccttatctttgtttttattattattattattatctactgactgagctagctggggccaaatccttatctttaaacaattcttgaatgtcaaactcatctataaaattggcatgtctctattaaagacagaatacactccgaactaggatacctgggttcaaatcccagctcagccccttaatagctgcatgaccctgggcaagttacttaacttctcagatgccttatgtaaaaagaagttaatacctcatagtgttgccttcatgattcagtggctcaatcaatgcatgtaaacttctttgaccagtgcctcacatgtagcaagctcaatataaatgttagctgttttttaaaaaatgttatttcacaag

SEQ ID NO: 203387 - DNA, 659 bp, Homo sapiens
tccatgtctgttgttcccctctttgtgtccatgtgttctcatcatttagctcccacttataagtgagaacaggtggtatttggttttctgttcctgctttagtttgctaaggataactttccttgattctctgcagccaactgctgatgatgcatttacttcaactcccaagttcagcagtaaaattaaaacaacaataaatttgtgcttaaagaaaaagagcaaagaaatcaattgcccaagtcagcaatagcttttcttcaattaaaaaaaaaaaaaagtctggcagatttcagtccccaattcctaaaactccaagcgaggttttgttcagccttttagacattggttaagtggaaaaaacagtaccaaccccaaaatactgaatatattgctaaacaagtttagagtttggatagctacctttagggatgaaggtatgaacatagtaataagaactactattcatttaacacttactgtatatcaagaactttgctacatattttgcatttgatctcttgacaacccattggggtagttaatattctcctcatgttacagatgaggaaaaatgaactcagaaattctgtgtttgtttacagggctgtcaaaccgaggtctgacacctatgctgaatctgttctaggaactcagtt

SEQ ID NO: 203388 - DNA, 437 bp, Homo sapiens
aactgaaatttaaaaaaggaacatttactagtagaactaagagaaaccaaggaagattgtactaaaaacctttggtactcttctgttatactaggttttagctatgttcaaatgactcagaggcccatggatttgtggagcataaaatagaatcttgcatgagttggacaggttttctgaaataagtctcatagccaatgagcatcccagtggatcaccccacactgtatctgaaactagctttggttttctgctgaattctcatgaagttatttaaaaagtatttttttgtgtgtgaaaatttgctatcaaatgagagataaaaatattagtaaagccaatgtcatgctcaactagaggtgtgatgataaacataagacacgactcttgagagaacagtgatttggtggaaaagtgatttacaacaaagccagaag

SEQ ID NO: 203389 - DNA, 556 bp, Homo sapiens
  misc_feature (80)..(80): n is a, c, g, or t
ttttgggatttttaatctttaattttcaagatggttaaaatattgaaatgtttaagtggataactatattattcataaantgactgagtgaaaactaatatactatgagatgaaaagtacttgtcagggattttcaagcttttgctcaagtaattaccatgaagtaacaatttctagaaatgaagaacaatctgtgaagataaattaccattggtgtggggaaaaaaagccaaacagaagtagaaaaaggtgtagctggcatacaaatgttatctacagtgtatttattttttttttaaacttttaattaaaaagtaaactttaatgtcgaaaatgcaaacttggggaagacagaaaagatcacacacaaggctgtcacttaacacttggaaggttgcacagtggctgggcagaggtgctcctcacttcccagatggggcagcgaccaggcagagacacttctcacttcccagacggtggggcggccgggcagaggcactcctcccttctcagacagttggtggccgggcagagggcattcctcacatcccagatg

SEQ ID NO: 203390 - DNA, 687 bp, Homo sapiens
cacgagtgagaacacaagcacactccaggctctcacccctcttgtgccctgcccagaggagccatcatacatggcagtgtggctatggggtgagatctgaaaatagttctagcggccctggagttgtatacaactgtactaccagggctgggttattctgcctgcccctgcttcagcatgagcctctaggcaagagagtcctgttaacttctgctctttcttctctttcctctgctttaaaaatggaagaagagccaggtataagcagaacaccctggcagaactttttacatttggttactgcttgggctacttgctactctgagtagaacgccttcaggggttggcaaactataactggtgggttaaaccctgcccgccacttgcttttataaggttttactggaacatagccacactcgctcatttacatgttgtccatggtctctggaggcttctgtgttccaacagtggcgctcaagagttgtgacagggccataggaatcacaaggcctaaaatatgtattatctggctctttatggaaaaagttttccatgcctgttctaggacgttccaggaacttggagggtgaaaaactgttgtaaagatcaagaagcttgtaatttctcagaaagcaatcaaacacacgacagagaaaaaaagttatttcatatcctatgtttaaa

SEQ ID NO: 203391 - DNA, 287 bp, Homo sapiens
ttatcgttggtttgctgtgtcccaggtacgtcctaaatgctcttatgatcattttcttgtttaatgatcactccagtcacataaagaatacatgattattatcctcattttataaataaggaaacttaaagatgttaagtgacttggtcatgattgaggcacatccaggatcaactgcttattcattcactcattcatttcttcattcatttagcaggcacctaccccacctagatagatacgccaatctaccataaataaatttaacattacaacacaataacctc

SEQ ID NO: 203392 - DNA, 246 bp, Homo sapiens
atttttaaaattttttgtagaaacggggtgtctcactatgtggctcaggctggtctcaaactcccagcctcaagtgattcttccctcttggcctcccaaagtgctgggattataggcttgagccacaatgcctggccttgagtacagaatttctttatggggtgatgaaaatgttctaaaattggttttggtgatggttgtacgctacaatgtgaacttaaaatgggtaaattatttgtgaatgag

SEQ ID NO: 203393 - DNA, 901 bp, Homo sapiens
aggatatgggttggactttgggatgaagaggaaaggggaggaagaatgggagtagcctagggagagacagagaagcagaaatagagacagtgagatgagttagggggcgttgtagtaacccaagcaggaaatgaaggcttttaccaaagtgcaggtggtgcacacagaggaggcatgggtttaagagacacaccgggcagcactggcaggatggaagatgaaggcacagtgcagatgaccagggttcccagcaggagagactgagtggagggagggtgggacctgttctggaaaagcagggagagaggattagttcagctggagtctcctgagggtgagacgctggcgggtgcccaggtgggaagacaggtgggcagacagtcggaaacttgggtctggcacttagaagaggagatgaagctggcaggggttctcagtgttgactgcacatcagatgtctggtttttaaaaatcagatgcccaggccccaccccaagagattttgattctgtgagaaagaaaggagagaagaaagacagagagagaggaaggaagggaaagaaagaggaaagaaagaaaagaaaagaaagaagacacctctatcaaagattctggggcccagctaggaattataaagtcaggtacagatttgaatcccaattccaacctatactaactgtgacttcacggggttactgatgcttagcttcaagttccttacctgtagaataaggccagccatgccaccgaggtatttccagagggattgatgctgcctccaaagaattgctttgaaggtcaactgcatttccagcaccaaactaggtgccatttaaaaaactccaagattgggtagatatgctttatataaccatttcagaaaggcaatttagtgtggtta

SEQ ID NO: 203394 - DNA, 1344 bp, Homo sapiens
gtggtgagtgggagctggcgctccaagggtggtcccggcatccttccctgtggcaaactaaccctaaccctttggctactgcagcgctagtcttgcagtggcagaattggaacactgggagatgcaaatgaagctgcttcctctctggccctggtgcttcgtatgtttctttttccctgccttcattttttctggcttttagagccgatggagcagcacatctgtggacaaccttgtccccagtgaccactttccccctgtgccttattaggaaaggcctcatcaccccagaggagcttatgcaatgactcagagccaattcctgtaagaaacactgtggacagagctggggcttgaggacttcattcctggtgatgggtgtccctgtgagctgagctctgcagagaatcatgcagcttccctaaccatcggcccagcagcttcccagacagaggagacttctgctgttgctctaaacagacctagtcatcagtgagaacagcacagaatcctccaggatcactgtactgcagcctccctggaggctcacctcctgccagcacagtacttacagaaaccctagggggcagagggtggcatggtgctgtcaatcagagaaacagcccctgtgtggtgggctgaaaacacagggcctggctgcctggggcccacttggtatggctgcacctttgtctcctgctgcaagtcctctctgagtgtttagccagtgctaagacaattcagggaaggggatgtgttcagggagggacagggccttgctgaggctggcaggcagaaatctgctgctggggtttgcctgttaaggaatgtgaacaaagctgtctggcggcagcgccctcctggcctgcatctctggtggcctccctgctgatgtaggaaaccagacggtaaaagggacccagatctcagcctgctgaccccagcatccttttcttacaagtctgtgctagaaatgaccatggtagcttttgtaaaattgttgcctgtatttacttcagacaggatgtagagagtgagctagtttagttattcagctagatgattataaagtagtaatcaaaatagggccttagaagttatttttaaaacatttctaagagtttgcttagggatcatattgatggacagtatagcatgacttttgaaatctaccagccctaagtggtttccagctagaccacttattagcttgatggaacctggagaattgtttgacttctgagcctcagtgtcccccccttgaaataggaatgatacctggctttgctggtggttacacggtatccatgaggcattgatgggctagcataggtcaagtgctta

SEQ ID NO: 203395 - DNA, 375 bp, Homo sapiens
ataggatctccagattcgaggagactctctacatcctgtatttacttcagacaggatgtagagagtgagctagtttagttattcagctagatgattataaagtagtaatcaaaatagggccttagaagttatttttaaaacatttctaagagtttgcttagggatcatattgatggacagtatagcatgacttttgaaatctaccagccctaagtggtttccagctagaccacttattagcttgatggaacctggagaattgtttgacttctgagcctcagtgtcccccccttgaaataggaatgatacctggctttgctggtggttacacggtatccatgaggcattgatgggctagcataggtcaagtgctta

SEQ ID NO: 203396 - DNA, 199 bp, Homo sapiens
ctcattcccacccctatccccagtaatctattttctgtttgtagatttgccttttctatttaatataaatagaatcataagatatgtgactggattcttttgcattgagattcttttagttagcatgttttagaggttcatacatgtcgtagcgtgtatcagtactttcttcctttttattgccaagtaatactccatt

SEQ ID NO: 203397 - DNA, 518 bp, Homo sapiens
catttagcattaggtatatctcctaatgctatccctcccccctccccccaccccacaacagttcccagagtgtgatgttccccttcctgtgtccatgtgttctcattgttcaattcccatctatgagtgagaacatgcggtgtttggttttttgtccttgtgatagtttactgagaatgttgatttccaatttcatccatgtccctacaaaggacatgaactcatcatttttttatggctgcatagtattctttatgagaatacgcagtttcaattttatgtggatttgtggggttctttgccatgtatatctcataaatctgagttaagtaacattgatcccattttacagatgagaaaactggggcagttgatttgcttgagattatttagccagaaagtgactgagctatgagttgaacctaaatctgtgtgactatattactgttaggctcagctgtgaggaacaataaaaccttaaaataacataagcttacacaagatagaagtttctcttt

SEQ ID NO: 203398 - DNA, 536 bp, Homo sapiens
ccattttcagtattcttgcctaggttatttcacatactcagaaagtcaaatttgagattgtttttaatttgaagattttattctataaataattgctgaggttgtaaaaccagttctttggctatgtaatataaaaattcctctctgttgaaaccatgaagcaagattctattatattgttttaagaatagttcgtatgaaggatgaagccctctccttttgggagtgattagttgtttgagaatttgcacagctgccacattaagctttgttctggttattccctgtcacacacttacgtcttcctgtgtagattttactattctcagttgcctttagccatacttacacataatatggaatttatggggatttttttttctgtctcctttgctcaggatgcaaagatttttttctattcatgttactaggtatggtttccagaagaaatcagaaaattcactgttaagtgtcaccaagtttttatcaaaacctgtttaattttcaggaaaaaaaaatcaatgaatgctgttttt

SEQ ID NO: 203399 - DNA, 146 bp, Homo sapiens
gagagtttgtccattgagcatcccccaaacacctgtcctctaaagagaggtttttagaaaagctctgcctgagaagacagttagggtgttaacctcagaaggagagaaccatggcagagactgagggaaacccagactttcgtgaa

SEQ ID NO: 203400 - DNA, 382 bp, Homo sapiens
gccaacacagtgaaaccccgtctctactaataacacaaaaattagctggctgtggtggcgcacacctgtaatctctgctagccaggaggctgaagcaggagaattgtttgaacctgggaggcagaggttgcagtgagcccaaatcgtgccactgcactccagcctgggtgacagagaaaaaaaaaaaaaagaattgaaatcatatcaactatcatttctgaccataattaaacaaaactagaaatcagtaacaacaatttgtgaaattgtacaaatacatagaaattaaataacatgatcctgaacaatcaatgggtcaatacagaaattaagaagaaaatttaaaaatgtcttgaaacatataaaaatagaaacacaacaa

SEQ ID NO: 203401 - DNA, 615 bp, Homo sapiens
aaaggaacagtcgaattgattcagcatcagctaagcatggaagaaaaaaaaatatgtaactgtgaaaacaaaaacaaaacagatttctggctgctgtcctcagaagcctcccgcacagacgatgttcctgacaggatcaacaaacgtcgcatttcactgtcccacagtgcagcttcgtccatcagccactgactggcatgggccaggagcagtgttggtctcggtgacagtgacttccttgccctgctctgaatgagtgtcctttctgtgaaagtaggtctcatggttctagggctgatcccagcgccatcccacaacatttcagtgtgcccgacagcgtgcctggcaagcagcgagctcctgacaattggaagctgctaatgctgttacagacatctgcaagcaagtcagatcagccagcttccatcacgtgagacaccttggaggacaaagccacattgtgtggaggaaaacacaccaccattcaggcccatcgtcatcctgctttctcctatactcagtctcccacagtgccaggtagttttctgcctgtactaagaagggtgaatggaaaggtgagatgtaaaaacaaacaaacaaacaagggctcgaaat

SEQ ID NO: 203402 - DNA, 505 bp, Homo sapiens
tgctttgtctagtagatagtgaaaatataaatatgaaaaagtttcaccagtttccatactgggtatgataattaaaatatgtaaccctagcccccaacgaaaacacaatatttgatagaaacagcctgataaagctctctgaacaaacaaaatagtgtgagggctacatacaaactgtatggttatataggctcctataattaagcacttttcattttctctagcttgtaataagaaagtaggtatgcatgaggaatttattttaaaatgccatatacataaatcaactacagcatagctgaggagtaaaaatgttctaacaaaaacaaaaacttttattgtaagatccctagtacatggagtggttccgacttcacagtaccccaacaaagactaaggaaaatctcttgttaaaagctctaaggagctggagacactctcttcaaagatgccaggcccagatcactgttgagacaaaggagacacgggatcctctagagcagtg

SEQ ID NO: 203403 - DNA, 484 bp, Homo sapiens
ggcgggagcttggtggagcaggagcggctgggcatcctcctgagactccggggtcagacgcccactccagcgctttctgcgcagcacaggcaccctcgcctgtcacgcctccctctcctcttcccgtctcccagcgtggatgagggcgcctgcagatcccggctagggcacggaccgcctaggccgagaacacaaagagggccgggcgcagtggctcacacctgtaatcccggcactttgggaggcccaggcgggtggatcacgaggtcaggagttcaagaccagcctggccaagatggtgtctctactaaaaattcaaaaattagctgggcgtggtggctaggcgcctgtaatcccagctactcgggaggctgagacggagaattgcttgaacccgggaggcggaggttgcagtgagccgagattgcaccactgcactccagcctgggtgacagagcgagagtctgtctcaaaaaaaaaaaca

SEQ ID NO: 203404 - DNA, 136 bp, Homo sapiens
ttactatttggtgatcagggtcttggagactagtaacaaaggccagaggacttataagaagtgttagctctcagatttcacctatttttttaaattttttaaaattttgaaataacttgaggtttacagaaaggtt

SEQ ID NO: 203405 - DNA, 391 bp, Homo sapiens
gatatcgtctgtcctccatgaattggggctatttgggttgatggttagttatatgatgggttgttatatattgagtatgtttgaaagtagagaataacaatcataaccatttcactgaataactattatgacccaggcactaagtgatttgtaatactatctaatgtacactaaaacattattcccaatgcttactactacaaagtatataatgactgccattttaaagatgagtaaactaaggctcatagtattaggttaaatgctaaagtcaagtttgaactctgatatggttttctgagacagagtttcactcttgttgcccaggctggagtgcaatggcgcaatcttagctcactgcaacctccgcctcccaagttcaagtgattct

SEQ ID NO: 203406 - DNA, 358 bp, Homo sapiens
atatacaaccacgcaccattagtcaatgataggcgaatgccatttccacctaaagaataagcaagttggaaaagaaaatataacagtttgctaggaagaatgaaaacatcatcatgtacaatgctggtgggagtgcagactgatacaagttttggggaggcaatttggcaactgccttaaaattttgagcagtctttgatgtatcacctgtacttctgagaagcattctgaagacacaatggatgtgtcgtttattatgacagtgaagaactggaaaaaatctaaatgctcaacacaggactggttaaggtcatctgatccaatagattgcaagcattaaaaagtatactagagaacg

SEQ ID NO: 203407 - DNA, 491 bp, Homo sapiens
agcttagtttcatgttaacttgtatgtccatattattttatttttaagggtgagatcaaagaaattaagagtccaaacaattattttaacataatagtacaggaaatgtgaccaaagaatgcactcatcagttacacatgtgaaatatctcaacttcaaaagcagaaaaagtccattccctgccctcccctcatcttcccccaccacctgccaccataagaattctatagattactgtaacctgtgtatcactgcattcaatttatgtaatcagtgagaagaaacagtgataagatcagtttaaaaatttacacatttatcatgtgcattaatgttttaaactcaactgaacctttttgttctctttccctcaacaaatccctgtgtttaataggggacattcagagtgaattttaaacttcctgtcttcccagtctcaaaagcctaatctcagctaccattacttctaatttgctttcttcagagagaaa

SEQ ID NO: 203408 - DNA, 410 bp, Homo sapiens
cccggaagtgggattgctggatcgatcatatggtaattctagctttaattttttgaggaactgtgatatcatttcctaggacaaactttaatttctctgtgcctcaccttccttatttgtgaaacaggaataatcatccttaactggaagagggctatcagggttagagataatgtagttaaagtgccagcatttcttgcctctagagccagtagcaacaaaacgtgtagtttctgcctaaatcttgctatttctcactgcctctgctcttgctgtctctctgtttgtaatggcctttcttacctgactccctcctatgcatcctgtaagacttgttcaagggctgccttctctaggaagttgtccctgtttctacccaagctatattgccccattttatgcttttatgg

SEQ ID NO: 203409 - DNA, 218 bp, Homo sapiens
aggcatatcatgatgcgaacttagtgcggacaccgatcggcatagcgcactacagcccagaactcctggactccagtgatccacctgccttggtctcccaaagtgctcggattacagacatgagccaccatgccaggccacaagtgtaattttgttacacagatacattgtgtagtggtgaagtcaggcattttactgtatccatcatctgaataatg

SEQ ID NO: 203410 - DNA, 451 bp, Homo sapiens
caaataggaaaacataattataacagagattacaaaagaggccagtaagtatgtatatattgctggttaagagcactgacctggagccagccaccattggctttaccatgtactagctgtgagaccttgggcaagttacttaacctctctgtgcccaagtctccccacttgccacatggtgataataatagtatcttctttggaaaccagtatcgtagttcctcataaagttacacatcaaattaccatatgatctagcaattccacttctgagtaaataactaaaagtattgtaagtgggaactcgaacagatacttacacaccagtgttcacagtagcattattcacaatagacagaaggtggaaacagcccaaatgtccatcaacagatggataaacaaaatgcggcatacacatacaatggtatattacttagccttgaaaaggaag

SEQ ID NO: 203411 - DNA, 539 bp, Homo sapiens
gtaaccattacctccatgatgttctgaaatgaagccccttcctgtaaagctgtgcttttttctcttgtagctagaggttggcccattgtactattggaatggatgtcagagtgtggataattctgggcttgtgatttttttctttctcctattttatctgcctctttttgtgtctttgtgagcaagtctgtgattactattgagtttttttccctaaatgccagcaattatctcacaggtggagggattaggaaagagctgagagaaatgcactgggtttagaataaaggctccccacccccactttaaatatggtgacaggagggagtgtagagttgggggcgggggtggcagacagctgtgggggtagggtggacaatttgcttctgatatttaaatccctagaaggagtaaaggaagaaattcctaaggaaagaaagaggaattaaagacctatataataagatattttggggttattgtttcagggagctggagatgcaggaagggaggggcagccacttttcttaacttgcttt

SEQ ID NO: 203412 - DNA, 484 bp, Homo sapiens
gtctacagtggtgtataggaatgttctgggccttcatattcactcaccactcatccagtgacacccagagcaacttccagtcctgcaagctccattcatagtaagtgccttgtatgggtgtatcatttttttttaaatcttttataccgtatttttactgtaacttttctgtgtttagatatgcaaatacttattgtgttataattgcctatagtattcagtacagtaacatgctgtacaggtatgtaacctagcagcaatatgttatattgtctaggtatgtagcagactacaacatctagtttggtgtagactctttgttcacagggtgacaaaattgtctaacaatgcatttctcagaacatatccttgtcattaggcagtgtgtgactgtacttgggagttcactgtgttatctgctccactttggtatgtggttgacattttaaataatattaataaaaaatgtaaacatttaaattga

SEQ ID NO: 203413 - DNA, 345 bp, Homo sapiens
acaactaaaatacaggtgaaaagacaaggcactcaaaataatctgtagataatttaggaagaatgcaggtgttcattctgtggcacagacaccactgttgcaacactgtggaagatcaggcaaaaaggagattaaacacagtaattatccaacagccagcacagccctaggagaatgcaggacatacagtaaatactctataatacatctactaactagctggtggttactagtttaacagccctataaaacaggtagccaaaaactgaatgtggaaaggcaacctcaaacttctgttccatttggactaaaaaatataaagaggaataagagccactaaaccat

SEQ ID NO: 203414 - DNA, 324 bp, Homo sapiens
tttctgaaatatccaggtgtctctcaaggctgcctccatgggctcccccactggctccttttcctccatcctttgaaccttgctgctaatccttaaactcgtttccttggagaatgcatccactcacagttttaacaagtatctccatacagatgattgctcaattctacctctggctccgacttctccttctcttttgagaaaaacctagctgagtttaacattcagtcatcatcgaaacttgactttgaaaattctaacagtattgtctgtcccactcatccatgatgctaattttataaatggcactagtattatctcagt

SEQ ID NO: 203415 - DNA, 554 bp, Homo sapiens
ttgaatccacggatacagaacccacaaatacagagggcgactgtgtactcctttaatcctcatgatatctcaatgaagtaggtactaggttaagcatcccaaatctgaacatttgaaatctgaaatgctttaaaatctgaacatttttgagcactgacatgacactcaaaggtaatgatcattacagcattttggatttcagattttcagatttgggatgctccaatggtaagtataatgcaaacattccaaagtctgaaaatatccgaaatctgaaacacttctggttccaagcattttggataagggattctcaacctagattattatgaccattttgctgataagaaaactgagacccagaagtgaactaactttttcagactctcataacccaaaagataaaacaataaacaagaaagaaatagtcccattttcaaggagttcatagattagtgggacagactattaaatctatgtttttaggaaaagaataataatacataatacactaactaaaatgatataccaaaaatgaaatataaatgagcaat

SEQ ID NO: 203416 - DNA, 300 bp, Homo sapiens
gaatccacaagccttgctgtgggggtgagggagatacaaagaggaaagggcaaggattatccaggcatttggcctgaataactgggtgatggagaggccattacgaggacaaggaggaatgtagtgggaatagaggggatccaagttctgtttaaggcacagtaagtatactattttataaaacaagaaagccatggatatgagagtctggagctcagtggagagggccagctagagataaaatggagaaatcatcagcatagtgaaagcatttaaatccctgggcagggactgtaacag

SEQ ID NO: 203417 - DNA, 243 bp, Homo sapiens
taggacaacagacacatgctaccacacgcagctaatttttttttttaattgtttgtggagagagggtctcactataattgcttaggctggtcttgaactcctgggctcaaatgatcatcctgcgttgtcctcccaaagtgctgggattataggcataagccaccacacctggccacatattagtttttttagttactttgtatcctgataatacttttgtgatttagaagcaggcaaaataag

SEQ ID NO: 203418 - DNA, 479 bp, Homo sapiens
ggtctggacctgggttgttttctcaagcccttaacacctgaagaaacatattctaaacaacaggcatagatttatcaggaagtgaatgaatttaagcttcagagcattcacttacagctgtttcttccagtgccctgggataggacctaacaattttctatgtgtaattttgtattaatttccttgagagggccctcataagaccccgtaagctgaagactccataaaccctgggtccatgtgccgctgataaattatagggaacaaggagtctaaggattctccttcgggcctgcagagcatctagtatgatgtttgctaatagaggtgttaaataagtacttaaattagattgctggattcctgagggtttctcttaaaaaatatttcagatctaaagattttgttaattaatacttaaaagtagaattattggttgtgaacaatcatttataaattgtcacagtgtataattttta

SEQ ID NO: 203419 - DNA, 145 bp, Homo sapiens
ctgccctcacttaggatgccagtcatgagtctcaggaggtcccaaggccactcacacttctgcccaactggcttcaaatttaatgactcctatgaccctctcaggttcagtcactcactagaacaactcacagaactcaagaaag

SEQ ID NO: 203420 - DNA, 464 bp, Homo sapiens
gaccctgagtcaggtccactgagtcaagctgctttggaattcctgacctacagaaaccgaataccaggatagagagaaagagaagccacaatgataccacagaaagaaagctagacatcttcattcagggaaactgcaggacagagaaggtcaatgctgtccctaaggccgcactgctaagggtgagaagaaatattcgaagcagttcagggaccaggaagtgggtcctctaggggcattctgctgaacggttttttaaagatgtttcctccaagattatctgcctcatttacaatggtttttgtcttagaagtctctttgattttataaactgaccatgccttattctgttacgaatgcatgatactgtactttagtccttcaataagcctattacacattttcactatgttgtcttcaggcacttttctgcagtattaacaatgtcatctttatcattacta

SEQ ID NO: 203421 - DNA, 461 bp, Homo sapiens
gccagatgctagggaggtcaggaaatggagtttgtagctgggagggtaagtactgggagaaagaatggattatggtagaccattagctgtttctctcacacaaaaatttctctctgctctgcataggatctttctatctggagacctgacttattaaatgttaaagaaaattttatctaatgcctaaagctggtaattcctcatcattatttggctgaatttggtaacttgccattcttctaccataggaaagactgatattaatagtaaagcaatattacttttttgtaatagacattacaaaaaaaagttccaaaatgctttttataaaatatatgaacttggccttctaaaacaacttgtatagttgtatcatgtgtttatgtacatacatatgtatgtatgtatgtatgtatgtatgtgtagttttaaacctttatgactgtcttagtctgtttagt

SEQ ID NO: 203422 - DNA, 338 bp, Homo sapiens
ttgtagtagagacagggtttcgccatgttggccaggctggtcttgaactcctgccctcaagtgatccaccctcctcagccccccaaagtgttaggattataggcgtgagccactgtgcccagccaattataccagtttcttaaacaaatgtattgattacttaccatggaccacactaagaacatatattgagaggctgggcacagtggctcacgcctatcaccctcccaaagtgctgggattacaggcgacaatcagacctatgtgacagatgagattgaaggcaaggttggtcaacatgagatatttattagataatacttatgtctccaaataac

SEQ ID NO: 203423 - DNA, 232 bp, Homo sapiens
tggctaacccagccttctgtgactgactgctctgcctgtacattctaggacctagagtctcatacctgttctgtagagatacatatgtgctaatcttactaccccaggttggttgcaaattgatcacgagcaagatctgtgtctcatacttcttgatcttgctcccagggtgctaatatgagcccagaacacactaggccctaaataatgaatgccagagggtctgattgaa

SEQ ID NO: 203424 - DNA, 244 bp, Homo sapiens
gtattggatcctaaagcaacaccgcaaaggtcattagtggaaaaataggtgaaattttaacaagacctggggtctcgctaatattgtggtaacaattactgcttagttctggcaaatgtaccatggttacgtaaggtgttcacattagaagaacctggtgaaggaaatatggaaattctctgtgctatcccttgtaatttttctccaaatctaaaattactgcaaaataaagagttaaaaaaaa

SEQ ID NO: 203425 - DNA, 263 bp, Homo sapiens
ccacactcacattgctatttccagtaaattacatcgcttacagacactagagccatacagcagcgggaccccatccttccagagttattaatgttctaggacaaatctagtatcccaaggagattttctttcagctaaagcagaagcctgaattcacttgagttcgggcagaatagataattcatccagattacttgaggccccaaatggatctgacagtctaaaagttagattgtaaaaggccgtattgatcctaatatctt

SEQ ID NO: 203426 - DNA, 584 bp, Homo sapiens
gggaagaatatattcaggttgagagagaaaatagctttcccaagagtgaggaccaaagtagtttccaaactctctataaattaataataagatagaactataacatcagtttatataagataaattggtatacgacaaactgcttatctacaaagagctgtgattattcactaaaaagaagtggcttgtcttggttgggaaaatcccccagttgggagtttcacagacctgagattgttttcatttcctggtttcctggtcttgggctgattatttagcttttcttaacctcagtttctttatttgccacgttgcaataatgacacctagattttcgggttgtggtaagcattaagtgagggaatgggtgtgcagctctcaccatagtgcttaaaacaaaatgaaagtagccagcattattgttagaataagtatggaaaaaagactttcagacttagaagtcataaaaccacttttctctaaatgtacattttggctcagatgatttccttgttctctctctctctctctctgtctctctctcatttcaatatattccctatcttcctaggtaagaacaatgc

SEQ ID NO: 203427 - DNA, 358 bp, Homo sapiens
tattccacttcctgcagcaaaacaccatcaatggtcttcactggagtcgggtgaggaggagacttgggagagctgaccagcactcattctgaaattgatttcacatgaaaaccgcatttcgggggctttgcctgctgcagctctctctttctctataaacgcttccccatgctgggaggatcaggtgctggatccgtttcctattccagctgtaaacaattaccacaagctcagtggctttagaaaatagatactcttctgaagattctcccttccagcgctggaggtcagacacttgatcatggcgcgagtagggctaagttccgtctggaggctctaagggagcgtctgtttcctg

SEQ ID NO: 203428 - DNA, 411 bp, Homo sapiens
ccgtatctctaacattaggtacaatgtacactcctcctttgacaggcgcactaaaatctcagaattcatcgctacataattcatccacataacaaaaagccacctgtacccctaaagctattgaaaaaaaatttttcttaaagacataccagataaaggttaagaagaagaaagctgggcagggcgtggtggctcacgcctgtaatcccagcaccatgttggccaggttggtctcgatctcctgacctcgtgatccacccagctcggcctcccgaagtgctgggattacaggcgtgaggcaccttgctgggccctttctccatttattaatgggacttctataacctagaactgtcccttgttaattatgtaattcccctgaaatgttataatgtaagaaactgaggctcc

SEQ ID NO: 203429 - DNA, 562 bp, Homo sapiens
tggccaattactccatctgtttgaaaccagagaggctggatgcctgaggcctatcaccctgtgctgaatgccaggtaattgtagccaaactcaggttcaactgctcactacttgatggaaagaaagcaggtttatttatgtgctagcaactttggagatggccagactgaaatctcaaaaagccatctcagagtctcaggctggctaaagggattttaaggggaaatgtggcatggaaactatgtgcagaagtggtgtggattgcaggtcggcttgttgttttccgttgactaccctgagtaatggaccatttgctgacctagttggcagcatctcagtgggggtctggttatgaattaactgttcaccagtttcttctcagaagggagaaaattgcaactgtgatcttcacttaatgcttggactgtttcgagatcagtctttggaactctcaagcaaacaggtagtaaatacacgttgtagcaagaaacaaagtgagggaggggttacttttagactaagcaagcaaattggctataccctttataacttaatctagaaa

SEQ ID NO: 203430 - DNA, 537 bp, Homo sapiens
catgtctaaggatggctgtgggttacaattctaaaggtctttttatttgcttattcaaatataatgacatttaaaaattcctggcaaattagaagtattaagttactaacttaacattttcatatagacctttgtattattttatgtaccagaatcctcaaaagcactctggagttattggcctttttttataaaaatagtgaagcagagagattaaaggagttaactgtaagaaatacaataaacattcatagcctagatttcaaattcactccttatcatactgctgctacaaactcaagataattattaaaatccaaaatagaaatgaagccctgactgaactaaatccttagcaaagataaatgaacttgcttggttttgaagagtagtgtaaagaaactggtttggaggggtctggaaggcaggtcatctgattatgattcctaactgccatgagacaatgcatgagggtgtgtgtgtgtgtgtgtgtgtgtgtgtgtgtgtgtgtgtgtgtgtgtgtgtgtgtggtgtcaa

SEQ ID NO: 203431 - DNA, 401 bp, Homo sapiens
cctcagcaaatcccatctattttccaagccccatctgaaagcgtgcctcttctctgatgaccatccttgttggagctgactttgccgtccctcctgtggacatccatgccagttgtctgtgtcatctgtttagcagtcatctggtcctaacttttagcttatcttttattatatctaagtgtgatctaacttttcacctttatcttgtctccctgtcacctcgaaagaggacacgacagtgctgttaatttttctatctcccatgggacttaatcggtgtcctccacgtagtatgctttaataatggtttattgctgtgatactgcttcacaaatgccagcagatgccatgctgtatcatcagagatgagattattttatttatttatttttaattttttt

SEQ ID NO: 203432 - DNA, 706 bp, Homo sapiens
gacttcaaagcctatgcacttaacctcaacactgtagattacaagatggtttgggggtggtcttatctaataatatgcaggtagccttattcatttggatccattctcaagagaaagctaaaagaatgcaagtctgaaggattcaccttgaaacatgacagcagaagaaatttagaaataaaagacaaatttaagtacttagaacagtactcataccagtacagggggaaatcatttgtactatgttcattacaatgacttataacagttaaaaaataaaatgaaataatagtccatcaccaaaggattggctaattaactaaattttgttatttaaaccacattgattggcatggtagctcatacttgtaatcctagaactttgagaggccaaggcaggaggatcacttgaactcaggagtttgaaactggccttggcaacatagcgagatcctgtctctacaaaaaaatttttaaaaaatattagccgagcatggtggtgcacacctatagtcctagccacttgaaaggcctaggctggagaatcacttgagcccaggaggtcgaggctacagtgagccgtgattgcgccactgcactccagcctgggcaacagagagagactctgtctcaaaaataaataaataaattaccacgtaatactttgcagctatcacaaattgtatctatatttaataacatcagt

SEQ ID NO: 203433 - DNA, 546 bp, Homo sapiens
gacttcaaagcctatgcacttaacctcaacactgtagattacaagatggtttgggggtggtcttatctaataatatgcaggtagccttattcatttggatccattctcaagagaaagctaaaagaatgcaagtctgaaggattcaccttgaaacatgacagcagaagaaatttagaaataaaagacaaatttaagtacttagaacagtactcataccagtacagggggaaatcatttgtactatgttcattacaatgacttataacagttaaaaaataaaatgaaataatagtccatcaccaaaggattggctaattaactaaattttgttatttaaaccacattgattggcatggtagctcatacttgtaatcctagaactttgagaggccaaggcaggaggtcgaggctacagtgagccgtgattgcgccactgcactccagcctgggcaacagagagagactctgtctcaaaaataaataaataaattaccacgtaatactttgcagctatcacaaattgtatctatatttaataacatcagt

SEQ ID NO: 203434 - DNA, 263 bp, Homo sapiens
ccgctttgtggtctggactgtctcctgtcaccggctccccagccacggttacttttgtagcaccccaaacctgtatcttgactgggggcaggcctaagcagccccacaaaatagtgcctgctccccgctccaacccctaatatcctgttgtagtccagatctctaagttaattactataccaggcacttcacggcagagaaaaacatcacagatgccttgtgtgcttgccatgatctggtctaggccaggaccacaaatggct

SEQ ID NO: 203435 - DNA, 243 bp, Homo sapiens
tctctttaatattttttacttccttaaagcctagtaaatagaaaaaaaattctgaagctcagaacaaatggaaatatagcccatttcatttatgtatgcatgcattaattcattcgacaaatgtttgttacatggctcagacatggcagaatctatggaatactctggggcagagaacaatgaggcagagagatatgttgtaattattaaagattaaacatgttgaaagtattttaattttaa

SEQ ID NO: 203436 - DNA, 716 bp, Homo sapiens
gcacacagcaggggtttggaccacaaaacatttttccctctaagcctcctggctgtgatgggagggtctgctgtgagggtctctaacatgccctggagacatttgccccattgtcttggtgattaacatttggctcctcattacttatgcaaatttctacaacccagtctcctgagaaaatagatttttcttttctgttgcatcatcaggctacaaattttctgaacttttatgctctgcttcttctcgaatgctttgctgcttagaaatttcttgtgtcagataccttaaatcatctctctcaagttcaaagttccacagatctgtagggaactctagaaaaaaattcttattttccctctttcccgcctatcttatgcccgtttctaatacaggtgcacaatgcctgcagtgtctttgcatagtaagagtgactttactccatttcccaacaaattcctcatctgcctctgagaccacctccgcctggaccttgttgtccatatcactattaacatttgggtcaaagccattcaacaagtctcgaggaagttccaaactttcccacattttcctatcctcttctgagccttccaaactgttccagcctctccctgttacccattttcaaagttgcttccacattttcgggtatctttacagcagcaccccactctactggtatcaacttattgtattagtctgttctcacactg

SEQ ID NO: 203437 - DNA, 531 bp, Homo sapiens
cttctacccgagggtgtaggattcagacagatgtaagcatggtaccattgtgagttaagatggatgctgccacagtaggctgctgtgaagaatgcagactggagaatgaaagtctaataggttggtttggggtcgggtgcagtggcttatgcctgtaatcctagtactttgggaggcagaggctgatggattgtttgagcataggagtttaagaccagcctggacaacgtggtgaagcgttgtctctacaaaaatacaaagctactcaggtggctgaggtgggaggactgatagagcctgggatgttgaggctgcagtgagctgtgcctgaattattccactgcacaccagcctaggcaacagagactgtctcaaaaaaaaattaaaattaaaaaataaaataaaagctcgttttgggactaaaattttagattcatttcggtagcaggtaaactgttaccacagaatttaaatacacagtaactatctgataaatattatatatatataatttatatatgcattaaatat

SEQ ID NO: 203438 - DNA, 564 bp, Homo sapiens
atatattagggtggtgcaaaagtaattctggtttctgcaattacttttaatggcagaaaccacaattacttttgcaccagcctaatagcacctcttaaacctgctaagctgctcctttgttaactattttcctctgaaaaaaaacacaccttatttaatttgaccctggctaaaagtattctaggaggagatagccttttaatgatttgtcttgagtgtatatactatgtatatactagtatatacacatatgctacatatgtgtacctcagtcctgtagaatttctggttcactgcatactttcaataaacacaatgttggccaggcacagtggcttacatctgtaatcccagcactttgggaggccgaagtgggcagatcacctgaggtcaggagtttttgagatcagcctggccaacttggtgaaaccccgcctctattaaaaatacaaaaattagctgggcttggtgtcaggcactgtagtcccagccacttgggaggctgaggcaggagaatcgcttgaacacaggagaaagaggttgcggtgagccgagatcatgtca

SEQ ID NO: 203439 - DNA, 412 bp, Homo sapiens
cggccacttcccattctcttaatttcccccagacttccattatctggaatatattttatttcattgtttctaaagaagaaaagcttttaaatacagtgctgagtatcatcatttagacctttggttaagttaatgtttgtattctctaatgattgaggtctgaattttagcagaggttcttgaactgttcagggaaatatataccactagttatatgagtaaatactttattaaccattcatgatgttaaatagactgtgactaataaagaatttaaaacagaacaaaagaatttaggattaataaattctgctttatacgcataccattcatttctaaggaattcctttattcatctacaattaggatgagtaggaattttttaatgcttttaaatgatcaacattattta

SEQ ID NO: 203440 - DNA, 298 bp, Homo sapiens
ccgccaccacacccggctaatttttgtatttttagtagaggtggggtttcaccatgttggtcaggctggttttgaactcctgacctcatgatctgcccgcttcggcctcccaaagtgctgggattacaggcatgagccaccgccggctatccttcatttttataagctccatgaggtcaggaacctcattcatcagtgtagttccaggctacatgtttagaaaataaaaaacacaggccatctagttctgtgtgaatttcagataaagaacaaataattttttagcataagtgtgtcc

SEQ ID NO: 203441 - DNA, 464 bp, Homo sapiens
tagaaataggaatgatttgtaaaatccacagctatatcctgatgctggatggtattaatcttgtgtagtcctaaactggttagtgtgaagtagttctgccacctctgatgcaccactgccaatgctgtacatgctgcatttgccccttgagccaggtggatgtttaccgtgtgttatataacttcctggctccttcactgaacatgcctagtccaacgttttttcccagtcagtcacatcctgggatccagtgtgtaaatccaatatcgtatgtcttgtgcataattgttccaaaggatcttattttgtgaactatatgtatcagcagtgtacattaccatataatgtaaaaagatctacatgtaaacaatgcagctaactatccaagtgttataccaactaaaacccccaataaaccttgaacagtgaaaaaataaataaataaatgagttaatgcatgtaaa

SEQ ID NO: 203442 - DNA, 431 bp, Homo sapiens
aaaatggttaagctataaagaagaacaaagtaaccataatgataaaagtgaagataaaagttactttgcagaggtaagcagtaaaagggcagtttctggggggaaagtatgttctttatcagagttagataacctggtgtttgattcacaaccattcattcaagttcacttataatcaaggttgccagacacaatgcagtatacccagataaatgtgaatttcagataaataagaaatatatctatatctgtatataggtatgtatgtgtatatataacataaatatgtcacaaggaataatataataatatttggaacatatgcatgtatgcttagcacaatatttgcctgtgtgtatctcaaatattatatgggacacacttaataccttatgtgtatgtgtgtgtgtatgtgtgtgtgtgtgtgtgtg

SEQ ID NO: 203443 - DNA, 307 bp, Homo sapiens
tcccaggtgatagcagggggttctgagacacatctggagacaaagccaagagggtttcccagcaggtgggatatgtgcaagaagggacaaggtaaagttatatgtaactttgatccactcacgtgaacactatgcctccttcaaagcacctgtctgaagaacatctgatggcatgaactgcttgacatattaaaacggggatggagaaacgtttctataaagggctagacaggaactatgttcagctttgtgggccatacagtgcctgccacaatactcaatcctaccattgtggcatcaaagcagc

SEQ ID NO: 203444 - DNA, 639 bp, Homo sapiens
aacaaacaaaaaaaaaaacggtaagtagcaaatctgagatttgaattgagaattgactctaaaagcccatgctgcttctaaaacagaaccttctgcaccttctctctatccctaatacttcttttccacctatacaagaatagaccaaaatagtattttggtataagccctgattctgccttacagcacaaattccagccattcattcactcaatattcaaagttcaatactctcctgaaaagacaggtcctgacaccaacagaacagcttcttgcacagcaatggcagcccctttccctgactcacagatcttctatttgagaaggggaattaatttacacaagaaagccaggcacggtgtctcacgcctgtaatcccagaactttggaggctgaggcaggcagatcacttgaggtcaggagttcaagaccagcctggccaacatggtgcaaccccatctctactaaaagtacaaaaattagctgggtgtagtagtgcaagcctgtaatcccagttactcaggaggctgaggcaggagaatcgcttgaacccaggaggtgaaggttgcaggtgagccgagatcgtgccactgaactccagcctgggcaacagagcaaaactctgtctcccaaaaaaaa

SEQ ID NO: 203445 - DNA, 375 bp, Homo sapiens
ccaggagcaccatcttctgtgggtcctgcctggatgtcacatcccggccccaagaagtcactgcaaaccttcgtattattgagcttcacatcctagaatttgctgtcactgtggctgctgcatgaagttgtcctgagagaaacgggcattgtcattaacagggaaattgatggtctgggggaaaagtcatcctcattctcttgcagatctatgggtgattgagactggctgatgttgaaggggtttctcagccatcgtgtgccatgttatggaacagtggtgtagccagccatttgacacccagcgctgacctttgtttaacaacctcacctatatatgacaaaatgattgtcagaaataatcgtgtaatgaaat

SEQ ID NO: 203446 - DNA, 482 bp, Homo sapiens
gaagaatgactaggttatctgaggagttggttatcatgtaggtttatttggggagttgggatatgaatcagaggatgaacatgttagatgagaaggtatgcccaatggaggccacattgccacaagagcccaggcacaaatccataaaccataacaggagctgcagatactttagagttccccacagctgtgcacttccccagctcagctacctggggaagctgggacatcctcccactcttctccagtccccttacaccacagctctgtgcttctgcactccagcccagtctgtgaatggttcctgggcccactgaagtcagaaggtagaagagcttcagtcacccagtaacagccattcccaaggtcaggccactggcagggacctagctggctgaaaagcttcccagggagctgattaacggtgcagactcctagctgtgctgaggagcatctgactcagttggactgggcggccaggt

SEQ ID NO: 203447 - DNA, 398 bp, Homo sapiens
aggaagtggttgtgagtgtttgaagtgaaggttgtaatgtcagtggcaggcattaaaggtataaaataattatgtgacattgaaatcctggctaaatcacttagaaacatttctcccccacccatgctgtagagcagtattctctaccttgtttgcacattagaatcacctggggagttaaaaacaaacaaaaacaaggccagacacccaccccagaacaattaaatgactctaagattagaatagaggaccatgtcccagctttgccctgtacaactgactgactctgctggatatttattcctgtttgtatataaagccataccgtcttacatgtctgctcaggatgtttatgtaaaaataaggggtcaggacctccagtagaggttgaacttctg

SEQ ID NO: 203448 - DNA, 552 bp, Homo sapiens
aggtgagtgaatgaccaggtgactaatagataacaataaaaaggaaggagagaatggtattgctggatggtaggagccccagaaaagcatggagttgctaagagtgagggggaaataaccatctgaaagtggcagtgaagagcaaggaaaatactgtagttatcctctgaccctgatgtaaatggagtatatgataataaactgagagaggactagcagaaaagtagtatccggagggatcagccaagaaagtgacgagggaagagaattttcgttcagagaagattggtagctgtatgatagtttcctgatcacatagaggaagttccaggagagtggagaggtttgaggagagaatgagtaggggattgggtcagattaagggataaacagcactgtagagataagaattcaggtgataaggaatgagaagaaaggctgtgtcttatcagtaggtgagatggaactggtcctggtagtgttggagcaggacaggcacttagttctgatgctgtggtcctttgtgatagtagagcaccggggttaaccacc

SEQ ID NO: 203449 - DNA, 649 bp, Homo sapiens
tatttttatagcgcggtgccccactcttgatatcaatttactgtattagtctgttctcacattgctgtaaaaaaaactgcctgaaactaggtaatttataaaggaaagaggtttaattgactcacagtttcacatggctgggcgaacacaggaaacttacaatcatggcacaaggtgaagaagcagacaccttcttcacaatgtggcagttgggagaatgaatgcaggaggagctaccaaacacttacaaaaccatcagatctcgtgagaactgacctcactgtcatgagaacagcatgggggaaaccacccccaccatgattcatttacctccatctgctccctcccttgacatgcggagattatggggattataattcaagatgagatttggctggggacacaaagcctaaccatatcacatatactagaaaaccctgtctcaaaaaaaacaaaaacaaaaaccaaaaaacggtaataaatactaaaaactcatcactttctaattgttttgttacattttgttattatggatgctctcctattctgtttatatggtgaaatactgtatagtaatatatactgtgcatctcttctgaactgtgttcagtgacatcatttagtagcttgaagctgccatggtaagata

SEQ ID NO: 203450 - DNA, 490 bp, Homo sapiens
cagaaagtactggaaaaaatgctttgtctttccctaaataatatagtgagagtgagagatctggaatggcagccaccattttgctaccatgatgtggcagaggttagtgctgccacatatccatcatgtggaatatgaagataaagccagtactacagaagtcaagagtagaaagatgtagagcgactgggttgtcatgccattgtttgacttgttgtatcaagctttgtttacctctgcaattgtaagttatatgtgcccctccatatttcctttattacataaattaattagagatgtgttttcagtcacttaaaacataaagttctattctacaaaaatggcaaattgactttgactatgttgtatttgtcacttaagtgtgaccacctgtttcacagatgcatccaagtttcggttgaaagtgattttgtcacttgagtccaggagctggagaccagcctgaccaacatggcaagaccccatctct

SEQ ID NO: 203451 - DNA, 277 bp, Homo sapiens
aatatccttactgactcatggtggttgttttgtcagttactttagaggtatattaaaatctcctggccaggcaaagcggctcacacctgttaatcccagcgctttgggaggccgaggcaagaggatcacctcaggtcaggagttcaaaaccagcctggccaacatggcaaaacactgtctctactaaaaatacaaaaattagctgcacgtggtggcgcacacctgtaatcccagctacctgggaggctgaggcaggagaatcacttaagtctgggag

SEQ ID NO: 203452 - DNA, 557 bp, Homo sapiens
cagcatttttattttcatgtttttctatttcatctgtcatattgtagggatttggggagggatgagcggcaagtgcatattttcagttaaccttttgaaattggaaatcagttcttttctgtgtagttttgttttcttatcgccttaactgctggttgcacagtagttggatagtaacttcacaactcaagtagtaatagatagacttcactttatttttttaatgaaaccaaatgtctcagtggaatatactcattcagaaaaaatgttgatatgttgtcactaaatatttaaatagtacttttcaaacttaaaagtaatcataacatttagaactataaggaactttacagatcattagaccagctgccttattttatggatgaggactttgaggccaagagagattcaatgatttatctcaggtgacaaagtcagtgatcaagacagaaagcccaagtctctttacttccattctgcaatgctatttgctgtcatacacattcatgctgttctccttacctatgtgataaaggaggtatttctgttaatacaaa

SEQ ID NO: 203453 - DNA, 685 bp, Homo sapiens
tgccttccgctatgtgaaggaagagagggtaacaccttgccatgtgacctgaagaagtcatctgaagatggaagtggagaaaatataatcgagaaggtgtgaaagtgaaggcaagctccacacagagttaagggatgttagggagtgtcctccgggccctctcccagaagatccattcatggccaagacaaatattcccacgtcaatatcactggagttctctttcaagtgcagacctcgtgtaccattcctttacttaaaaacttcaatgtctcctaaagcttatagggtcatgtcaaatgccacagtccaggcccttccaggttgatcccaacctagctttgttccctagctgctctctcctccctgccactctgctccctacactttaggatttagctattctggcctgctaaccactttctactgagtcaagccttccatctgtgataggcctttctccttgctgtgggatcagcctggagagtcctttcctatatacctgcttgtgaactcctcaaagggcagaaacgttaccccctgggctgcctcctgagctaccacccatcatagtggatgactgtgctccgatcatctgcctggatgtcttcccctgattatgagctccatgagggaaccatggtccctgttggcccagggcctgtaggtgggggaactctcagta

SEQ ID NO: 203454 - DNA, 977 bp, Homo sapiens
ggggcctatgccttgggacgtcgtctggctccactgcctcagtggttaggtcttgactacacactggagaatacgcacatgcccttcggcggatatggccttgcctccaaggtgacggcctctgactaaatatagctcatgtccaagaaggcagtccttatttggaccccttgtgaaaaggatgggaagcatgaattaggagctgccattgctttgggttcgcatttaaagtcttcggtgcagggttttacttgaggctttgtccgctcaaccgccattatggggatcaattggcacgtgaaggaggagtaaagctatatttccaggaactgaaaatctcagcctgagcatatcggctagtaaagatgattatttggctcttttggctgtttctgcccttaggatgaccgcagtagttatctatctggtggctttagggtctggtcagtttactgtgcccatgatgaaatcccacaagtaacttagtggtatgagaggacaaacccaggatcttgatgagtgctgaaggttagctgttacaccagttagtagtagaccgaagttcagagcctgcagtctggcttccacattatgtttggattctgttttaggcggttatagaaaattcagaaaaacgaacttgaattagggagatatttgttctccctcctaacaatagatgacaaagcagggagacatggattcggaatacgtttgagcatcttctacactgttgagcttttgtttcctgcgcaactcctaacagcaaaatcagataattgccattattagtcagaaaatgcttttcatttaattgtttaatcgaattatcttgttgctcattataattggtgttccttaagattagggaaactggcctacctgtggcctcagttctaccagactcccaggtgcagaggggtttggtacagttgtggaagtgaatatgatatagggcaaattctgttctttaaagg

SEQ ID NO: 203455 - DNA, 981 bp, Homo sapiens
gcgaattccagctcggttccctcccatttcacctgcactgcctcagtggttaggtcttgactacacactggagaatacgcacatgcccttcggcggatatggccttgcctccaaggtgacggcctctgactaaatatagctcatgtccaagaaggcagtccttatttggaccccttgtgaaaaggatgggaagcatgaattaggagctgccattgctttgggttcgcatttaaagtcttcggtgcagggttttacttgaggctttgtccgctcaaccgccattatggggatcaattggcacgtgaaggaggagtaaagctatatttccaggaactgaaaatctcagcctgagcatatcggctagtaaagatgattatttggctcttttggctgtttctgcccttaggatgaccgcagtagttatctatctggtggctttagggtctggtcagtttactgtgcccatgatgaaatcccacaagtaacttagtggtatgagaggacaaacccaggatcttgatgagtgctgaaggttagctgttacaccagttagtagtagaccgaagttcagagcctgcagtctggcttccacattatgtttggattctgttttaggcggttatagaaaattcagaaaaacgaacttgaattagggagatatttgttctccctcctaacaatagatgacaaagcagggagacatggattcggaatacgtttgagcatcttctacactgttgagcttttgtttcctgcgcaactcctaacagcaaaatcagataattgccattattagtcagaaaatgcttttcatttaattgtttaatcgaattatcttgttgctcattataattggtgttccttaagattagggaaactggcctacctgtggcctcagttctaccagactcccaggtgcagaggggtttggtacagttgtggaagtgaatatgatatagggcaaattctgttctttaaagg

SEQ ID NO: 203456 - DNA, 327 bp, Homo sapiens
gtggagactttattttggcatgtttttgatatattagaacatacccaatgtcattattataaaacagaaataacagaccaggtagcattcagggatctttgcttgcttcattgtttggaggggaggtgtaggtgggtaataattcggtaaatattttttgtttaaagtatagttcctactttcttgctaaattgagcaagccattgcccttttatagacaactttccttctctcataacagaaagtacttcaggaattgggcgtgattatctttatgagtgcagaataagctctacctttgtatattaagtcagtatattcattact

SEQ ID NO: 203457 - DNA, 268 bp, Homo sapiens
agttcataatatgtaaggcgcttggaacagtgcctggcacatggtgagtgctgtatgtggtagctgttactgcactagtaattattaccccctgctgggatctgtaaatccctgaaggtggggttggcatccgttgtttgatcactccacacctaggatgctgcatgaacataatagctcttcaatacctgtctgttcagcagagtggcgtcctagtgaggttcttggtaaaagatgaaaggtgagatgtggaattgcaaaaaaaaaa

SEQ ID NO: 203458 - DNA, 412 bp, Homo sapiens
attcaaaggtgattgtgcactgggtaggcactatgcgtactgttcgttgaacataaaaattagtctcgttattttaattacaatacatataatatccatatctttaaaacacctttatcagggaaaaagtggcctccattgacttgaattatccatttttttaaatttagagttttatcttgatccattatgtaacccttgaggcaaaatgaaggtgtgccattttttcagaatgcagcaggctattaaaagagttcatcctctttcataaccaccatcactctactcccacaagcctatcagatctcatcacccaggcactattatgatatgttatgtgctgacatcgtatgggtattagaatgtcattgtgttttctgattgtctgatctagaggtggcttgaatgagtg

SEQ ID NO: 203459 - DNA, 155 bp, Homo sapiens
aaagtaggttgaagtaggatcatggaggcctagtctaccatggtaaagaactaagactttgtctgtctgaatacttgaaaagttttacttgtgaggtaacatgctaagtaaagagaaacttcattgactccagggcatccctaatgtaaaaacag

SEQ ID NO: 203460 - DNA, 295 bp, Homo sapiens
tactgaacattaccaaaaaaaacaaagcaacagagaaagtttcaacaaatcccaaaagaatatatcatttggcaaaacaatttctatccatattgttgttatattagaaatatatgaaaagtaaccctctccccagagacatatagaaatggaaactaaagtggaaatagaaccaagcctacctaaagaaaattgtgcatccttaatagactcattttaacaggaaagcctgaaataaataagtattcagcaagaaatcaaatgcaggctgtggctcacgtctataatcccagca

SEQ ID NO: 203461 - DNA, 372 bp, Homo sapiens
ccttgtaagaaattattggcatgattctctagggacatatataagaaacaggcgggtcaaggctgatcatctggacccatgaaaatagagcagttgtgttgaccaaatgaatggcatgaaaccatcaggacctactctcatgtcccagaactattaaaagtctctggtctctttctatgcaaagcagcagaggtgagggcagtagtaatgagcctcctgaggctttacagactgagcagggtagaaccttctggggcttggtgagttctcggctcttgtcttttttctttttttttaagtgaacgtaaactcaagatttttttgtcttcataataaaacaaaagatgacacttaaaatgagatatcttggcc

SEQ ID NO: 203462 - DNA, 146 bp, Homo sapiens
atcttgaaataattatagatgcataggaagttgcaaagattgcctagagaggtataggtggacctgccatgcattttccccagtggttacatctgttgttcttatagtacaatatcagaaccagggaactgacgttagtacaatgt

SEQ ID NO: 203463 - DNA, 1171 bp, Homo sapiens
catgagtgtgtacagtgggaaagtcttactccagacaacaccaccccatgttattggtcagttggacaaactcatcagagaggtatctaccttagatggagttttagaagtccgaaatgaacatttttggaccctaggttttggctcattggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccattggaagattaattttttccttttttttgacatggagtctctctctgtcgcccaggctggagtgcagtggcacgatcttggctcactgcaaccccacctcccaggttcaagcaattctgcctgcctcagcctcccgagtagctgggattacaggcatgcaccaccacacttgcctaatttttgtattattagtaaagatggggttctgccatgttggccatgctggtcttgaactcgtgacctaaggtgatctgcctgccttggcctcccaaagtgctgggattacaggtgtgagccactacacccggcctgattaatttcttttacttgcttcaagtgtctcctttattccagcctacacatagaggtaaatattcctaggaaactttcagcaagttaaatcctattataaaatgccagagtcagttgtctaatttttattttattttattattattattttttttgagacagggtcttgctttgtcacccaggctggagtgcagtggcgtgaacacagctcaccacagccttcacctcccaggctcaagtgatcgttccagttcagcctccttagtagctgggatcacaggtgcagaccaccacacccgactaattttcttttttttttttttaagacaaggtctcactctgtcgtccaggctggagtacagtgagctgagattgtgccactactccagcctgggtgacagagcaagactccatctcaaaaataaataaaaataataaaacctccataagtaatcctgaaaa

SEQ ID NO: 203464 - DNA, 1299 bp, Homo sapiens
catgagtgtgtacagtgggaaagtcttactccagacaacaccaccccatgttattggtcagttggacaaactcatcagagaggtatctaccttagatggagttttagaagtccgaaatgaacatttttggaccctaggttttggctcattggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcac

SEQ ID NO: 203465 - DNA, 1323 bp, Homo sapiens
catgagtgtgtacagtgggaaagtcttactccagacaacaccaccccatgttattggtcagttggacaaactcatcagagaggtatctaccttagatggagttttagaagtccgaaatgaacatttttggaccctaggttttggctcattggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgaggcaggagagttgcttgaacctggggggcggaggttcagtgagccactgcactccagcctgggtgacagagcaagactccatctcaaaaataaataaaaataataaaacctccataagtaatcctgaaaa

SEQ ID NO: 203466 - DNA, 1023 bp, Homo sapiens
catgagtgtgtacagtgggaaagtcttactccagacaacaccaccccatgttattggtcagttggacaaactcatcagagaggtatctaccttagatggagttttagaagtccgaaatgaacatttttggaccctaggttttggctcattgacagagtttcactcttgttgcccaggctggagtgcaatggcgtgatctcggcccaccgcaacctccacctcccaggttcaagtgattctcctgcctcagcctcccgagtagctgggactacagatatgttccatttaaggctctgaagatggggagagaattctggatgatccaggtgggcccttaataatggtcccttattacagagagccagagggagatttgaaactgacaggagaagtcagtaagaccatgaatgcagagattcgagtaatacggctacgagccaaaagatgccagcagccacctgcagctggaagaggcataaatggattctcccctaaagctcccaggagtgtggccctgctgacaccctgatttcagccccatgatactgatgttggactggtcctcagaactgtgaaagaataaatttctgttgttttaaaaaaaaaaacaacaataaaaacagaaaaaaaacaaaaacaaacaaaaaacaaaaaaaaaaacaacaacaaagaatagccaagcaacaggatagacacacaccactaaacgaatcaagaacaacaacaataaaacagggagcgccagcaacatgagactcctcctcatacttgatgacgaagcaagaacaagcacgcgaggccgaccacgatgagagtatgctcaaagatggggacggcgcgcacccacatggcacaagcgcgccgccaagaatgccacacggacagggagactcggcccggcgaggccgtaaaacagagacgagggcgagcggcggcaaactaacggccgggccagcggccagatcggggagaccccaacgaatcacggggcggggttgcagcagcgcgggccgacagccccaa

SEQ ID NO: 203467 - DNA, 423 bp, Homo sapiens
aagtcagaactttcccttttgatggtggagtaagctggtgttcacgattatatgatttactgatgaaattcggaaatgcaaaaataagtctggctttaaatatccttttcatgtcatgttaagttatgaataaattaacagatcagggccaggtgcagtggctcactttgggagaccaaggcgggctgatggcttgagctcaggagtttgagaccagcctgggcaacatggcaaaattctgtctctataaaaaatatacaaaaaatacaaaaataagctgggtgtgctggtgcgctcctgtagtcccagctgttcaggaagctgaggtgggaggattgctcgagcctcggaggcagaggttgccgtgagccaagttcacgctactgcactccagcctgggcgacagagccagaccccgtctca

SEQ ID NO: 203468 - DNA, 510 bp, Homo sapiens
tatcacaatgtacaaatcagtgcaataaatacacaaaactatattacagctagttaatcagtttaagaattgttcccgtcagtcacattttattggccctcagaagttcattcctaaagattgcaactactctaaatttctagctaccaagaagttaagaatgattataagaagctttccaaggagttatgagatctttgtagaccagaggccaactatcatcacctcaagtctgctctcaccaacagcccttgagtattgtataaagcgctttatacaatactcaaggggaggaaataattagtggagcaagtcttggaatatttggaggggtagagttaagggcacaaatttgataagctaactgtggaaaagaggagagagacttccttttctgagatggcagggagtagaaaagcgagaattactatatggagaaatgttaaagtggagataaaagaagttgggagtgctggcgtctaatggtctttgtttcagtgaagtatgagg

SEQ ID NO: 203469 - DNA, 878 bp, Homo sapiens
cgaacgagacctatttagttcagtggacagagataagtgaatagacaaagctctctgctcaattacaacggtttatcgtggcgtgggagacgtctacagagaaagacatcagcgtttgggcttctaaccaccctgtctccagactgctctgcacacatggacagggacctgggaaaggtgggagagatgctgagcccagcgaatcctctccattgaaggattccggaagaagaaaatgatccggatcattttcttcttccggtgttggccttcacgaaagatgggtaaagtggagtgacctgcagagtagtggtccaagtctgggtccccctttaacaaagggtttcgtggagggcccgtgtgcacagcacgtagccgccggggggatgaaaagatgtgtcactctttgctcttgaatgattatgaaaatgtcagatggttttatggatctgtgatctcaggattgtaattaccaatccacaatcgcattgctcactgggaattgcttcaagcgtattttccaggtagtgaatgatgagctacttaattcctcttcccttgaattcatcagatttggacttggactttagttctttctagatgcaatcctgatccacacaggaattagaaagtaattcttcctcccctcccacctaaagcaggagcaaggcagaggctcaaagaggaggaaaatgctgtcgtgactcacatcccctcctccccactttgaaaggcatttcaggccaagctgaaagttctgggggaacttccccctggtacttttaattccttctgtgttaagctcctcaactacctgatgacttggcaaaggcagtttttaaagcattaataataatcgtgcctaaatgtttccagcg

SEQ ID NO: 203470 - DNA, 473 bp, Homo sapiens
cctgtttgagaatgaagcctacacataggaaaagcaaagcaaacagggcaggaaggatggaaagatgctgtggtagacagcctcaaagacagcccccattgatcctcaccacctaggattcatgcccttgtatggtgtcttcccacattgagttagggctgttctgtgtgtccatcagaatatgacagaagtggctgggtgtggtggctcacacctgtaatcccagcactttgggatgccaaggcaggcagatcactctaggtcaggagttcaagaccggcctggccaacgtgttggccaaaccccatctctatgaaaaatacaaaaattagccgggcgtagtggcgtgtgcctgtaatcccagctacccgtgaggctgaggcaggagaatcgcttgaacccaggaagtggaggttgtagtgagcagagattgtgccattgcactccagcctgggcgacagggactgtctcaa

SEQ ID NO: 203471 - DNA, 453 bp, Homo sapiens
gactaatacctattatgaaaataaagggctccttctcttccaggaatcagcacttggaacaggggtcaacataatatccatcaattggtcaaccaacaaatgatttattgagaacccattgtgtgctcagcatttaactcaaagaatcaaaacacagacatcaagtatgggtttttagagagacatgggatatgtggtgaggggttctctcaaatcgtgttactgcaactactgtatttccaagcctacctttgggccctgaagcaatctatctgtagctgttcttgcactagctcctctttcccccacccctgatcccttggcctccagactgaatgtttggctcaacaagacaaaatgtttggctccgaagtctcagctggagacagattacattcaactgagcaacagaatttgttctatggggcagcaataaaaatactagtttgtaat

SEQ ID NO: 203472 - DNA, 460 bp, Homo sapiens
gctgggccaaccacagtcctctctggagcaccagagccagacccgggatgggctcactgtggccaaacacatacataagcttccaaggactgcggcctctgtctggggctttgaagatttcctggggggaaatccctcctaagaagcgctattcctggctctgctgacaagcagaaagtttcaagaaagaagtggaaaattccaggggcaataaaaatttagaaattaattcaagactgaaactccagctgtatatccctggcagccagtacaacacttggcttatgaagaacgctcaatgaacttttgttgaatgagatgaatgcagcaacctgcctaacacaaaatgaccttcaatgagagattgttgtttctatatttgtagctgcattgtctcagatcagatacttactaagctctggtttttccaaagctctggtttctccaaccacaagctgca

SEQ ID NO: 203473 - DNA, 377 bp, Homo sapiens
aaaggtagaatgctggccacaatctgaatgataaatctctgtatacaactattttaattttttttcccctgggagaagacactgtcatgatcctgttctagtcatagaagatgtgcttgctgccattgaacgtctgaggtgtagatgtctgtgttgctgaccactggaaaaaggattatcaggagggaggtgaagatgggaaaagtaaatttgagagtcagccaatcagggggctaagcgaagctcattggcaagctctgggaggtgaaggcagaaaagaggttgaggacaagcctgcaggaacagctacatttggggagtggtgaaaaggggtcagagaaagagaagcaggagaggacatgggcaggaagtgtaaa

SEQ ID NO: 203474 - DNA, 3108 bp, Homo sapiens
gcccccaggagacccagaggacaactgggcaaggtgggccggagagtgtgggggaaggcaaaggagttctgtgagctcagcgtctgaagctcatttcatgcatcaggccccagggctcagcttccgccttcggcttccccttctgccaagagccctgagccactcacagcacgaccagagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaagactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacagccctgactcagaagcctgatgtctacatccccgagaccctggagcccgggcagccggtgacggtcatctgtgtgtttaactgggcctttgaggaatgtccacccccttctttctcctggacgggggctgccctctcctcccaaggaaccaaaccaacgacctcccacttctcagtgctcagcttcacgcccagaccccaggaccacaacaccgacctcacctgccatgtggacttctccagaaagggtgtgagcgtacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagagtaagaggttgaagataacagagtgcaaagtttccttctctccctctctctctctctttctctctctctctctctttctctctcttttaaaaaaacatctggccagggcacagtggctcacgcctgtaatcccagcactttgggaggttgaggtgggcagatcgcctgaggtcgggagttcgagaccagcctggccaacttggtgaaaccccgtctctactaaaaatacaaaaattagctgggcatggtggcaggcgcctgtaatcctacctacttgggaagctgaggcaggagaatcacttgaacctgggagacggaggttgcagtgagccaagatcacaccattgcacgccagcctgggcaacaaagcgagactccatctcaaaaaaaaaatcctccaaatgggttgggtgtctgtaatcccagcactttgggaggctaaggtgggtggattgcttgagcccaggagttcgagaccagcctgggcaacatggtgaaaccccatctctacaaaaaatacaaaacatagctgggcttggtggtgtgtgcctgtagtcccagctgtcagacatttaaaccagagcaactccatctggaataggagctgaataaaatgaggctgagacctactgggctgcattctcagacagtggaggcattctaagtcacaggatgagacaggaggtccgtacaagatacaggtcataaagactttgctgataaaacagattgcagtaaagaagccaaccaaatcccaccaaaaccaagttggccacgagagtgacctctggtcgtcctcactgctacactcctgacagcaccatgacagtttacaaatgccatggcaacatcaggaagttacccgatatgtcccaaaagggggaggaatgaataatccaccccttgtttagcaaataagcaagaaataaccataaaagtgggcaaccagcagctctaggcgctgctcttgtctatggagtagccattcttttgttcctttactttcttaataaacttgctttcacctt

SEQ ID NO: 203475 - DNA, 946 bp, Homo sapiens
gcccccaggagacccagaggacaactgggcaaggtgggccggagagtgtgggggaaggcaaaggagttctgtgagctcagcgtctgaagctcatttcatgcatcaggccccagggctcagcttccgccttcggcttccccttctgccaagagccctgagccactcacagcacgaccagagaacaggcctgtctcaggcaggccctgcgcctcctatgcggagatgctactgccactgctgctgtcctcgctgctgggcgtgctcagcttcacgcccagaccccaggaccacaacaccgacctcacctgccatgtggacttctccagaaagggtgtgagcgtacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctaccagagaacctgagaagtgatggtatccccaaaggacaagaccaggacaagcaccctgtgaacaaaccctaagcgagagacagggacagcgatacaacgtcaccccaaaggacatgggaagggggcccaaaagacccatgtaggccgcgaggtacctggcgggtcgacaacaaccagagcgaagccccacccaagccacggctagaagacaggaaagccccagaaaggagaaaccagggctatcacaggacg

SEQ ID NO: 203476 - DNA, 462 bp, Homo sapiens
ttagcgacatcaaggtgggaaaagcaccgatagttctgaattcaaatcctgcctggcacttactagctatgagacctcagccacgtcactcaccccctctgagccttcatttcttcctctgtctcctttgagagttggtttgaggattagaatacatgcactttctcaatctgtagccattgttccattattactgccaccattgacatgactacacttaactgcttaacaattatgtgtatcatcgggaggctgggcatcctagggattcagcacagggggtctgaaatcagcctgcatgggttcaaatcctgctgtcatcactgtgtcatgaaacaagtgtcttaacttctctgtgcctcaatttctttagctgtaacatggagacaatactagcggccacctcctaggatgatgctgggtgttaaatatattgtacttgcataataaaatattcagaat

SEQ ID NO: 203477 - DNA, 3393 bp, Homo sapiens
gcccccaggagacccagaggacaactgggcaaggtgggccggagagtgtgggggaaggcaaaggagttctgtgagctcagcgtctgaagctcatttcatgcatcaggccccagggctcagcttccgccttcggcttccccttctgccaagagccctgagccactcacagcacgaccagagaacaggcctgtctcaggcaggccctgcgcctcctatgcggagatgctactgccactgctgctgtcctcgctgctgggcgggtcccaggctatggatgggagattctggatacgagtgcaggagtcagtgatggtgccggagggcctgtgcatctctgtgccctgctctttctcctacccccgacaagactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacagccctgactcagaagcctgatgtctacatccccgagaccctggagcccgggcagccggtgacggtcatctgtgtgtttaactgggcctttgaggaatgtccacccccttctttctcctggacgggggctgccctctcctcccaaggaaccaaaccaacgacctcccacttctcagtgctcagcttcacgcccagaccccaggaccacaacaccgacctcacctgccatgtggacttctccagaaagggtgtgagcgtacagaggaccgtccgactccgtgtggcctatgcccccagagaccttgttatcagcatttcacgtgacaacacgccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtatcctccagagaacctgagagtgatggtttcccaagcaaacaggacagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactactccccgaagctgctgggcccctcctgctcctgggaggctgagggtctgcactgcagctgctcctcccaggccagcccggccccctctctgcgctggtggcttggggaggagctgctggaggggaacagcagccaggactccttcgaggtcacccccagctcagccgggccctgggccaacagctccctgagcctccatggagggctcagctccggcctcaggctccgctgtgaggcctggaacgtccatggggcccagagtggatccatcctgcagctgccagataagaagggactcatctcaacggcattctccaacggagcgtttctgggaatcggcatcacggctcttcttttcctctgcctggccctgatcatcatgaagattctaccgaagagacggactcagacagaaaccccgaggcccaggttctcccggcacagcacgatcctggattacatcaatgtggtcccgacggctggccccctggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagagtaagaggttgaagataacagagtgcaaagtttccttctctccctctctctctctctttctctctctctctctctttctctctcttttaaaaaaacatctggccagggcacagtggctcacgcctgtaatcccagcactttgggaggttgaggtgggcagatcgcctgaggtcgggagttcgagaccagcctggccaacttggtgaaaccccgtctctactaaaaatacaaaaattagctgggcatggtggcaggcgcctgtaatcctacctacttgggaagctgaggcaggagaatcacttgaacctgggagacggaggttgcagtgagccaagatcacaccattgcacgccagcctgggcaacaaagcgagactccatctcaaaaaaaaaatcctccaaatgggttgggtgtctgtaatcccagcactttgggaggctaaggtgggtggattgcttgagcccaggagttcgagaccagcctgggcaacatggtgaaaccccatctctacaaaaaatacaaaacatagctgggcttggtggtgtgtgcctgtagtcccagctgtcagacatttaaaccagagcaactccatctggaataggagctgaataaaatgaggctgagacctactgggctgcattctcagacagtggaggcattctaagtcacaggatgagacaggaggtccgtacaagatacaggtcataaagactttgctgataaaacagattgcagtaaagaagccaaccaaatcccaccaaaaccaagttggccacgagagtgacctctggtcgtcctcactgctacactcctgacagcaccatgacagtttacaaatgccatggcaacatcaggaagttacccgatatgtcccaaaagggggaggaatgaataatccaccccttgtttagcaaataagcaagaaataaccataaaagtgggcaaccagcagctctaggcgctgctcttgtctatggagtagccattcttttgttcctttactttcttaataaacttgctttcacctt

SEQ ID NO: 203478 - DNA, 1660 bp, Homo sapiens
tagagacagggtttcgctatgttggccaggccggtcttgaaattccctggatgacctattaaacagtcatcccaccctccctttcgctgccttctaaaggtgctcaaatttcttgatggcatttgtcacttaccagtcattgtacttttgctaattattgtctgttcctccttccaagatggaatgcaagctcagcaaggcaagggcagggacttagtttcactctgtgctgtaaatcagtgcccgacgcgtggtaagtgctcaaatatttgctgaatgaatgaatgaaggatggtggttcttccctcaggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagagtaagaggttgaagataacagagtgcaaagtttccttctctccctctctctctctctttctctctctctctctctttctctctcttttaaaaaaacatctggccagggcacagtggctcacgcctgtaatcccagcactttgggaggttgaggtgggcagatcgcctgaggtcgggagttcgagaccagcctggccaacttggtgaaaccccgtctctactaaaaatacaaaaattagctgggcatggtggcaggcgcctgtaatcctacctacttgggaagctgaggcaggagaatcacttgaacctgggagacggaggttgcagtgagccaagatcacaccattgcacgccagcctgggcaacaaagcgagactccatctcaaaaaaaaaatcctccaaatgggttgggtgtctgtaatcccagcactttgggaggctaaggtgggtggattgcttgagcccaggagttcgagaccagcctgggcaacatggtgaaaccccatctctacaaaaaatacaaaacatagctgggcttggtggtgtgtgcctgtagtcccagctgtcagacatttaaaccagagcaactccatctggaataggagctgaataaaatgaggctgagacctactgggctgcattctcagacagtggaggcattctaagtcacaggatgagacaggaggtccgtacaagatacaggtcataaagactttgctgataaaacagattgcagtaaagaagccaaccaaatcccaccaaaaccaagttggccacgagagtgacctctggtcgtcctcactgctacactcctgacagcaccatgacagtttacaaatgccatggcaacatcaggaagttacccgatatgtcccaaaagggggaggaatgaataatccaccccttgtttagcaaataagcaagaaataaccataaaagtgggcaaccagcagctctaggcgctgctcttgtctatggagtagccattcttttgttcctttactttcttaataaacttgctttcacctt

SEQ ID NO: 203479 - DNA, 340 bp, Homo sapiens
cactggggagggaccctggggacagcctatgggctgagcagagagggctctcagggacccctgcagcacaagaatctcccaccacggtctctgtcccagccctgactcagaagcctgatgtctacatccccgagaccctggagcccgggcagccggtgacggtcatctgtgtgtttaactgggcctttgaggaatgtccacccccttctttctcctggacgggggctgccctctcctcccaaggaaccaaaccaacgacctcccacttctcagtgctcagcttcacgcccagaccccaggaccacaacaccgacctcacctgccatgtggacttctccag

SEQ ID NO: 203480 - DNA, 336 bp, Homo sapiens
ggtagtaaacgtggcagtctgtcacagggaggtgcagcagggcacaaacaggtgggttcatttcctcagcatgaagattctaccgaagagacggactcagacagaaaccccgaggcccaggttctcccggcacagcacgatcctggattacatcaatgtggtcccgacggctggccccctggtgagtgtctgggccatgcttccactttttctcttctctaaagctgacatcccactttctgacttttgcaccccttgtcttagcgacatcaaggtgggaaaagcaccgatagttctgaattcaaatcctgcctggcacttactagctatgagacc

SEQ ID NO: 203481 - DNA, 377 bp, Homo sapiens
ggcctcacaatcatggtggaaggcaaggaggagcaagtcgcctcttacacggatggcagcagggaaagagagagcctgagcagagaaactcctgtttttaaaaccatcagatctggtgagactcattcactaccatgagaacaatgctggaaagacccacccccataattcaatcacctctcactgggttcctcccacgaccatgtgggagttgtgggagttaaattcaagttaagatttgggtagggacacacccaaaccatatcagaagtccaatttatttatttttttcttggtttcttatgcttttgctgtcatatctaacaaaccattacctaatccaaggtcatgaaaatttatacatatgttttcttcta

SEQ ID NO: 203482 - DNA, 259 bp, Homo sapiens
gtattatgttagcttctgtctatgtcgtagtccaatttctcttgtcgaagcggaggtgtggagtctcagcaggcacaggaaaaggagttaggattgaatttgatgatgaaaatgatataaactgtggtggaactaacacagctgtaaattagccacacattgtgactatgtgatagtaaagtaggaaacgtaagtttattttctagtgcgagacattaccaaaagcatgttaatgcagtgcatgaagacaaagggaaaa

SEQ ID NO: 203483 - DNA, 449 bp, Homo sapiens
gctaatacatgaatttagcaattccacatgatacaggatcaacacacaaaaatcagtgatatttctatacactagcaataaacaatccacaaagaaaattaaggaaacagttccatttacaatagcatcaaaatgaataaaatatttaagtacaaatttaaccaaagaggtataagagttgtacactgaacaaagaaagcatggctgaaagaaattcaagaatatgtaaataaatgcaaagacattctgtattcatggactgaaagatgtaatattgtaaagatagcaatattccccaaggtgatctacagattcaatgcagttccactaaaatcctaacagctttttgttgctattgcagaaataaaaaagctgatcctaaaattcacattgagttgcaacagacccagaattgccaaaacaatcttgaaaaagaacaaaactgaagc

SEQ ID NO: 203484 - DNA, 509 bp, Homo sapiens
tcagctttggtaagttgtatttttctagaaatttgtccacttattctcaaatttaattttacaaagttgtttatcttcagaccattttatcgtttatcatttattgcatctggactgatgttttctcttacgtttttgattttaggacattctttcccttttttccctttatcagtgtcagcagtgttttacaaattttgttaatccttttgaaaactgggttttggttttgttaatcttctctattgtatacttgatttgtccattaatatttctgtccattatttcttgcttttatttttattgttgatttctttctacttactttgagtttaattggtattttttctgactttttgaagtgaaagtctatataattaattttcagcctttctccatttctaatacatatgtttaaacttatatgatttttgtaacattttatcttcattgtataagttttaacaagtatcttttgtcatttaattaaatttcattatgatttctta

SEQ ID NO: 203485 - DNA, 519 bp, Homo sapiens
tcagctttggtaagttgtatttttctagaaatttgtccacttattctcaaatttaattttacaaagttgtttatcttcagaccattttatcgtttatcatttattgcatctggactgatgttttctcttacgtttttgattttaggacattctttcccttttttccctttatcagtgtcagcagtgttttacaaattttgttaatccttttgaaaactgggttttggttttgttgctcttgtaaagtgtatcctccagccagaaggaaagcaccaagcccaatgaacttggtggcccttaaggaactgggatataccaggcctgagttttttcttggttgggaggtgtaagaccccagaagagggagttttttccaacccccagccacccttggttcggggtggggcctggtgaaaaaggttggttttttcttttcccttggaagtgccttccgccaccacaagtgaacctgtgtttgaagatccccggggttaccccttatcaccttttttttcttta

SEQ ID NO: 203486 - DNA, 236 bp, Homo sapiens
tctagatatacccaagaaggaatacaaaatgcttacttacatatccaaggtactaagatacttcagatgtagatatgctaactgtaacttaattacaaaataattttttctttttttttttttgagacggagtttcactcttgttgcccaggctggaatgcaaaggcgcgatctcagctcatctcagcaacctccggctcccaagttcaagtgattctcctgcctcagcctcccaa

SEQ ID NO: 203487 - DNA, 380 bp, Homo sapiens
gtccagcccgcctggtgtgggggagtccaggctcagggaggacacagcagtaccgcctgcttgggctggcagggagctcaagtcagcatggggttcaggccccgcctgcctgatgggcgaacacacccccaaggcccccgttagggccaggaggcaggctggcagccagcgcaggtgcagaggggccccgaggcttccatcctgaggtcagcactgggaggacagaggctgcctccttgcagcccgagggttgaccaatggcactcgccgcatcccttcccagagcaggccagccccacgggcatcatgagggcctgcgtttggtttaatgctccgctgtcaacatcttgaaattctctgtaatttttaaataaggggcc

SEQ ID NO: 203488 - DNA, 382 bp, Homo sapiens
ggttggaatcctggctctcccgctgtctggttgggtgaccttgtaaaatggggaatacatcattcgcctcatcctgcaagttgtataagaaataaatggctggtgcaggggcttatgcctgtaatcccagcactttgagaggctgaggtgggcggatcacttgaggtcaggagttcaagactagcctggtcaatatggcgaaactccgtctctactaaaaatacaagaattagcacggcatgaaggcacacacctgtaatcccagctattcaggaggctgaggcaggagactcacttgagcctgggaggtggaggttgcagtgagccaagatcaccacaacgcactccagcctgggtgacagactgagactctgtctcaaga

SEQ ID NO: 203489 - DNA, 444 bp, Homo sapiens
caggcagcaatattagcctagtgagtgcttccccccagtccactcccactcccactcagatgaggtaaggttacataggtataaactaatgaacccaaattttgtacaacccacttctatcaggcccttagaaatgccggcataaagttgagaaacacagctacagtttgttgcttaggagtcatccctgcttcctgcacttgtacttgtagccctcatcctaggaccactgcatcaggtaggggaaaaagaaacctgaggtgatgtggagaaaaaggaaaaaatcatagtcattatactagtgtactcttcccttgtcaagaattgcagtcataccagcatcctccctgcccctcctttcccaggtccactagaaaaatagaggaaaactgaatggggacccttctttagccccactcctggtacataaaagcacacacttgt

SEQ ID NO: 203490 - DNA, 254 bp, Homo sapiens
tattttataagggcaacatactctcgatgccaaaacctgacaaacaaattataagaaaagaaaattacagaccaatttctctcatgaatccagatgcaaaaattctcaacaaaatattaacaaaaaatttaaagagttgatccatttctctaattcaagacagcttattaagtaaagatgctcatggaatcctaaacttaccctaaattgggataaactgaggtcctctttttcctttttttttttttgtttgt

SEQ ID NO: 203491 - DNA, 207 bp, Homo sapiens
atttaaaaacatctgatgagagttcagaagtaaacccttttatccaaggtcatttgattttcaacaggagtaccaagacaataaaatagagaaagaatgaatagtcttttcaacatatgatgctgagacaactggatatccacatgcaaaataataaatgaagttggaacccttcctaacaccatacacaaaaatcaactgaaaatg

SEQ ID NO: 203492 - DNA, 382 bp, Homo sapiens
atcctatcctgtgcgtccacatgcactaactcattctcagggccttcactatccacatcccccgctcagatggtttgcctttagcaacaaaaattaatccaagattttggtctgtggatgcccttgttccctggtttcagggctactgcatgtttcccctgtaatattcctttcatgtttgtttttctctggtgatactggctgatacctggttgcgggagttgcctgaggctccttgggctgccatcttgcccggaagactccagtgtgccccgcacctcctatgctcatccctgagtagctaggttggagtctgtctctcttacttatctgtgaactctgtgagggtagggcgcaggtctgattcatctctccaagtgag

SEQ ID NO: 203493 - DNA, 177 bp, Homo sapiens
gttatatatcacagctgctgaagcagaggttcagaaaagtcaaattacttcactgagattgggtaacctaactcccaacttaaataaatctaatgcctttctaccactgtcctgccctcttttctgattgtggaaggccctgaaagcattaccaaagtttcaaagttacctaaataa

SEQ ID NO: 203494 - DNA, 550 bp, Homo sapiens
acagccacccatgggaacattgttcacgtcttccagccacagatttcctgtctttcccattttaactgagtccgtatcatgctctgtggctgtaacttttgcattttgaggtgtgacagcaaaactagcatgaatttctttttctttcttcacaatttctttaatagaagattccctctgaccctagttcttagcagcctcagcaaacaattattttatatccttataaagtgtagagctttcaccttttcatttaaggaagcactttacggcttctctttggtgtacctgaattgttggtatcactactctagtactttggggccatggttaagtgaaataagggttccttgaacataagcactcagaagccacaagagtggatctgataacccagatggccaccaagtgatgagagggtgggagcgcccacagcctggagatgctggacgaagggaggattctcgtccaggcaagatggggcagacagcatgaaacttaagcatgcaattcagaatggtctgcaatttaaaacttatgcattgtttat

SEQ ID NO: 203495 - DNA, 494 bp, Homo sapiens
ttcttgggcaatcatatcagaaataaacactaccccttatctgaatagaccttttctggtcttggtcttacctccctggctattctggagcagatgggtggattaaggcaaaagggcactacagtaatcaatgcagggctcaattcactctcaggtgaagttcatttctctattctctcaaggttggattcttagcctttggcatttgtgctatgtgccatgaaattcctgccccaagaaccggttcaggggatcaaagagctattattaatgactcagtttaggccaactgagggagggaatgacagtagaggcaggccactcacccctccattcagccaccctcctccacaacggggccattgagcaggcgccacaatagagggctgagaataaaaggctgaaggaaagcatacagagtccctttgcacagactcggtcattcatcaccaggcaagtgccaatatctgggaacagcaatctcaatttctgca

SEQ ID NO: 203496 - DNA, 520 bp, Homo sapiens
ggtggtgttctagaggatcctcggattggcgacatttcaatatgtaattaacatcaaagaatgggttcatgagataacttggcagtgtgcagtggctcacgcctgtaaccctagaactataggaggctgaggaaggcagattgctggagcccaggagctcaagaccagcctgggcaacacagggagaccccagctttaccaaaaaaaaaaaaaaatttagcccggcgtggtggcacacccctgtattcctacctactcgggaggctgaggtaggaaaatctcttgaacccgggaaacggattttgcattgagctgaaattgccagtgcactcctgcctgggaaataaaataagactttgtctcaaaaaacaaacaaccgcctcggtctttgtgcaaaatctataatcatttgcaagaggctgcaatcaggtatagcactggattttgtgaccaaaactaggtttcaggatttaattaaaaacaaaaacaatgtcaggtcataaaacacaagacatataca

SEQ ID NO: 203497 - DNA, 781 bp, Homo sapiens
catagattaggaataattgattctacagtaggtctgggtggcatggaatataagctccgtccagcaaggatttgctccatcgaagataaacgcagccagcgtggggtagatatgaggtgctcctgtcttccagcaactccagacaactgatacatgttagaagacagcacattaattatgaaacaatgcagaaaagatcttaagggagaaagaaaggatgacaaacatcaataatggtaggagcacctttcagcagtcaacttggactttacttacatatgcatgaattgagaggcagacggaaggaaaaattcaagaatacacaatacaaaataagtgttggaatcttgttctcaataaagcatacatcttgttatcagttttgggagcatcgtgtgacaggaggttatctagtattatctgtaagaatcacctgctatgtgtacagttcagtagtagtgctaggtatactttggtaccttgacggattacacatgaaacctgttgcccaacataagtgtgttacagggagttcggcaaagagaaatgcatataagatacaatagttgggaaggattttcatagaatgctcttgtttggaggtgggagcattagacgaccattcagaacaaaaggggaagtagtatctatcttagtgagtgtgtccagagatttggggaggtagaaatacctaggtatcaacttcaaatgagctatatctgtttcggggagtagatacgatcagagtgggcccaccgtgagcaaaggctgacagttgata

SEQ ID NO: 203498 - DNA, 651 bp, Homo sapiens
agagacaccgcctgtttcagtcccaaagagctggccagaacggtggggcgtgtgtggggaaaatggtgtgatgctgggctggcttgggaccctgtgaggggagggaacggaagcaaaagcttgatgttcttggctccacttgggaaactgaaaccagccttctctgtggtttactggcccagaactgaagtatctccattcccactcaggattgcagggtgggccagggggtgcagctcagctgtgtccaagaataggctctcaggagaacgggctgggctctctcagccgaggctgggtcagaacttcaggaaatctaagtcctggactcgttagccccaagctggggtgggtcccatgctgtgctggcctctggagggtggggcagaaagcctgagcatatggcgagcttgtggtctccttgaaggaggagaggcgcactcctggaccagccagagagccagaggtggctgaggtgttctcacctgaaccgctacccatgtgttgcacaggtgtccccagtttgggacccattctgcactctgcatctcactcctctattctacctccttacctcaaaacaactccgcttttcctcttgaatctctgatttcatgaatgctcccccatccatcccgaggcgaggaatct

SEQ ID NO: 203499 - DNA, 438 bp, Homo sapiens
ggacacaaaacaaattaagttgtcaaaataagcacatggtaatcagagtggctattgatctcagacagtaagcaggtgagtttagctggatttggtgtacactgtcagtcctcaaagtacagctactccatttgtgaatgtatgttgatttttcttatgattgtctgtattctgtagtttcctctcccccagtgtattcgagaatgtcttcctattgcttttactcatgaatgacatcttagattggaaaataattttctgggtcacatccagtttttttctcttaccataagacattactccattgtcttctggcatttagtgttactgtggaaaagtccaaggtcagcccatttttgttttgtaagtgatatgcttctgctgggatgcttttagaatttttgttaatgggtaaaattcagcagctccaccaggata

SEQ ID NO: 203500 - DNA, 494 bp, Homo sapiens
agaatcaggaatagattgtatacatatttttcaaattctttctacttagtgttatatgatagtcaataatatatgtgtatgtaagtagcaataaatcattcctgaaaacttgttttttaagcttgtataacattccgtcatatggatgtactgattttgctaatttgttaagtttaaaataatattcattttcatttctttgactactaggtataattaattttttcatacactcactacccttcatacttcttttattgatttcctttttatgttaattattaagatttctatttgactctcaacattttcttaatttttttatcattaatagatgtaaaaaaattcttaatttttaaaaaataaacccttttcatcttaaagatagcaatctattttccataatacttgttataaatatttccccagtttgatgttggtcttttaattttgtttaaagtatttttgacaaataaataagtttttgtggcttg

SEQ ID NO: 203501 - DNA, 878 bp, Homo sapiens
ccatcgtgtggattctggttaaggtgtgtgacgcctgtgtcatagccgggcttcacaaatggaagctgttgtcataaaaggctcagcagcacaggactgcgatcagtaggggttttgcaccaacttagcaaactggaatatctctctctcacacacacccctatcctgagggctgacagtcacaaatccagaccaagcaggaattggccagctggtaaagtcctggaaggaacaggctgagcattttagaggacttggtcagtaggtgatcctgagggtcttaggacatgtgtcctgaccactgcagcgtctggcctgcgtgagcttttccagcccctggcagcaaatcaaggagaagggagcaagtctcattcatttgaaaccccaagaattctcctaaaggggtcaggaagctgtcccgaaggcttgtccctctgggtgctcctgcctcaccaggtagttaaccagaagctacactgagctcacaccatcttccaggcatctttgagctcaaaatcactgagctcacaccatcttttcagtccctcactgttgacctcagcctgcacacgattggtgccgccccagccgacacatggttcttcctaagccttctctgctcatccaccataccttactgcttataccttacaggccaatgctcttcagttctgtcttgcttcttcccagcatcactctatcctgatggttctcagacattagtgagcatcagaatgcctgaagggcttgttaaaacagtactgggcccagtccgggagcggtggctcacgcctgtaatcccagcactttgggaggccgaggcaggcggatcatgaggtcaggaaatcgagaccagcctgaccaccatggtgaaaccc

SEQ ID NO: 203502 - DNA, 603 bp, Homo sapiens
gaggtaccagctagcagtcagtgtgagtatgcatgtttgtagcctgattccatagcaataaaactgtctgcttctccatcggactctcccccttggctgtgagctcccagaaggcagggcttcccctgccttgtaactctatctgcagtttctggcatcatctggctgagacttcatttaatacaatttactcctctgtaccagacactgggctgagccccagaaggaacagtggtgagtaaggctgacttgatgcccgtctgcatggtgcttgcagaagcctgctaggctctcagaagccaaggctctcagaaagtgtctgctgaatgaatgagcttgtgtaagaggtggccatcagggggactggggcagctcgtgtgtgctgtggggggcttagggtccagtgatgatgggtctttgggagcagactacttctgtctgtggggaaaaaaaggaggctctttgcctttcacaacgggaaatcgggtcaggacccgagtgattataggatcataagtaattataggcctagatctccccgtgatccatccctccctttcctcgaagggcctggagccaggggttacagctggggcggccgca

SEQ ID NO: 203503 - DNA, 943 bp, Homo sapiens
aaatctcaaattttttaagaacctgcagattctttgatacaattcacgaaacaaaccagtgcaaagcaaacgcagtacacccattccaatgtaattccaatggcaggcccattccaaccctcagactaccaatatttgaactcaggtttgaatgtcagaatccaatcattggcagtcctgtgccaaagcttaactgataatgtggaattcactactgaacatcatgtttactgctgactaaacaaattgctattggaaagcctcttctctccatcttctgggtataactgcattgtgtagtagccattctggtcttttctgcaccagaaggaacactggagtaagaactcagaggtcatgctcccataggaaatatttcccagtggggaaatactttatagacttgtttctcctaagttcagttgtcccagggtctgtagacagaaactgaaatgcataaaactattattgtgtttcttggactaagctttttattgtggaagattctagaaaacatgctataagtttaattgtactaaagccacatttaaattctgagacatctaagttatattttttacttgaaacatccgtgtttatgagttgtggctctatagcccttgtaagccatgttcccttttccctgaatttgaaactccaatctttccaaacatccctggtgtgtattagcattccagaggctgccagaaagaagctgggaggaagcctaatggctagatttgtactcaagtacctattttttggacaagaagactatgtctgtgccaacacaccacacaataaaataggggtttggtgccagtttctatcgatttggtcaggatgggcagccaaactagaaatttcatgccagaaatatgagttggtttggctgacttagcctgattaaattcactggataataattaaatgtcacatctgg

SEQ ID NO: 203504 - DNA, 603 bp, Homo sapiens
tagctgttcagaggatccgtgataatccgtacatcataaaaaatatcttgttctcttgtgcataaatctagacgataatttccctgtatataatagtatcatttagctgttatgtaatttttgtatcattagatcaggttgtctgcatttgtcggtgtaagtgaacatcatcacagtaatcctgagttagagtttaagccaaatacatgcatagaaaagggtctatcctattaatggaagaaggtaatttttaggatgtgtattattacagtgtcgtatgtttaacttttattaaataaacgtgtttttaaaatctccagggtgtgttcacacaaggataaagtctttagactgtcagcacttagagcagttaaacctccaagtacttgctcacggcattcatgcaagagaatactgagtgtgtgagacgtttcagtaaatgcttacgtattccttccatttttcttattttcagctttaaaacttagctgtcgttcagttaagcttaaagataggttaatttgtaaatggcaaagtttgttttgaggtttttcctcaataacttgtttcctaggcctattaagccatctccaaaattgatct

SEQ ID NO: 203505 - DNA, 714 bp, Homo sapiens
caaacaaacaaaaactcaacaccttaaatactgagatttgagatatacaattttccatatatttgatatgtataagtaaatataaatgagatcacttcaagttagcatctgcacagcaaaggatacaatcaacaatgagaaaaaaccccacagaacaggagagaatattttcaaactacctatctgtcaggatctaataacccaaatatataaggagctcacacaagtctataggaaaaaaaatctaataatacaatcaaaagatgggcaaagttcagctcactcttttccccactgcaatagtactactgaaaaaaatctgcccttaccattttagtgatgtctggctttatctttgaaagtgcttaagagcatggagtgtttccagatcattttgtttcaagtccagcagagtcgctataaaaccttggtcaagtcacctaccttccttgcacttcaatttcctcatctgaaaataaaaataatcatagtaggtttgtagacaggattatgagtgaatccatgtaattaacttagaacagtgcctataatggctatataaaggctataatgttgatttttacttattatgatagtcactattcttcaagcaacatgcttcccataaattgatggaaaattgacaaaaggaaatatatttgcataaatagttgtaatatatatatgtcaaacagtggatttaataaaaggcat

SEQ ID NO: 203506 - DNA, 493 bp, Homo sapiens
ccacagacttctatcactttagttttctatcattttaattttgcctcttctaggattttatgtaaatggaatcataaagcatgttgtcttctacttctgatctgttttacttagcatagtgcttttcctccatttggttgatcctttttatctctgagtagtgttatatggaaatatatctacttgcttctccaacagttgagggacactgacatggtttccaattgttagccattgtgaagaaaattgctgtgaatatatacatacaaatttttgtgtgaacgtatttttttcatttctcttgggtaaatttggagtaggattgctgggtcatgtggtaagtgtgtgtttcattttattttttaaaaatggagccaggcacaatggctcatgcctgtaattccagcacattgagggcctgaggtgggaggatccgttgagctcaggagttcaagactggcctgagaaacacagtgagacctcatctctaaaa

SEQ ID NO: 203507 - DNA, 358 bp, Homo sapiens
agagtttcgctctgttgcccgggccggagtgcagtggtccaatcttggctcactgcagcctccacctcccgggttcaagtgattcttctgcctcagcctcccgagtagctgggattacaggcatgcgccaccacgcccagctcattttgtatttttagtagagacagggtttcaccatggtggccaggctagtctcgaactcccaacctcaggtgatccgcctgcctcaacctcccaaagtgctgggattacaggcatgagccactgtgcccggtctacttctgtgattccatttaacaaagggaaggtccctggttatccttcttgtacagatgaggaaaacagcttgtggaggggt

SEQ ID NO: 203508 - DNA, 428 bp, Homo sapiens
ctcttatttcctgtgtgattaatgagttagaattagtactggagctatctctatgagatgtggatttcattttggggggtggtacatactcaacagatgaaattttgggtcatatggtagttctattttgattttccaaggaaccattatactgtttttcataatgtaccaataacatttctgccctgtaagggtccccttttctgcacaacctaaaagggtttcactctctccacacctttgccatcattactttttatctcttgactttttgctaatacccgtcctaacaggtgtgaggtgatagttcattgtggttcatttgcattctctgattattaatgatgttgagcacattttcataaacctgtcagccagttgtgggttttctttcgagaaatgtctattaaagtcctttacctattcgt

SEQ ID NO: 203509 - DNA, 490 bp, Homo sapiens
ctcaaacttggcccagaagtaccaaagggagttgctggacctgaggggctggggcttcagtgaccataatggaatgacccatagccccatatgggcccataactgaacaccaaccagatggggctggtggaaggctactgtcaacctgaaatgaagaaactgttattgaaccagaatggggtccaattgcctggtgcagtaaaagtagatatccacaccaaggttttgcagcagtagtgaagaaggaattcatgaattttaaaagcataatcaaagaccagcaagacatttttactttttccttcaaaagctaagtgtactgtagccccccaccccacatagtcatagtctaagttagagaagaatactaactgcctgtttttccttctgtgctcagcaagccttatctgtactcaccagtttcacattccttgaggctcagcaagttcctgctttacctccctagcgcagctgcaaagttacaaggttg

SEQ ID NO: 203510 - DNA, 674 bp, Homo sapiens
ggacttgtaagacatagtaaggatcatggaatttatttaaagtgagctgtaaagctactaaaggattttaacccaaaatggcacaatctaacttgcatttttaaaaattacttttgctactatgtagataattaaatgaagaacggcaaagaggaaaaaaaaagatgatgatgacctattcatcagtaaagaattagggaaagaagagagtagattcaaggaatactttggaagcagaatcaacagaatttgctactagattcaattgggggtggtggtgagacacagatcaaaataaagtatgacaccaagttttctggcttgggcaaataggtaaacagtgagagtagagggggaaggttattttttaagtcctgttctgggcatgttgggtttatggtattctgaaacaacactgaagtgaaattttcaagtaaacagttacatatgcatgtctaaagtgcaagtgacatctggaccaaaagtgtaaggttgggaactttcacaataaagatgacatttacatgccttggaactgattgatatagagaaggctcagagagcaaaagatactcagagacaagccctgagaaatcttaatatctaaaagtgggacagaacatgattaacagccagatgagaggacaccaacagagaaaacaaaatggcaattg

SEQ ID NO: 203511 - DNA, 596 bp, Homo sapiens
gtagctagattcacaacgtcgtgtgagtgtactcagccaggtcgatacaggtcacaagactagttaagttatacagctgaaatacaagcataggttttttttgtttgttttttgtttgtttgtttttaagacagagtctcgctctgttgcctaggctggagtgcagtggcatgatctcggctcactgcaacctcctcctcctgggttcaagcaattctcctgcctcagcctccctagcagctgggactacaggcgcatgccatcacgcctggctaattttttgtatttttggtagagacggggtttcgctgtgttggccaggacggtcttgatctcctgacctcgtgatgtggcccgccttggcctctcaaagtggtgggattacaggcgtgagccactgtgcccggccagattttacatttagctaagttttgattaattgtgcctttatgcactggaccaatcctacagcttaacttcgtctttgtcacttccctgtgcagttctcaaagaattcaaacgtgtgatattgacaatccaagactctttttccaagcctcattttccttgataccctatctgatggctggaaattc

SEQ ID NO: 203512 - DNA, 127 bp, Homo sapiens
tttatgaaaattctgaaatgctaaagaggcatgctggggagtgttcataacttctctctttctttgttccgatggtgtgctttcacacaatgctcacctcattatttcagacggtcactattttgta

SEQ ID NO: 203513 - DNA, 687 bp, Homo sapiens
aactcctggggctcccagaagccagcagaggcaaagatgcatcctctccgagagccttaggcaggagccagccctgctcacaccttggctttggacttcgggcctccagaactgagaggataaactggtgtttcttcacgccccgtggtctgtgctagttcgttatggcagccctgggcagggaaaccttgagtgacgttactcgaggcaccaaaggcaccagtgcattttatccttaaaggcccacgtggtctgaagggtgtggccgagcctcacgcttgtcacttcagaagggtgggaacctgacatgtcagagctaatccttctcatatttttagatcctgatttcttttttagaatggaagaaagttttttgacttaaaaaaatgaatatgcttcatgttttagagcaattttaggtttacagaaaatggaacatagtgtagagcattccgggatcacgttacatgattatttgttttgttttgtttgagacggtctgctctattactcaggctggagtgtggtggtacagtctcgatcttggctcaccacaaccttcgcctcctgcgctcaagtgttcttctttctcagcctttccagtggctgggaccacactcagtaaccaccacgcccagctgattttttgtattttttttttgtagagatggggtttcaccgtgttgc

SEQ ID NO: 203514 - DNA, 563 bp, Homo sapiens
atggccaaagttaagaaggtgatatcatcaagtgttgatgaggaagtgcaaagcttgcaagtctcacacactgctagtaggaatgtcaaatgatagtcattttgaaaatggtctgctagtttcttacaatgtaaaaagaaatataccacatctcagcaatttcattcctagatatctacacaacattacttgaaaagatatgcccatacaaagacttgtaaacaaacgttcacagcagcacagcagcgtgattcctaatagcctcaaatataaacaatccaaacatccatcaactggtgaatgaacaaaatgtggtacatcacacaacacagtatacacagcagcaacagggaatgaacagatacacccaaagtggctgaaacttaagaacattacattaggcgaaagaagacacaaaaaattacatattgcgattccatgtatataaaatagactttaagtcaaaaactgtaacaagagacaaagtcgttatagaatgatacaagggtcaattcattgagaggatataactactgcaaatatatattcccccaacattggag

SEQ ID NO: 203515 - DNA, 182 bp, Homo sapiens
tagagtctttgaagtgatgggtatgtgtgtattggcagagttgaagataaacaatgccaaaagacctctaaaaagattagactgttaaccacaaatacgcggtttcagttgagaagatttatttatggtaattttatccactagcaaatcttgatttagtttgatagtgtgtagaaattgaa

SEQ ID NO: 203516 - DNA, 516 bp, Homo sapiens
ctgtaaggattgcatgtccaaaaaattatgatagttggcaagatcaagtctccataaaaatggtaggtcggaggaaaaaagaagtggaatcaactgtttttaaaaatcacggcaaataagctttctagaaagtattaactttctgccttaaaaattgtccatgaaaggaaatacttctccagtgagcagcaaaataccgggaattctgtacccaaactggtgttaaaccctggctctccctcttgttagttctgtgagtctgggcaagatcctttactcctctgtgcctctgttttctcatctgtacaatggggatgataatagctgcactaactttgtggaactgttatgaagattaaatgagaaaatacttgttaaaaaaaaaaagacagttctcgtagtatggtcattgcaatattctaagataaacaactcacctttctaggctgctctcttaatttgctgaagcagattcccccaagtgtcatgttactcagattatgtccttttcaagtt

SEQ ID NO: 203517 - DNA, 529 bp, Homo sapiens
tttctcacgtttcagttcagctcactttgttttccgtccccctccctctactgtaaaagtatgtactcagtgtttcatttcctgccggatctgattcaggtcagtgatgaagatctttgcgagctcagtggggaggcgtttcctccctttcataccggccctgcttagggatgcatggttggttatatacttgcttcactcggttaggcatggaggagaattcattcagacctcataggtttaaatcaaatgcatgacccttcacattttccagagatttagacagttacagtgagacaattaaacattcaccccacaagctgcacttggagatgtgtaagcagtaatgtagtcatgcgctccccatgatatgagagtgtgcagaatgccactccccacagcaggtccaccaggacctcctcagggagcatcttgcctacaaaatcacccatcccttttcccccactttcttcactttccctacgtttccactcccacacccacaaataaacaaagaaactttgagctt

SEQ ID NO: 203518 - DNA, 1198 bp, Homo sapiens
agttcgacggagactctcaagagggatcagaccatgaggggtttgccttcctgaatgaattaatgccattattgttatctctggagtgggctccttataaaagatacatttggccctcctcttgccctttctttgcctttctgccatgggatgatgtagcaagaaggccctcatcagatgccagaccttccatcttggacttcccagcaaccagaactgtgagccaacaaatatattttcattgtaaattacctagtctgtggtactctgttatagcagcacaaaacagaccttagtgtcttaacacgatacatatatatcctatctggaagcaaatgagaggattatgcctttgagagccagatggaataacttattagttttttaatttgtctggcacattatttatttttgacacaactagtgaacaactagtgcaggttaatggtagagcaatctacatctatagcaacaatgccaccaccaacaacaaaatcatagcaattcacttttctgaaaattaaactaaaactagatcttctcaacagagaagcccaataccagatatcaagagaataaggaagtggtctgaccttttagaactattgatagcacttaaaagttaaggagacacttgcagatcttatgatgagagtggtctccttataaaaatattatctctccccctattaaaataggactcccccattgcacatagaaaatagaattcaggccaggcgcagtggctcatggctgtactcctagcacttctggaggccaaggctggcatatcgcttgagcccaggagttcaaggccagcctgggcaacatagcaaaaccccgtccatctctacaaaaaattagccaggtttgctggtgcgctcagctacttcggaggctgaggtgggaggatcacctgagcccagaaagtcaagactgcagtgagctgagattatgccactgcactctagcctaggcaacataacaaaaccctgtaaaaatatatagacagccaggcgcggtggctcacgcctgtaagcccaacactttgggagatttagaccctagcagtttgactcctgaggccatgctataaactactaggttacatgagatgtatactaatctacatgagtgtgcttatttcagagtgttatatggtatctgaaaatgggacgtggtattatgagactgtgaa

SEQ ID NO: 203519 - DNA, 367 bp, Homo sapiens
tgctctagaggatctgtcacacgggttcgagttcataaaagtggtaatactttcacatattttgagcattctatgtgacagacagttcaacactctacttgtctcagcaatgctctgaaatgggtactatcattatcactattttaatggcaaggaaagtaaggcagaatgagattaagtaatttgcccatagttaaactgccagaaagtagctgagctgggagatttagaccctagcagtttgactcctgaggccatgctataaactactaggttacatgagatgtatactaatctacatgagtgtgcttatttcagagtgttatatggtatctgaaaatgggacgtggtattatgagactgtgaa

SEQ ID NO: 203520 - DNA, 313 bp, Homo sapiens
ttcctgtcgcaggatcctatctatacagcatattatgtttagtccccatgtactccttaggctcctcttggctactaagtcttttgcaacctaacatttattattattgctttcagggccagagttcataaaagtggtaatactttcacatattttgagcattctatgtgacagacagttcaacactctacttgtctcagcaatgctctgaaatgggtactatcattatcactattttaatggcaaggaaagtaaggcagaatgagattaagtaatttgcccatagttaaactgccagaaagtagctgagctg

SEQ ID NO: 203521 - DNA, 569 bp, Homo sapiens
tgtcctgtacctattaagagaagctatcaatatactttgtcaggataaaattcaacagaactgttttagactaaagattttagggaccacaaggaatttcccagtgggcaaattgtgagggaggtatttagcttttaaaaaaatctttgtagctatctcatttagaaataaaatgggaggcagattgcctgatgcagctcctaacttgacttttcccttttacttcataattttggggtcctgaggtttattttcctttcacagaatataaacatgtacatacatttattattaaaaactctgaaggaaataacaggttttgtgaaagagaacacagaagggaatccgatttagatcaatgttcagacagccctggttgaggaagtaacaacagaagagggaaggaggatccaggcctcagaggtaccagactgtccagtcaggcagccagtgggagtactgatgaaacacctactgtgtgcaggctactattctagtgctggagacagccataaataagacagatggactttctactcagaaagagttggatgaagagtaagtccaaa

SEQ ID NO: 203522 - DNA, 1306 bp, Homo sapiens
aacccacagcaaatagcgggaagcagaaaagcaagagaggaggtctctaagtggatacactgttgctgagtctagacaccagaagaacgttgcaggcggcgactcacagttctagcactgcctaggagagcgtggtggccccagctcagaatctgcagaagtgcacagctccatccacaccactcagggtatggagcctccggaccagtgtagccagtatatgaccagcttgctcagccctgcagtcgacgacgagaaagaactacaggatatgaatgctatggtgctgtcgcttactgaagaggtcaaagaggaggaagaggatgcacagcctgagcctgagcaaggcacagcagcaggagaaaagttaaagtcggcaggagcccaaggcggagaagaaaaagatggcggcggagaagaaaaagatggcggcggcgccggagttcctggccacctatgggaaggagacctcgagggcaccagcggcagcgatggcaacgttgaggacagcgaccagagcgagaaggaacctgggcagcagtattcgcgcccacagggcgccgtcggggggctggagcctggcaacgcgcagcagcccaacgtccacgccttcaccccattgcagctgcaggagctggagcgcattttccaacgcgagcagttccccagtgagttcctgcgaaggaggctggcaagaagcatgaatgtgactgaactcgcagtgcagatttggtttgagaatagaagagccaaatggaggagacatcagagggcattaatggcaagaaacatgctgcccttcatggcagtgggccagcctgtcatggtaaccgcagctgaggccataacggcacccttgttcatcagcgggatgagagatgattacttctgggaccacagccattccagcagcctgtgtttccccatgccaccctttcctcctccgtccttgccccttccactcatgcttcttccacctatgccacccgctggccaggctgaatttggcccattcccttttgttatcgtgccttctttcacattccccaatgtctaagggatagcctctgtgccactttttgccagagtgtctttgagccagattcatattttgcatagcaccccatcaaaagtagttcatcaaatgtctattaaacgttttaaagaaaagtacatcattgacccatttttagggcacttgtaaaaatgtttctataaatatgtgaagggtatgtacatttgttttgtgtgtcacatggggtcagtaagttctcaataaaaattgttaagaaatgccattcaaacc

SEQ ID NO: 203523 - DNA, 412 bp, Homo sapiens
ggcatctcctttatttgtggcatgagagaaatgttcctaatgtgaggctcagctgggtgttacagaacagcctactgggtgtggggagttggtagaataaaaaaattaaacacaagaatgaaacgacacccacaactccaaatgctgaacacgtgtggtttcttccatagaaggaggctggcaagaagcatgaatgtgactgaactcgcagtgcaggtcagtaaaccgaaaaagcaatcgggcaggggagccattctaaaacccgcttcagggcttggacacactttgacccagacattgccatcttggtgtttttgtggcctttttcatgtataggcaatgaggtctgaactttgggatctttgtggctggaaaatgcagtaaggaaagctcagcttgtggaaatttccca

SEQ ID NO: 203524 - DNA, 569 bp, Homo sapiens
acagttctagcactgcctaggagagcgtggtggccccagctcagaatctgcagaagtgcacagctccatccacaccactcagggtatggagcctccggaccagtgtagccagtatatgaccagcttgctcagccctgcagtcgacgacgagaaagaactacagggtcagtaccttgatgggacacatgcttttgcgaactcaggaaaccaaggttctctgggagaggcgagtagactggatgatacccctgcactaccactgctctcagagtgtagcccctcaccacctccttccaacaccctcaggaccaatgccttgatctttctcttggggtttctacttttccagatatgaatgctatggtgctgtcgcttactgaagaggtcaaagaggaggaagaggatgcacagcctgagcctgagcaaggcacagcagcaggagaaaagttaaagtcggcaggagcccaaggcggagaagaaaaagatggcggcggagaagaaaaagatggcggcggcgccggagttcctggccacctatgggaaggagacctcgagggcaccagcggcag

SEQ ID NO: 203525 - DNA, 275 bp, Homo sapiens
aataatacatgtgaaacatcatacatacgctttccctgtctcagggaatgaaggatagctgtaaaaatattttgaactataaataattaatcataaatttcaactgatttgattttgcaattttaattattgagaacagtaagtaaaaaagagatagcttattcatgttaaagaatataatagacaaacctgtgctactctttcttcttctactaatcaatcacttactcaacaaaactgtaaaattcactaataatcttgccttttacatttgc

SEQ ID NO: 203526 - DNA, 316 bp, Homo sapiens
cacctgtccacgacgcaggatcccaaattacccactgcctttaatgacaaatgccgtcatgattcggttgtcgtctgagggtgggggtgggataaactcccttcaaagggggacctggatgaaaattacctctaacctgttaactattctaagagatcacagcatcagtgtgacagaaccaaacaagcaagtagctagaatacagcaggtgctccacacacatgagctgaagatggcggtatataggctgagcaagaggtggtgaggttgatcggggtttatcgattacagaacaggctcctctagagggatatga

SEQ ID NO: 203527 - DNA, 519 bp, Homo sapiens
caactaaaaagctttaataaaagccagctaaacctattggacatcgtttcttttgatgtttaagagatgatattgatgaatgagatataaaaatgagaatataattaatttcagtgactactttagacattcattcattccataaatatttatcaggctgcttttctgtgccaggcactgttctgcacactggagatacaacaatgagcaaatcagatttttaaaaagcaaaaaattggctgggcacagtggctcacacctgtaattccagcacttcaggaggctgaggcaggaagattgcttgagcccagaaattcaataccagcctgggcaagataatgagaccccatctctgcaaaaaatgaaaaataaactagccaggtgtggtggcatgcacctatgcccccagccactcaagaggctgaggtgggaggatcacttgagcccaggaggtcgaggctgcagtgagctgtgattgcactacactccagcctgggtgacataatgagaccctgtctc

SEQ ID NO: 203528 - DNA, 1008 bp, Homo sapiens
ggacctgtcctgcctactgccactccctgccttggtccttcaattctgcacgtcacttcacccccccaggcctgggggcaatctatgtcctgtccagctcacactggggctccctggacttgggggctgacatggattctctaagccttctgcctggttgagaggctgatgcagttcaacaggtggacaaccattttacaaaaacaggagacggaactaacacattcttccgtcctgttgaaggtgccaagtcactgttacaaaggcttcccacaagatgggcagtctccccatcaacctctgacagccacagcaaggctctcagtgcctgagcagggactccttggccccacctgggctgtgggatccagggaagccaagggcaacaagaagactgggaaggggacaaggaacacatggcgcccatgaagtaagagcatctgaccctgtaggaaaggcagaagacagacaaaggaaacagtgggacagcagacagacacctccttcccctgcaaagtatacactagttaaacacagagcaatcctgaacaacacacacgtatatactcacactcatacgcatgcacagttttcatcccctcctcctacttctgagtcttgctcaattgtctcagaaaacatctttctggccaggagcagtggctcacgcctataatcccagcactttgggaggccaaggagggaggctcacttgagtccatgggttcaaggctgcaatgatcgcaccactgcactgcagcctgggcaaaggggcaagaccctgtctctaaaagtaagaagaaaaaaagtctttcttctgcatttaattctgaacaaaagaacagtagttctcaagagcaatcagcgtccacacagctactgatctacttgtctcaagaatatggaaaaccacaaagtatggttttcagacacaagggccggaatcaccaagttgtagagcatgtgaaggagcccagagccctgctgagtctcacacgcattcccacc

SEQ ID NO: 203529 - DNA, 304 bp, Homo sapiens
cggtccccatgcacagttcggtccccatgcacagttcatggcttctgctctcttcacctgggcaaaggggcaagaccctgtctctaaaagtaagaagaaaaaaagtctttcttctgcatttaattctgaacaaaagaacagtagttctcaagagcaatcagcgtccacacagctactgatctacttgtctcaagaatatggaaaaccacaaagtatggttttcagacacaagggccggaatcaccaagttgtagagcatgtgaaggagcccagagccctgctgagtctcacacgcattcccacc

SEQ ID NO: 203530 - DNA, 919 bp, Homo sapiens
tctcaaaaaaaaaaaaaaaaaaaaaagaactataagtcagttattatctcccaacatagctcttttattttatttttaatttttttaaattatattttaagttctggaatacatgtgcagaacgtgcacttttgttacataggtatacacgtgccatgggggttagcccttttattaactgttctctgaaccgcaaccatctcctgatatttggtagagtaacacctttatatgtgtgcttgcctcctaatttaaaatactgtattcacatgtagatataatgtacataacagtttaacttcaaagttgctggggtcagggccccctgcacttgagacactaatacagagtgtgttcgcgcttagccatggactggactcaagaacctgataccagggttgatgtggattacctggaacccttcctgcagtattcctacagtgtttttattttgttgtcattgtgtgtgtggtttgtgtgtgtttttaaggagaatcttgttttaaaatgtaatttctaaagttgaacatgaatgttttatttgttgtacagtatatattatacaatagagaggtaacttaaacatttttgttcttattctttttctcataagtactcctgagtactagtggtcacttcccgtagtattcatttggcttcactgtcaaaaatcattattctgtgcagttgtggccctgggaaggggaaataataaggccctattgacgggctgtcctggctctggaattcatgcatcctgtccttgccaaggttctggcagggcccgctggtgtgttggagcctgcaggtcaggtcaggctggttcagaggtccatgctgaggggagggcactcctaagtggtgtaaagcctcaagtccatgaatcccaccccagtcatctctggtgtcacgtgctgct

SEQ ID NO: 203531 - DNA, 432 bp, Homo sapiens
aacatgttttagatatttcccaagcatatcgtttgaccgctagctagaggtgtgactgaattggattccataatccttgtctgaatcactgcttaataatattagtaggttctatttatgtaggtcttgctctagcccagagatatacattaactcatttaatcctcacaacaacttttaagttataggtagtattgtcctccctgttttacattattacataatgaaaagttaaagaggttaaaatcataccttaatagatggtagaccatagattgttgtccaggtctttctaacttcccagcccatattcataagcgttggactttattccttcttttctgtggccataaaaaaggctaaaaataaattaaaaagacttgatttaagtatggtattgaggtttgaataaggaaaaaaatgagtggaata

SEQ ID NO: 203532 - DNA, 639 bp, Homo sapiens
aggaactgtttcagttggccctccatatccatgagttgtgcatctgtggattcaacaactgtaaatcgaaaatatttggagggaaaaaaaggatggttgtgtctgtactgaacatgtgcaggcttttattcttgtcattatttcctaaacaatacaatataacaactgtttaccagcatttacactgcattagatattagaggtaagctagattatttaaaatatactagaggatatgtgtaggttatatgcaaacactacaccattttatatgagatttaagcatgcatggattttggtatccaaggggagtcctggaaccaatcccccacagatactgagggacaactatacttaatacagtatcttccagactgtaataatgattgatatgttcaatgccattcttacgctctcatctttctataaaactttttaaaaaattaaatatatccttattgtctcaagaaactgctttatccccatgttttctctcatttaatatgatgttgaattataaaaggcttatagagacatgtgatttgtagacagtgatacacaaattcaaagtggtaaaattttaggacagagaggcaatgctaagtggttattaaaacataaactcttatcaaatgaaaa

SEQ ID NO: 203533 - DNA, 203 bp, Homo sapiens
agggttcctagtggcaggacagtttaaagtcaggcagcgacgccattggcaccagttgtgtggtctgtacaaaagggactggaaggaaatggaataagtctcagtgctttcatctgcatgatgggcatattaacaggctctatcacacaggtctatggaaaggattgagatataaaaagatcatacatttatttttcttaatt

SEQ ID NO: 203534 - DNA, 328 bp, Homo sapiens
acacctgggctgagtcctaaatgacaagagctagctatgcaaagaactagggggaaggcctgtgtgtctccccaaactagaatgtcaggtcacaccattgttgtattcccagtgcctgaaacagtgcctggcacatagtagaggctcaattaaatgtgttgaatgacagtgttagggctcagaaactgataccccacaatatggtgtttggacacactgaattgaagaagcttccaggtctttctgatctctcccaaagtacaagatgaagtcaaagttccttgatttgcctaagatccagatctaccaaggagatcagctgttgttc

SEQ ID NO: 203535 - DNA, 126 bp, Homo sapiens
gaaaactcagttctatagacagatttaggcagggttaattattgaagaatatagctatttggtgtgaattgagttatctctatagacaaaggaagagagttgtgtgtgtgtgtgtgtgtgtgtgtg

SEQ ID NO: 203536 - DNA, 684 bp, Homo sapiens
ctacattccagcctgggtgatagagccagactttgtttcaaaaacaaagcaaaacattatgagatttttttaacagctcattagctattgttagtgtattttatgtgtggcctgagacagttctttttccagtgtggcccagggaagccaaaagattggacatctctgctttaggtaatagatgtttgccttgatgttgccagtagaatatttcagtagaacagttacagatcttccatctttttgctgaatagttagttgtattaaataactgaatgaaaaataatgttctgaaggaataactacaggtgggatgattagaaatgtctgttgtcttttctgtttgttggagtaaatgacaggaagtaacttgaagaacatttgactagttttcttataattgttagttttccaattttgttgattagtttccattaatatggccagcatttgcattatctggaagttttatacatattcctaatagaaagttttcatttgaacatttttgtattttagtattaatttgttcctctcttcaatatctttgatttcaagttactgtgctatgaaaaagcttaaggctgggcatggtggctcacactggtaatcccagcactttgggaggccgaggcgggtagatcacttgaggccaggagttggagatcagcctggccaacatga

SEQ ID NO: 203537 - DNA, 151 bp, Homo sapiens
aatactagtagtcataaataaatccctaaggatccctgtgaacacaaacatgttgccaaactttcagataatcacacttcagctaacccttaattaaaatttagattcagttgtcctttaattcaagcagccatactcattactgattctg

SEQ ID NO: 203538 - DNA, 511 bp, Homo sapiens
gatgagaaagtgatcccttctctccattcccactctttctttttcttcctctaagtacagagatggaaatgagccaggcactaggccccaagcttggagggctaatactgacctctttgacagagaagctggcttcaaatggattccatagaggttcaccagagcccctcacctggaactctctttccctcctgcaaacatttattgagcagctactatataaacgttttctgttacacattgagaatacaacagtgaagatggagcatgttgccctccttgaatttctagtctagtttatactgcagtgttatgatgatgtgagtaggaatgaacattcttggtgaactcatagaagggaacttgatgtagacttgtgaagtcaaggaaggctccctggaaggagtgacatttaagcagaaacttctggactaagatctggactaagtgtgggcaattggtgtgagaggaatagggaggaaggaagagagaaggaggaaaagcaggggat

SEQ ID NO: 203539 - DNA, 411 bp, Homo sapiens
gcgcttttcacaggtactcacaaagttccctttctttactttcggacagtttcatcgtgaaaggtgggaggggtgagggaggaggaaagcaggggttatggattcctatccatggctggtgatagagccaaggcatggggtggaggtcgtcggcctctgtctctagaccagctgtttggaaaagaagcggaggaataatggatgaagagcccttcgatgcaggcaaactttaggatgtattttttttcaattttcaagtttttagttaaagctcctctcactgtgaaggcagaaaaattaaacaaatgccaagctcacaactctatgtcttctcataggaatgggtatctccaatcacggttccttggcagcccagtgtagaaaatgtgaagaggagataaataaaaggaa

SEQ ID NO: 203540 - DNA, 242 bp, Homo sapiens
aggaccggccccggctgagcccccatcagctactctaagttaaacactcaggactccagccactcctaaagctgccgcctctgcccagcaagaggacaagagcagagcttcaagaacttccctttgaagaggctctcttcactagtcccgggacacagtcaggaaagggaaggcaaaccttttcccctctctataaaaggtttgcttactgttaaaatattaaacatcacacatatcattga

SEQ ID NO: 203541 - DNA, 401 bp, Homo sapiens
taagtaggagtgcgagtattctacacacccacccagaacacaactccagtgcgtaggctggagcaagtgctgacggggaaggccttgggccctgatagggctgcaggaggcaggagccatggccgtagcacccagctggatgcccagcgacaggaggtctcagcactggctaacctgagcctcacacacgggggtgttatctcatcatgcttgccctcagatgcatctgcttcctcctcttgcttcacagtcacagaacagcacttttctggtccatgatccacaactctcagtatcttcaaatgccagttccagcccacccactgtcctctagttaggcagacccatccatgtaccacctcgtccctctgtgcctggccctgcatatacactggctaact

SEQ ID NO: 203542 - DNA, 756 bp, Homo sapiens
gaatgctccgacagagctaccaaggaggaggaatggcacaacatgatgacaagattaattagcatctgcaagactggacatggctccccaagggattcttcccatgctctgccatggctgcctctggtaccctccccctgccttgagatgtcacctctgatgtgtctgggtccccagctggcttacaagctcttgtgacatcagtggcacattttgtggcactgcatttagaaaactgtaaagctggtatatgcactagagatctgtccttcattttcttcattttgtatttaatgctgtcctaactccacaaaatagagacctggaaatgtcaacaattggatatagtataagaattttaaaagtagattttaaaagcacaaaggcaaatttaagttcaatattatggataatgcagtattctgtatttagtagcaatgagatctttcagacctttctttattttgaaatatattatcttctaaggagtgtaagaaagatagcctctgtctaaaccaggggcatgaaaattacatcctctaggaatttgaggaaacattgcagagggcatttgactgcctggagtctgtcggaaagataaggctttatatgcttcagtaatatcctagagcaaaataacagccactgttgagcactgatttatgtaacaccccagtgtaccgggcactattgtatatgataccccagcgaaatagatattattaccatcttcgttcccaggattataaagttgag

SEQ ID NO: 203543 - DNA, 344 bp, Homo sapiens
gccaatgttatactcaatggtaaaactaaaagaactttcattaaagtgaggaaacaagacaaggatgtcagctgtcaccactataatgcaacgttgttctgagaactctagccaatgtaatgtaataagaaaaacaaaacatagcttttggaaatgaaataaaattgtcattatttgcaagatattactgatctacaaaatctaagagaaccacctaaagagttattaaaaccagtggaattcagtacagcgacccctataacacgacagattccacatgcaaaaattaacagcatttgtatcaaacaacactttagaaaatctaacagagaatggctgggtgc

SEQ ID NO: 203544 - DNA, 537 bp, Homo sapiens
acatgtgttcactttatgaaaatgcactgaactaggccgggcacggtggctcacgcctgtaatcccagcactttgagaggccgaggcaggtagatcacctaaggtcaggagtttgagcccagcctggccaacatggtgaaaccccgtctctactaaaaacgtacaaaaattagctgggcgtggtggtgcgccagctactcgggaggctgaagcaggagaatcgcttgaacccaggagatggaggttccagtgagccgagatcgcgccattgcattccagcctgggcgacaagagcaaaactccatctcaaaaaaaaaagaaaaaagaaaagaaaatgcactaaactgtactaataatgtctgcctttttcagtctgttagactccaataacaatttttagaaagaactattaaaaagggggacggaaggaaggtgaagaaatataagtgagctcaaattcaacagtgtcaagtgccgataaatctggaagtcacagaataagctcattatttgtaagaactaaaacattgtctttgc

SEQ ID NO: 203545 - DNA, 861 bp, Homo sapiens
tgcccttctcaaatagtggtgagctccacgaggactgctgggatgcataccatgtattcctgactcaggccggcagtgtcctggcacccatggagacccatcgaaccctaacccacctctgagcacacctccacacagcttgagcattgctcccccactacaaactgtttctctgactctgacatcctggccagcctcctgctgaagatgaacattctcctctgtgctgggaagcagttcacctagtcgactggtctgccttcagaccaggtcctgtgtgtcaacctcaaccacagcagctctcattagttgcttagcaatgagacaacctcctatgaaatcataactggaaacaaagtgtcagaggggttgcaatacaattcactacatgcatatgtcctcatcctcgggggatgatctgtcctcgggtaaagctcatctctccagattacagcaaggatgggaatctgaagcccaccacatccttctttccaagtcaaagaacgtaacactgagagggctctgagtgccagcatgtgcagagttggaacctcccactgacagccagaacgatgagccactcccgaagagctgctcctactcaggaccaatgccacactccaggattccccacctcccgtgaaaccagtgggagcatatggcaggccaggatctgtggatctttacaggctctggacacatggcgaacacacatccccagaaagagcccagctcccactcaggcatcacagatctgtctgctgttgcctgaaagcccctggagaaatcccacaccccggggatttcttaaacctttgattaactgggatgctatcctgtacttcaaagaaaagaggaata

SEQ ID NO: 203546 - DNA, 2197 bp, Homo sapiens
  misc_feature (2019)..(2020): n is a, c, g, or t
  misc_feature (2024)..(2026): n is a, c, g, or t
  misc_feature (2035)..(2035): n is a, c, g, or t
  misc_feature (2038)..(2038): n is a, c, g, or t
  misc_feature (2041)..(2041): n is a, c, g, or t
  misc_feature (2044)..(2044): n is a, c, g, or t
gctcatctttcacaaaggccttcacaacctacgaaactacagttcagatttgggaaagcagccgaaaaaggtgcctaaacgtcgccaggccgcccgagagctgtccattcagcgccgttctgccctcaatgtgaggctcttcctcagagacttctgctctgagttcctggagaactgttacaaccggctcatgggatcagtaaaggatcacctgcttcgggagaaagctcagcagcatgatgagacctattatatgtgggccttggctttcttcatggccttcaaccgagctgcctccttccggccaggcctggtttctgagaccctcagtgtccgtaccttccacttcattgagcagaacctcaccaactactatgagatgatgctgactgaccgcaaggaagctgcctcctgggcacgccggatgcacttggctctgaaggcctatcaggagctgctggcaacagtgaatgagatggacttatctccagatgaggctgtgagggagagcagccgcatcatcaagaacaatattttctatgtgatggagtaccgagaactattcctggcactttttcgaaagtttgatgagagatgccagccccgctctttccttcgtgacctggtggagaccacccacctcttcctcaaaatgttggagcgattctgtcggagccgtgggaacctggtggtgcagaacaaacaaaagaaaagaaggaagaagaagaagaaggtcctagaccaggccattgtttctggtaatgtcccatctagcccagaagaagtggaggctgtgtggccagccctggctgagcagctacagtgctgtgcccagaattctgagctcagcatggactccgtggttccctttgatgcggcctcagaggtgccagtggaggagcagcgggcagaagctatggtacggatccaagactgtctcctggctggccaggccccacaggccctgactctcctgaggtctgctcgggaggtgtggcctgaaggagatgtgtttggctctcaagacatttctccagaggaagagatccagttgctgaaacaaatcctctctgctccacttccccggcagcagggcccagaggaacgtggggcagaggaagaagaagaggaggaggaggaggaagaggaggagttgcaagtggtccaggtgtcggagaaagaatttaattttctggactacctgaaacgctttgcatgttcaactgtcgttcgagcctatgtgctgctactaaggagctaccagcagaatagtgcccacactaaccattgcattgtgaagatgctgcaccggctggcccatgacctcaaaatggaagccctactttttcagctgtcagtcttctgcctcttcaatcgtctgcttagtgaccctgctgctggagcctacaaagagctagtgacttttgccaaatacatcctgggcaaattttttgcactggctgcagtcaaccaaaaagcctttgtggagctgttgttctggaagaacacagctgtggttcgagagatgactgagggctatggctccctggatgacaggtcttccagtcgcagagcacctacatggagccccgaagaagaggctcatcttcaggagctgtacctcgccaataaggacgtggaagggcaggatgtggtggaagccatcttggcccacctgaatactgttcctcgaacacgcaagcagatcatccaccatctggtacagatgggactggctgacagtgtcaaggacttccaaaggaaaggaacccatattgtactgtggacgggggatcaggagttggagctgcagcggctttttgaggaattccgggactcagatgatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttgccaatgggcggagccctgaagatttgccggannctgnnnagaggaacngcnganaanggaaagaaaaaggggccaacaaacgccggtgtttccttaggaaccttgacgctcaaaggttttccccttggtcaagctccctatcgagaagtccccctgcccaagtggaaactggcagccccgtgaacaaacccgttagaaacttttgataca

SEQ ID NO: 203547 - DNA, 1289 bp, Homo sapiens
gctaggtacgaggctgggtgttaatcggccgaggctgaggtctgctcggaggtgtggcctgaaggagatgtgtttggctctcaagacatttctccagaggaagagatccagttgctgaaacaaatcctctctgctccacttccccggcagcagggcccagaggaacgtggggcagaggaagaagaagaggaggaggaggaggaagaggaggagttgcaagtggtccaggtgtcggagaaagaatttaattttctggactacctgaaacgctttgcatgttcaactgtcgttcgagcctatgtgctgctactaaggagctaccagcagaatagtgcccacactaaccattgcattgtgaagatgctgcaccggctggcccatgacctcaaaatggaagccctactttttcagctgtcagtcttctgcctcttcaatcgtctgcttagtgaccctgctgctggagcctacaaagagctagtgacttttgccaaatacatcctgggcaaattttttgcactggctgcagtcaaccaaaaagcctttgtggagctgttgttctggaagaacacagctgtggttcgagagatgactgagggctatggctccctggatgacaggtcttccagtcgcagagcacctacatggagccccgaagaagaggctcatcttcaggagctgtacctcgccaataaggacgtggaagggcaggatgtggtggaagccatcttggcccacctgaatactgttcctcgaacacgcaagcagatcatccaccatctggtacagatgggactggctgacagtgtcaaggacttccaaaggaaaggaacccatattgtactgtggacgggggatcaggagttggagctgcagcggctttttgaggaattccgggactcagatgatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttgccaaatggagcggagtccctgaaagatttttgccaggaagatctggaagaagaggaaaacctgcctgaggaagacagcgaagaggaagaagaagggggctcagaagcagaacaagtccagggtagcttagtcctttcaaatgaaaaccttggtcaaagcctgcatcaggaaggcttttctatcccgctcctatggctcagaactgcctgatccgagcagctgatgatcggcaagaggatggt

SEQ ID NO: 203548 - DNA, 2229 bp, Homo sapiens
gctcatctttcacaaaggccttcacaacctacgaaactacagttcagatttgggaaagcagccgaaaaaggtgcctaaacgtcgccaggccgcccgagagctgtccattcagcgccgttctgccctcaatgtgaggctcttcctcagagacttctgctctgagttcctggagaactgttacaaccggctcatgggatcagtaaaggatcacctgcttcgggagaaagctcagcagcatgatgagacctattatatgtgggccttggctttcttcatggccttcaaccgagctgcctccttccggccaggcctggtttctgagaccctcagtgtccgtaccttccacttcattgagcagaacctcaccaactactatgagatgatgctgactgaccgcaaggaagctgcctcctgggcacgccggatgcacttggctctgaaggcctatcaggagctgctggcaacagtgaatgagatggacttatctccagatgaggctgtgagggagagcagccgcatcatcaagaacaatattttctatgtgatggagtaccgagaactattcctggcactttttcgaaagtttgatgagagatgccagccccgctctttccttcgtgacctggtggagaccacccacctcttcctcaaaatgttggagcgattctgtcggagccgtgggaacctggtggtgcagaacaaacaaaagaaaagaaggaagaagaagaagaaggtcctagaccaggccattgtttctggtaatgtcccatctagcccagaagaagtggaggctgtgtggccagccctggctgagcagctacagtgctgtgcccagaattctgagctcagcatggactccgtggttccctttgatgcggcctcagaggtgccagtggaggagcagcgggcagaagctatggtacggatccaagactgtctcctggctggccaggccccacaggccctgactctcctgaggtctgctcgggaggtgtggcctgaaggagatgtgtttggctctcaagacatttctccagaggaagagatccagttgctgaaacaaatcctctctgctccacttccccggcagcagggcccagaggaacgtggggcagaggaagaagaagaggaggaggaggaggaagaggaggagttgcaagtggtccaggtgtcggagaaagaatttaattttctggactacctgaaacgctttgcatgttcaactgtcgttcgagcctatgtgctgctactaaggagctaccagcagaatagtgcccacactaaccattgcattgtgaagatgctgcaccggctggcccatgacctcaaaatggaagccctactttttcagctgtcagtcttctgcctcttcaatcgtctgcttagtgaccctgctgctggagcctacaaagagctagtgacttttgccaaatacatcctgggcaaattttttgcactggctgcagtcaaccaaaaagcctttgtggagctgttgttctggaagaacacagctgtggttcgagagatgactgagggctatggctccctggatgacaggtcttccagtcgcagagcacctacatggagccccgaagaagaggctcatcttcaggagctgtacctcgccaataaggacgtggaagggcaggatgtggtggaagccatcttggcccacctgaatactgttcctcgaacacgcaagcagatcatccaccatctggtacagatgggactggctgacagtgtcaaggacttccaaaggaaaggaacccatattgtactgtggacgggggatcaggagttggagctgcagcggctttttgaggaattccgggactcagatgatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttgccaaatggagcggagtccctgaaagatttttgccaggaagatctggaagaagaggaaaacctgcctgaggaagacagcgaagaggaagaagaagggggctcagaagcagaacaagtccagggtagcttagtcctttcaaatgaaaaccttggtcaaagcctgcatcaggaaggcttttctatcccgctcctatggctcagaactgcctgatccgagcagctgatgatcggcaagaggatggt

SEQ ID NO: 203549 - DNA, 375 bp, Homo sapiens
accaggtaggggtaaaggagggcaatctagatcaaataataagaaggtaatagctactaagaagaattttatggagaaagggacgcgggcgggggatatagggtcgaagccgcactcgtaaggggtggatttttctatgtagccgttgagttgtggtagtcaaaatgtaatgttaggtctacctggccaggtagacctaacaaactgaaattattttaaagttctgatatttagagtgtgctgcctctctacaactaagacctttttgactttaactttatatctgtttaaagaatcaatatcccttcagaggttctacgattacagattgaaattactttttaaaaagttaacgtcccaggttctattaagact

SEQ ID NO: 203550 - DNA, 7222 bp, Homo sapiens
  misc_feature (749)..(749): n is a, c, g, or t
  misc_feature (771)..(772): n is a, c, g, or t
  misc_feature (920)..(920): n is a, c, g, or t
  misc_feature (931)..(931): n is a, c, g, or t
  misc_feature (988)..(988): n is a, c, g, or t
  misc_feature (1494)..(1494): n is a, c, g, or t
  misc_feature (1587)..(1587): n is a, c, g, or t
  misc_feature (2137)..(2138): n is a, c, g, or t
  misc_feature (2140)..(2140): n is a, c, g, or t
  misc_feature (2166)..(2166): n is a, c, g, or t
  misc_feature (2194)..(2194): n is a, c, g, or t
  misc_feature (2198)..(2198): n is a, c, g, or t
  misc_feature (2218)..(2218): n is a, c, g, or t
  misc_feature (2277)..(2278): n is a, c, g, or t
  misc_feature (2413)..(2413): n is a, c, g, or t
  misc_feature (2620)..(2620): n is a, c, g, or t
  misc_feature (3255)..(3255): n is a, c, g, or t
  misc_feature (3312)..(3312): n is a, c, g, or t
  misc_feature (3361)..(3361): n is a, c, g, or t
  misc_feature (3477)..(3477): n is a, c, g, or t
  misc_feature (3556)..(3556): n is a, c, g, or t
  misc_feature (3582)..(3582): n is a, c, g, or t
  misc_feature (3606)..(3606): n is a, c, g, or t
  misc_feature (3610)..(3611): n is a, c, g, or t
  misc_feature (3617)..(3617): n is a, c, g, or t
  misc_feature (3661)..(3661): n is a, c, g, or t
  misc_feature (3676)..(3676): n is a, c, g, or t
  misc_feature (3764)..(3764): n is a, c, g, or t
  misc_feature (3771)..(3771): n is a, c, g, or t
  misc_feature (3777)..(3777): n is a, c, g, or t
  misc_feature (3904)..(3904): n is a, c, g, or t
  misc_feature (3910)..(3910): n is a, c, g, or t
  misc_feature (4663)..(4663): n is a, c, g, or t
  misc_feature (5168)..(5168): n is a, c, g, or t
  misc_feature (6215)..(6215): n is a, c, g, or t
  misc_feature (6217)..(6217): n is a, c, g, or t
  misc_feature (6377)..(6377): n is a, c, g, or t
  misc_feature (6701)..(6701): n is a, c, g, or t
  misc_feature (6726)..(6726): n is a, c, g, or t
  misc_feature (6731)..(6731): n is a, c, g, or t
  misc_feature (6735)..(6735): n is a, c, g, or t
  misc_feature (6760)..(6760): n is a, c, g, or t
  misc_feature (6767)..(6767): n is a, c, g, or t
  misc_feature (6777)..(6777): n is a, c, g, or t
  misc_feature (6789)..(6789): n is a, c, g, or t
  misc_feature (6800)..(6800): n is a, c, g, or t
  misc_feature (6822)..(6822): n is a, c, g, or t
  misc_feature (6834)..(6834): n is a, c, g, or t
  misc_feature (6864)..(6865): n is a, c, g, or t
  misc_feature (6867)..(6867): n is a, c, g, or t
  misc_feature (6874)..(6874): n is a, c, g, or t
  misc_feature (6891)..(6891): n is a, c, g, or t
tgttggcacaagattacaacctacaatttcaatgcccttccctcctacacagctcaaatggaaggaaactgattaacacatagaaaggaacggcaggctcacaggtttaagcatttgtttttacaaaaaggagtgggatatgggggtggtcaagttttacgggtaataacaacattctctctagatggcagggggtaagtctgcctgtcctccattgctggtaccacataagggatacattagtaaagtaaggtaagggttatatgtgtggctggcctgttctttagagaggaaggtgggatggtatctgctgtgtacctgtctcagaccaaacctggggctggaccagtgcccctttcttctcagccctcctccacagcctgactgtactgccagccgcacccatgagaaggaagtgttgaaggaagcctgaagacatccacctcgagaaaaggaaacaggaaaactattccttccgccttctctggaccaaattcactccctcagctccagagagtgctgcaaaaatcttccttagggacgctgtgaagacacggggaagaggccagccctgagcgggcaagaagaaagcttgaactttccatgcagtaccaagcaaggctattttggaaacaagcaaacaaacaaaaaatggaaaccaacaccatataaccacaggttgggtagctcctaaatcctggacagcatttggattgggggtaagggcaattttactccagctccttgtnttataacccgcacaaggtgccnngaggttaaggaccacaactgacctctctttccctacaagcaccattccttggattcccagttttgttgagctcatttgaggtcatccttgccatcctcttaaaaaatgacacagcctcttggttattccattttctatccctttctanaattatgaacncactctctaaacaggagatctatatatgctctcatcctgcaacccaagagattaggngacctaatgatgagaaggctaacttatttgctttcctgggtggtcctgatggaaatgaacagcagcagagttctggtgggatagagcagtctagtctgagccactgtgtgattccccaggggactggtccctgggtacatgggtccctggctctctgtctcagttccacagatattactcaacttggccatttacgcctcagctaaaacatatgagcatgagggaaaagggacaagaaatacttttgtcctctagaaaaacttaactcaatacatcttggctactttgcctcaacccacggggttccctggaaacatttgttgaacttggccaagaggagattgtatatggatggcacacctggaaaaggggagaaagcacactagttcatctcttttataagtagaatggtcccagggatgttaacctttctgatgctgatagtagatgagtggagtggggtaatcgtgaaaacttaaaaacccttaagctgtttggagactacncaccacagtggagcaaaccaaggtggggcctcactgccctcctcagagcccatccctgaccatgtcattggataggatggaagacaaagtctntgaaatggaggctgggctggcaaaagtaagtatgaagatgctactactggccttccacttcctctctctgatacacctaagaaggtgagagacactagcttcaattccattttacaacagttctcaacaacctgaaatattcttgacttccttaagcacatggaaaactggtaagctatatctttctaactgaaattttacttattctaaccaaccttttctttgattatcaaccagtttgacagtcttcagatcacaaaacaatagaacagacctgacatttacaaaactgtactacatacttatttcttttacagtagagctgaccaattacttttctaactactaatgcaacaccatgccactgggccctggactctgatgtttctgatccctgagcaacacatctatgtccattcacagatggaaatgaaagagtgagattctcagaggctaaacaacattctgggaagcaaattggatttttgaagggagagtcctccttagaaaattctggagccaaacatgctcccagtcacgagggaatggnntnagccgggccaggtttcctgtctgtgngctatagctcccttcctgaactccctcntgtnctttgggaaggacacaagcntcttgctcattaagcaaaggccctccaagtctcctttttacttcagcactttggaaacnntccaagacttaacttccgatctggggaggttctacgtggagcagacctatcccttcttattcctgttcctgggtgtctccataatcagcctctaccttccctggcataagtcatatctgttatgctgcaggaacngagtaaccaaagctagatatcccttggaccactgattagtgacacattttctccacaacaaagggaggttaaagacaaaggtttaaccctgagaaactttttttttggcaagataataaagaggttaaagaggctacgtggatctgtcactgctttagcttaccattttcaattcagcaccaaagtgctcagaaagacaggctcagntcaggacgacttcttaaagggatacacaggcaatattactggcaaaatgattttccaaagctgagccacgcgccccaccctacagggaggggagtagaatcttatggcccagcattggcattgaggcatcttgctttttttcctcagaattccacaaaggcttaagagtgatctaaatgcctggctggaagctcaagtctaggagagctattttactgcactgttgagatgttctctgcaaggtagtcacagataataagcaatttagtagataattattctatacaagaattaatgttctctgaaacagtgattaatagaatcttcacatctggcctggctgggaggcttgggggcaggaaagggagggtggaaggatgggtagcacatcaaaatggtgatgaactggcaaaacgacaatgctgctgtttttgtatcctttaaagcctatatcccagggttttaaacgacgccgggggtgtgcttcacatctggcctggctgggaagcttgggggcaggaaagggaaggtggaaggatgggtagcacatcaaaatggtgatgaacctggcaaaacgacaatgctgctgttttgtatccctttaaagcctataacagtttaatgacgcttttttngtgtgcttcctgataggaagtcaaataagttttagtattaagaactggggatataanccaaaggaaacctagagtcaactgactgctggaggaacagaagcaatgnctttctttccacccttcttagatagtaatcttacttttgttggctaaaagcactttcttcagcattctgagttaacacgggttccctataagctcccctccccaggtggacagtcntattttctaagacaagctcaaagctcaaactcaccaaattaccactataaacaaagcttcagggaagagacataacctnacttcaaaagcttcaggtcagagacngccaaaatcatgtgactgctagcntcanntcaagnagtgtgcccaaatcattcacaaaatgggattccctttccttttnttttttttttttttngagacggagtcttgtctgtcgctaggctgcagtgcagtggcgggatctcggctcactgcaacatccacctcctgggttcaagcgattntcctgcntcagcntcccgagtagctgggactacaggagcgtgccactacacctggctaatttttgtatttttagtagagatggggtttcaccatattggtcaggctggtcttgaactcctgaccttgtgatccacccgcntcggcntcccaaagtgctgggattacaggcgtgagccaccatgaccagccctccatttattaatttataaggggactagaaggacaaactatttgattaatttgaaggtgagaggtatcattttctcagatgctccaactaggcttctcacatccctcaaaggttatcagctaaagacaagagtttctgaggctaatgcaaaaacatggtcaaatgtgaaaccgcccttttagaggcagggtttgtgaaaggctgctggcctccaaaggagagtatgcctaaactctctgggctcccaggacctgtggtgacctcaagctaacctgatgcacagacaacagtatcttttagggactgcagccaatgttccccaatttactttttttttataccttaaaatatcaaatgtttcatttttaggtgatatcccaagtgacacagaaacacagctcctccggatggtgaagtctccgctgcaaaactcacgaaacagcacagaggatgactctagggtgctctcccacttgctccaagttaggcaggtgccctgatggaggcaaggctgagccattaacatgcacagctccatatcctggaagcctctgtagccttgaggagataggctctatccaacaggactcagaataaatgactgccacctcaactgagcagtatgaactgcccacctcaactgggcagtctgacctcttccacagtctttaagaaacagaagagccatttgcattatttaatcaccantcaataatctcctccctccccatagctgcttgagttaactgtcccacaagtgtcctgtgttttgtaaagatgagggttattttctgaaatgcagatgggactaggatgaagctgtattatcaattacagagacagccaactctcatttctcttaaagcaaaaattcattccactgtgatttctccaggtatttcctgcaattctaaatccgcccttgatattagagaatattaaaatcacacagttgtggcaaaaatcacattgtggctattaaatcctttttgtgaactaaaaaaagtgaatgtggcttaggctaagctgtttttttttttttttttttaaagatgaggatgcggactccaacaaaggcattaagaaagtactagatgaaaatgagaaatatgtgaaggataacatgtgaaatgtacactcaggtctaacaaatacctattatttctctggttaagaaggtttagcaggagcctccaatgagcactgtatgtanagaaaagggaaggagcaggaggaggaacagatctgcacagaatttttttcttaaaaaccacaaagggtgacttttttcttctaagcaagcaagcctgagaggcattacatgggctggctcctaatatcaaaacaaaatatttctttgccacaaaggaacttgactatgtagcaacacatttacaaaactactgcaaaacactcccagagggcagtgacctactctgctccccagaggctccaagaagcaaggcctcaagtgcctcatgttccatggggctgtgcagtgcaatgcagaaggcggaaatcctgctgtgacgccaccctcgagaccttctgcagcctgagagggggtgatactcccacaccctttgatccttccagatggctcagcctagatctagcagtgagagagccctctccatgcagggcagatggagtggtggacacttgtgaaaacaaaacactaactgttccatcctgttatatttgctgtgaggaaaattaagattcctgttgtatgggctgcactgtttctggaagactacagaaaatctaacatggttgacacttcctggtagcccttctgtacatacacacacacacacccagagagaagacagagagaaaatcctggtccaaagatcacatgaccttactagtgtttccccaatgactgtaatttataaactaaaaatttttacaaatccactgctatcttcttctgtcctgagtttggtagactttaatggatgctccagcaataaccagaatctaggacatgcagactcactgtgagcgagaggctagggatctgccctaaacataggaacctgtttctatcaagcctgaatgaggtcagctctggtagaattaatgacaaatcaatgtcagtgaaatattctgcaaacagggtagcttttgtgctttcttttgattattttctttggggagataaaggtattgcaaccatgggtctaactaatctatcactaaaggactgtgacgacattcctcagtaaagacagtcatggtgtttactgtgccnanggagggaaaatcccagatcatcagaatcccagtgcaacagaaaacagcaccagtttcaacaattctgatgttggacaaagcctctttttgtcagttaagaaagcgtaagcacaatctctcagtcaattgcattaacaggatccattcatgtcactgaaanatacttcttggcacagttcactttccgtgacccaaagacaccaacaacaatcaaaactgcactttcagggtagtatattgttacactagcccagtcaaaacatactcagaacatttaaaaatgtataaattactgttagcactgcagttccgttttattgtcttatttatttattgagacagagtcttactctgttgcccaggctggagtgcagtggcatgatcttggcttactgcaacttctgcctctcaggtttaagcaattctcatgcttcagcctaccaagtagctgggattacaggagtgcaccatcatgcccagctantttttgtattttagtagagatgggnttttnccangttggtcaggctggtctcaaactcntggcctnaagtgacccncctgccttggcntcccaaagtgntgggattacaggtgtgagccantacacccagccntgcagtccctttttaaagagtactgactgnntncctgcanagtactttcaaatccanaccataaaggtagaatttatctggaagaatgtgttttttgaattccacctggcacttggttaaatccactttattttgccctttatttatttgaacagaactttagaatgctctaggtcaggaaaagaaacagtgtgttcgtttttaagaaggatgtgtgaatagtaagttggcattcagactcaagtcccatggtattgttcttatccaatgggacctctccttgggaatataattcctttaccagaggtatcatggtatcccaagaatataactgctcccttggctctgtgtgtgaagattgggggagaggatgtaaactaagagtata

SEQ ID NO: 203551 - DNA, 156 bp, Homo sapiens
ttttgaaagttactaacttgctatatttactttggtttctgtttgaggtatacatatgttttaagaaactatcaatggacatcttcaaacaaaaataatagaataaatgacccacccactaggtgcccattttccaacttcagtgattatcagaga

SEQ ID NO: 203552 - DNA, 577 bp, Homo sapiens
taccttggaatgttgatagaatatgaaattgttgtaatgctgaaatacaaatcacctatttattaataagttatattctaaaaatatttacaaagctttttagagcaaggaaaactaaaggtagcttccagaaacctaggtgagagaggattgtggggaggtctcaggcattgccattagctactaattgatacttggggccagtagcaaggtaactccagcttaaatgatgaagtttacattctaggattggaggaaattgcttgtttcccaatgtaaaatttgctaattttaggttgtcttccttgatatgatattgagataaaagctgtgctacttgtggcttattaaagtgaattgtaccatatagtggctatatagttagggttaggttgcaggttgtgttttatttcaatgaatgataaaataataatttgccatgtcttctaataagagtgaaaaagtgaaaatgaatctgtatgcaacattatttttatttcttaatacattttgggaaacttaattgcaactgtgtggttcagggatttagtgcaagaagaagaacagttgatggaag

SEQ ID NO: 203553 - DNA, 431 bp, Homo sapiens
tcagagggagtgtggccccaccaagaccttgatttcagacttccagcctccagaaccgcaagtggatgaatttctgttgtaaaccacccagttggtagtggtttgttgcggcagtcacgggaaaccattataccatagccctgttacatgcggaatctctcagcagcgcccattggtgcttgacacccagagatgggggagtggggtccactggccatgatgggcacactggttcatacctgttgacaccccaggccattcagaaatgtctccagccttaattcattgagttcaacctttaagaggccttaggccaactcagtcacctcactgctcagacaaagaatcagaggcgtcagcatagccagaggacacctgtaatcatgtgtttgatggtgatgctcaaagattaatggggagcttgatgaaga

SEQ ID NO: 203554 - DNA, 455 bp, Homo sapiens
tcagagggagtgtggccccaccaagaccttgatttcagacttccagcctccagaaccgcaagtggatgaatttctgttgtaaaccacccagttggtagtggtttgttgcggcagtcacgggaaaccattataccatagccctgttacatgcggaatctctcagcagcgcccattggtgcttgacacccagagatgggggagtggggtccactggccatgatgggcacactggttcatacctgttgacaccccaggccattcagaaatgtctccagccttaattcattgagttcaacctttaagaggccttaggccaactcagtcacctcactgctcagacaaagaatcagaggcgtcagcatagccagaggacactgtgcacctggcagccccctggggccactcatggcccctccagggacttggcagagttaacgcaccctcccccagatgca

SEQ ID NO: 203555 - DNA, 469 bp, Homo sapiens
tttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcaagacattagccctttagttatgagcctgtgggaacttcaggggttcccagtggggagagcagtggcagtgggaggcatctgggggccaaaggtcagtggcagggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagttattttcc

SEQ ID NO: 203556 - DNA, 1006 bp, Homo sapiens
tttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcaagacattagccctttagttatgagcctgtgggaacttcaggggttcccagtggggagagcagtggcagtgggaggcatctgggggccaaaggtcagtggcagggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagttattttccaaaaaaaaaaaaaaaaaaaaaaaaaaaaaaaaaacaataagcaaaaaaaataaaaaaaaaaaaaaaagagggggggggggcccacaaaaattctccccgcgggggggccccaatttggccccccccgtttttttaaaaaggggggccccacaaataggggcacgattattaaaacgcagagcgcgaggggcgcgcgagtatataaaaaacccgcggtgcagctaatggtagcgaagcaacacctcgttccgacgagcgaggggtctcatagtatgaggagaaggagcaccccacacaatccacgtgaggggggggggggggacaaccaataatgcggcggacacgcaacaccaacgcaagaagaatatttctacgcccccagcggaggcaaaatatccaaacagcttgacggaagttcattctatgtgtgttacacaccacacggccgcgattaattcggcagcgggcatcaaaaaaaatcgcttctgtcccaaccagcagtaatgtatattagtaaaagcaaaattttatagcacg

SEQ ID NO: 203557 - DNA, 818 bp, Homo sapiens
tttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcaagacattagccctttagttatgagcctgtgggaacttcaggggttcccagtggggagagcagtggcagtgggaggcatctgggggccaaaggtcagtggcagggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagttattttcccaaaacacttgattcatatggaattaatgttggttctcaaagtgaaaaattacaaacagcactgatattcagccagtatacaagtctggtcacagcagttgtataatactgaaataccccctgccactgacctttggcccccagatgcctcccactgccactgctctccccactgggaacccctgaagttcccacaggctcataactaaagggctaatgtcttgcacagcagcgagcacccaggaccgagcagccacatggccgggtctgctggtgaaagcatccattctgactgatcaggacctgaggggcctcatggttacatattttgataatatcccgtcgacgc

SEQ ID NO: 203558 - DNA, 426 bp, Homo sapiens
gtattccataatgttgatgtactgtagtatgtttagtcattaccttgttgaacatttgccctgtttgctgtttatttgcattataaatagggatactatgtatttctttgttcaaatttctcccccatttacattcctgaacataaataccccaaagtaaaattactaggtcaatggataacaactagacttttgttaaatatttctgagtagcttcctgaaagtattggaacaaagtcatgtacggatgtcgctttgttatttttttcttttatttttctcctgtttgatgtgtttccccctagtagataactatcttgatctctatttcttctccttgttacttctgcagagttttaagccttttcattcagtgttggccattcttctagtatgtgtgtgtctctgcccagattgttaaaaaaa

SEQ ID NO: 203559 - DNA, 448 bp, Homo sapiens
atttccttgcctttgacagatcttccaagggccccgcggctctaggcaggccagaatttgcgagtgtattagatgcctcttgtgaaaagctgcatgggccaggaggggaaactgacatgtggccccagcaagaagaagaggcagtgttgagagccggcaggggttttctaggaagtcttcctggcctgggtagctgggccgaggacttcctcagctggcatgctgacccggctgggcaggtggggaagcatggagccccttgcctagcatctctccaccaacttgagggaacaacacaaacgcttttggaataacgagtggaagttgagtttggtagatgattttgtatgcctcccacgtgccaagccgttcgccgtcaggcactctgctgtgtagtgcagactgcatctgttgtaatggtttcaactgtgggcagccgtgagagatg

SEQ ID NO: 203560 - DNA, 415 bp, Homo sapiens
aatgtaggtacatcattcagtaagaaaacttctctgttgctttctgttttgcaagtagtattgatagcgtagcattctcctacaggtagcctccatgaataaatgtttaaaataaggaggctgggtgtagtgcctcacgcttgtaatcccagcactttgggaggccgaagtgggtggatcacctgaggtcaggagttcaagaccagcctgaacaacgtggtgaaaccccatctctactaaaaatacaaaaagtagccaggcgtggtggcatgcgcctgtaatcccaggtacttgggaggctgaggcatcagaattgcttgaacctgggaggtggaggttgcagtgagccaagattgtgcctctgcactccagcctgggcaacagaacgagactccatctcaacaaaaaataaaat

SEQ ID NO: 203561 - DNA, 374 bp, Homo sapiens
attctcgtgcctcagcctcctgagtagctcagattacaggtgtgtaccaccacgcctggctaattttttgtattttagtagagatggagtttcaccatgttgcccaaggtggtctggaactcctgagctcaggcaatctgcccgcctcggcctcccaaagtgctgggattacaggcttgagccactgtgcctggcccagcacattaacttttaaacatttccaaattggacaaaaacacatgtataactgatcacaaaagacggcccatcattttgtacctgaggtacctatgcagaagagcagcaatagtaatcaaataaagcccaatttggcatgaaagttaatttttttgttttcagcattaatttgttag

SEQ ID NO: 203562 - DNA, 313 bp, Homo sapiens
tgggacaaagtacacttgtcttaaaaggagttggctcaggtggttcctacttgaggtaagtgttggacagtatcaaaacaacaggtgcaattgctgctctcaagtgtggttcttcaccaagttccactacgatggggtataaagtaatgtgtgcatgtgcatgtgtacattttcctgtgtgcaaaattttcatcagattcttacaatatgggagttatggaccctcaaaagtttaagcataattgaatacaaaaccaaacataatttgaaatcacgttttcacacattaaagtaaaaattaattttaactctg

SEQ ID NO: 203563 - DNA, 206 bp, Homo sapiens
aaggtaaggcgagtgatggacaaactgctgctactccacaaggccagcgcctccctcctctgaactcccgcggcccttggtgcacagccttttgaaggtatttttcgtttcttccttttactagctatttagatgtttatttcgcatttcctccacttgtagtgtctacacagtcagggctcgtaagtgatcctcttttacacccc

SEQ ID NO: 203564 - DNA, 670 bp, Homo sapiens
tatattgctcttaaatgtccaaaagcttattagagataaatttaagtcagtaaaatctgcctaaggcttagccagaacctgacaatgtgacactattctgtctttagacaatttcatgcaggcttaataggctctgtccagtttctcaagctttcctctaggcagtggatattgtaccaatatcagtggctgtccccacttcatgccctaacgccaccccattccctaccacctccaggtcgtagactactgaaggaggcacatttacagggagcattctaaagagaggagacacttgctttgccttctctagaaaggaatggagaatcttcatgggaagctatatcatgttgacatagcaaaaatttaagcacatatgaaatgtaaaatgaaaagttaatgcccttagtcctttttcgtttgaaattcatttggggacaagaaattgaatttttaaaaagcagatctatctttgtgttcctggagtatctgtctgtcactgaggaaaaaggatagaagtggggaaaaaaaagccttaaattttgttggaggcctgagttgataaggatgatggcagctagattgtgagaggccaagcggcatggggaggtggggttgcgggggttagagctgtgggtgatcagaagggaagggcttcatttctacgctc

SEQ ID NO: 203565 - DNA, 480 bp, Homo sapiens
ttaaccatctgggaatgcagcagttggtttcagccttatttcacccagctcctatttaagatggagttgctcttgttcaaacgcctctgacaaaaccactgtgctttggagagaacaacatggcggtggatggttgtggtattatgcaataacaacacaaaatggacgaagacacatcgttagacccagctgggtaacatacctgaactccagaatagggagaaaaatctaggagctgacaaccaaccaagtcattagccagcaagaaaatggagaccacagtcctagaactacaggggactaacttctgctaacaacctgagtgagcttggaaaaggatcccatgcatcagatgagatagcaactccttctgacaccttgacttcagccatgtaagacactgacaaattagctaggccaaccttggacttctaacctacagaaactgtgaaataataaatttgtgtggtatatgtatgt

SEQ ID NO: 203566 - DNA, 803 bp, Homo sapiens
ctgtcactcttgggcagcgcctagcatctgctgctaaaggctctgcccaaatcaagaactctcccttgcaagactttgacaagcgcctggattagtccaagacagtctccttgtccatgttgctatccttggactggttcattaacatctttccctatactacacagttttctctcaatgttaaatgttactgtgatgtggaaattttaatctaccatatgcatgtattaattatactactatgtatggtttgccatattgactaacttgtagatcagcttgagcctgtgtgttcttggctgtgactgccaagtgaagagataatgctaaggagagttgtctccttgggaactccctgtagcttgtggcttttatgaataaataagcatcagtaaaagcctgaccttaatgttgtacctgatcaagtcagagaaaatgccacactttgagatgaattaaagagtccgtttattcagctggtggccaagagacggctaaagctcaaagttctctcggccccgaagaaggggctagattttcttttatactttggtttagaaaggggagggggggtctagttaaaacaattttacagaagtaaagtaggcaaaaaagttaaaaggataaatggtcacaggaaagtaaacagttccaggtgcaggggctttaagactattacaaggtgatagacgctgggctttgggcattatcaatcggacgaattcctgggaactgcggatattgctcgccacagtatcttatcagttaattgcattcttggatgtgctgggagtcagcttgca

SEQ ID NO: 203567 - DNA, 199 bp, Homo sapiens
tgggttgagttgtttgcctagacagtcccagtgtgagaacctgaatatctcaattgacagtgctaaattcactcaccccgtttcattcctctccctgagtgccatggaccacagctgcttctaattggccatcttgtagaccctgaatagttatcttcttactgtctgaaagacttaatatcaggtttgacccttcatt

SEQ ID NO: 203568 - DNA, 625 bp, Homo sapiens
tataattctgggaagttttaacctggttacagagcagaaggtggaccagtgtggggtaagaggagcaagcccttaaagaaagatgctacaaacattaggatggggcttcctccttcaatcttcttctgcctctggtctatttaaagcttctgtccagaaggcagagtaaatccagaaagaaacctcaccctcacctttatggcaatactaggtgtctgcattgtcaaagggaatagtgggtttcattagcttgcctgagaatatacaaatgcttaatcagaaaacacatgagcccctcagcccaggtgacaaccaagaccttggcagtttgctgatattgtctcagcaatcaaaggcgggctaactatcagcagcttgtgtctgactcctatcagacagcatgcttgaggggttccattaatgttccactttgggtaccatcataagaatttgggcccagactgcagttcctgatagtggccttttccttttaggctcaccaaaccatggcacaagcacatgaaaatactgcccagaccacctttcttggagcttctgtgtaagccgaaatagttcccctgagctttaacctgtaaatctgactgtcaaccagatggccccactt

SEQ ID NO: 203569 - DNA, 473 bp, Homo sapiens
tgagatggagtctcactctatcacccaggctggagtgtagtggcgcgatctcagctcactgcaacctctgcctcctgggttcaagcgattctcctgcctcagcctcctgagttgctgggattacaggtgcacattaccatgcccagctaatttttgtattttcagtagagatgcggtttcaccacattggtcaggctgatctcggaactcctgacctcgtgatctgtccacttcggcctcccaaagtgctgggattacaggcgtgagtgactgtgcccagccctaactgtcttactttacacaatataacagaaattagatctttgcaattccttaaattgaagatgaaaaatttcagacaactatgcgagagggggtacaaaattattttagaggatacacaaggaaaggatacacaaggaaaaggttggaagaccacaaataaggtgtaagccaaattcccataagactag

SEQ ID NO: 203570 - DNA, 406 bp, Homo sapiens
taatttaaaatagcaaaggatcgaaacagacatttctcaaagaagatacacctgtggacaacaagcacgtgaaaagatgctccgtgtcaccagccacccgggaaacccaaatcaaagccacgatgagaggccacctcacacccatgaggatgcttatgtcaggaaaaccaggctgtaggtgttggtgaggatgcggagaaacaagtcttcacgcactgctggcaggaatggagaatgaggcagccagtttggaaaacaatttaatggttcctcaaaagtcggaacctagaattagcacatgacctggcaattccgttcctagccatctacccaagataactgaaaatatatgtccacacacacatttgtatatggatgttcatagtactattcacaatagccaaaa

SEQ ID NO: 203571 - DNA, 456 bp, Homo sapiens
gagcagaggaaaaagaaggatttgaattctgtcactgtactagcaacaccacctagggatgaggaagacaatatctaatagaataacaaataaagtaagtatacatgattcatcaagctcttcaataaaaatgtattttagaatttatcaacatcccttttgaatcatgtttcaaaaatcacacaatctgttcaaacacggatagacccccagataaatcagaatctctctctctgttaccacgcctctgtggacttagaaatcaccacttagatttgtaaacaaggcttagtttcattattgtaaatcaatttggcaggacttatcactccacagagagctgaaataattgaatttctggacttctaaggaagaaggtttaagtacattaaggcttccaaaaggaagatcaccaactcttctttagcagaaaatgcccctggagaattttgaacc

SEQ ID NO: 203572 - DNA, 198 bp, Homo sapiens
ttgtagagatgaggtcttactgtgctgcccaggctgtctcagacccttgagcttaagtgaacctcctgtctctgcctcccaaatgttgggattatggggcctgagccactgggcttggcttaggaaggctttttgaataattatcttcctcactcttctttccacccactctccattcaaccctgatgaaccctgctg

SEQ ID NO: 203573 - DNA, 190 bp, Homo sapiens
tgagagagggagggaggggactgcacgggaggtaaggatgaatgtagtattttttaaatgaggggttcttgaatcaaaagcagagaaaagtcttatagcacaggctacagctattgctcagtcaactgctcttactcatttttatatcccaagcacacagtgcagtgcctggctccacagaaggtgttaa

SEQ ID NO: 203574 - DNA, 401 bp, Homo sapiens
gcatcagctccacccgaggtcattctaccccaccccaagggccagctgggggttgtcggcttggcctctggatttcccaggtcttagagtcagaggttggccctgccagtcatttgctggggaacctgggggcatggcggctactcttctctgagcctcagtttcctcctttggaaaacgggtttaataaccacctcttcctacctcataaggtgagaacagtgagagcaggtgtatgagacacaggcacgggtcctggcacactgtttaaagtgccaagaactgttagctactatcattgttactgccctggctccaggcctggtgttggcagtggcatctcacccctggttttctgcctgcttctctggctgctctaggtactactttctttctttttt

SEQ ID NO: 203575 - DNA, 786 bp, Homo sapiens
taaatgatgtgggtctattcttagaagagcctaagtaatcagctgaaaaacttagaattaataataagagtttaggccaggcgtggtggctcacgcctgtaatcccagcactttgggaggccgagatgggtggatcacaaggtcaggagatcgagaccatccttgctaacacagtgaaaccccatctctactaaaaatacaaaaaattagctgtgcgtggtggtgggcacttgtagtcccgctactcggggggctgaggcaggaaaatagcatgaacccaggaggcggaggttgcagtgagctgagatcgcgccactgcactcctgcctgggcaatagagtgagactctgtctcaaaaaatatatatatatactaataataataataagagtttattaatatcactggatagaaggataaatatataaaaagtgtaaatatattttaaaaaatcatttatataccaagaaagtaaatgaataccaattttttttgttcccaaacttaacaaaactaagaaactgcctaggaataaccttagttgggtatatggagtaaactgttactgagaaatatttttaaagtctgaggaaatggaaatttctttttctttttttttttttcatgaatcatacgtgagcctttgataaatttcatgttcattatggaaagaatatatatatgtgtatatatatatttctttctctttctctctgtctttatatagttcccatgaaactgccttgtttttggaatttgattaaatgattctgaagtctaccttta

SEQ ID NO: 203576 - DNA, 198 bp, Homo sapiens
tgggaagatcacgaggtcaggagttcgagaccagcctgaccaacatggtgaaatcccgtctctactaaaaatacaaaaatgatctgggaccccagggaatctgaagggaagagaccagaagtctatggcaattgctcatgaagagatgagggtctggccaaggggccaggtgggaggaaccaggtaagagatattatc

SEQ ID NO: 203577 - DNA, 368 bp, Homo sapiens
catttccaccttttagccattgtgaatcgtactgtatgaacatttgtggcaaggttctatttgaacacctgcttccaattcctctgggcagataactaggagcggaattgctgggtcatgtggcgactccgcgttcagccttttgaggaaccaccagactggtttccaaggcggctgccccatcttgcatcacacatcaattctcaatgccaaggcgttcctcagcttttaaacaaggcactgaggcaggaggcaggcagctgattgttgaaggtcaccccgtagccattggcagagccagaacttgcagctgtgatttgtgccgcggctcctgcccaagccctccttccctggcttcagtgctgggc

SEQ ID NO: 203578 - DNA, 483 bp, Homo sapiens
  misc_feature (30)..(30): n is a, c, g, or t
agaggaggtgaaatgccacattcttccagnaggcccatctgtatccagatcccctgaaagctactcagaaaccttcaaaggaccatcagaacgcactttgagaaccactgtgatggataagccttcagaggcgtttccctgcgattcccactgcactctaatccactggctttccgcacaagggcagctccaacaaggaacccaaccagagttgagggaaattcaagtttgggcagttgaccagaggtgctgactgggtccacggcagctgcattcttcaggacctgcactggccgtcatcattccaggacacaagaaagaccccgccagactgtccccgatggaagtttggctgtggtcaccatgcattgcctcctatagagcctgcctattttccatgtctgattcttcagctcttctggcaattctgtaaattaaacaaaatcctttcaataaaatctatttatgattaaaccagccaaa

SEQ ID NO: 203579 - DNA, 577 bp, Homo sapiens
gccattgagaacagaggcaggcagaggactcagattggtggagaacagggagaaacagtttagccaatgcaacgagtggggtttggtttacacaggattaaagaacaaccacaaagctaaaaaggacattttgaagaaaatctgggaaatttgaaaatgggggaaatttcaaaactgccactgcattaatgtttattgtcttaggtatggtaatgatgatgtggcagagtaagagaaggtctttgtttctagaaaatgcaaattgaaatggttaaggaggagtgccatgatatttacagaaaacttcttttaatgatttgggaaagtgtgtgggtgtgtgtacatgcatgtgcatgtatgtttctgtgtataaacagcaattgtgggaagaaatcaatagttcatgaacataaggagaagtaaacaggggtacactgtacattcaatgttttttttgttttgatttttttgagatggactctcattctgttgcccaggctggagtgcaatggtgcgatctcggctcactgcaacctctgcctcctggattcaagtgattctcctgcctcagcctcct

SEQ ID NO: 203580 - DNA, 558 bp, Homo sapiens
aaagcagacataccatgtgactcatcagactcagatattgtgttaaacacacagaccacttgacttccgcaaccatgagaaaacagaaggcatccatcccattaagataccagaatacaaaaaactttgaggcaggaaggaaatttttatgtggtaatgacctttatcattaatacctgaacagcttactacctaagcaatgaacaggaccacaccattttattgacttgtgatctttagaacacaattccggattattaggaaaacaaatctaggagaggggaaaaatacctaaaatggaataaaaagtaaattgtatagttggttgtcatcaaggatatcctgtaattcaagtaagcacactggcaaacactcccataaatcagtttataagttcaattctatttagcaattttctagactctactacaggtctaagattgcaaatttagttcatcaagaggcaaggctgataaaatcacaaaacttgaattcaatttcaattacagaaggtggtcaccattaagtgatatacagaccatcttatctgtcattaag

SEQ ID NO: 203581 - DNA, 453 bp, Homo sapiens
tgaactctctccaatacctcaaatgttttttgaaacttttttttttttagtttaaagatcttaattaattttatttgcaatcgggaatacttcatttcataaaataaaatgtgttccaatgagctgagcagaagaggttgattttatagatggagaagtcctgaagaaaggataaacacagaccacgcatggtggctcacgcctgtaatcccagcactttgggaagccaaggcgggcagatcacctgaggtcaggagttcgagaccagcctggctaacatggtgaaaccccgtttcttttttctttttcttttttttttttttattatactttaagttctagggtacatgtgcacaacatgcaggtttgttacatagggatacgtgtgccatggcacccattaacttgtcatttacattaggtatttctcctaatgctatccctccccctgcc

SEQ ID NO: 203582 - DNA, 397 bp, Homo sapiens
aaaacaaaacaggtagacctttcaaaagcaaccaacaaatccataataatcctcctagccataatattgttcacttaataacttaaaactatgaaagatttttgcaaggcatttataatgtattctagtatttttcaaattggaagctgtaactaccaaaaattgagaagactaccatgaagagctacagaaagtgatctctatgaaagaaataatgccagatggaaacttggatctatacaaaggaaggataagtgctggaaaaagtaaatatgtgaataaatataaaagactttttttcctcattggcaaaattttaaaactaaagcaaaaatattaagtgtatgtgcaatttataacatctatagaaataaaatctctgacaacaatagtaaaa

SEQ ID NO: 203583 - DNA, 1081 bp, Homo sapiens
tacatgtgtacttttcttattgggttgtgagctcctagatgtcaagtattggggctctttaatttctatcctcccagtgcctaatacattttttcatcaagcaataagagagaggatcttcagcctggccaacatggtgaaatcccgtctctactaaaaatacaaaaaaattagcaggctatggtggcagtatgcctgtagtcccagctactgaagaagctgaggcgggagaatctcttgaacccaggaggcagagactgcagtaagccaagattgcaccactacactccagcctgggcaacagagtgagactctgtctcaaaagagagagagagagaggatccatgatgttggtgctggcatgtgggtctgggacacaggggaatgtagctctaggccaggctgtgccagcttggtgaagcattagcaagtcactctgtgcttttgtttcttcatctataaaatggtggcctgcacaagatcatctttcagttctcttttgctctaacgttctgtaattgtataagggaggttcctttttcttcctttttttttttgtttgcagtcaatatttggtaatacaaataaaagtttacagaggtggatgtcaagtggtaagtgcactgtgaagcacaggtcggccaaaagtttacatgagctatttcctgaagagtgggcaatgactctggttcaattattcacacggtaaaaggatgcatttttcctgttgtgggagtacagaattgtctcctcaagtgttgactccttttaaaaggaaataaacagaacttggactagtcttcttcttattattataaggctttaagttttcaaatacattttgaagacattagaagcctgagagacacccagcagttttgtccaccttaagttagttctctatttattaattcagcatagtacacagagctctaccaggttctccatgtccctctcataactgttgcctgtctttgacttggtaaaatatgctgtgacatttctgcttcatcagcacattactggcctgatcaccagaatttaaaattcaggatctccagcaacagagccaatttctatt

SEQ ID NO: 203584 - DNA, 488 bp, Homo sapiens
cagactcctagcggggcgagcatctgtcttacgtgtctgtacatcttaaagcattagggtatggctttgaatggggtacattctccattaaaattagttaaacacacacacacacacacacacactacacacacacacacacaaacactcactaatagagccatgaagataatacaaccctaagccaggcatggtggtgtgtgcctgtaatcccagctacttaggaggctgaggcatgagggtcacttgagcacaggagttggaggccagcctgggcaatgtagcaagatgttgtctctaaaacaaaaacaaaaacaaaaacaaaaaaagacaaaaaccctaagacaatttctgtatgcatcatgtgctaaattttttaaagatacttcacaatatgattagtgttcctcagtcttgctgggtctctgtgacccccagttctttgtgcttcttccccgctgtgaaggcccaccccagccctcctccct

SEQ ID NO: 203585 - DNA, 509 bp, Homo sapiens
aaaacaattttatcaataatagctaatatgctaaaacaagcacctattcttacaagcaaatcaaaaacataagagcaaaaataataaaactcagtgtgataagattataagaaaacagttattctattttatatccttttggtgaaattaggttatattcttttggtggaagcataaattagaaaaatctgttattgaggataatcttagaaaatgttcaaattttaaaaataatttgctttttagaatttacccttaagacgtaatcaagaattggaattgtcacttacaagaaaaaacaaaaactgttcaattaaaggagaattgttcatcagttagtgagtgagtgtgaagtgccactcattttcaagatgttgggaatatagtgattaacaaaaactgaaaatatctctgtcttcatttcatttacattctagtaggggatgtagaaaataaaatgagtaaatcaatatggaacataatatcagctggtgatacatgctatgaag

SEQ ID NO: 203586 - DNA, 454 bp, Homo sapiens
taagatcaaataccaagttagaggcaaagttggaactgggaccgagattgccagcctcccaatatagcacttttatattcctctgttttgctgctactcttgattgctggcagaagtgttggtttcttggtctctgtgatgaaaaagactttataggcttggttattcttcatctttcccagcaatttgaatcaattttgttagatatatacaaccacttaaataacagactatcacttacttatgataacagaatatagaagatgggtcatctgaaaacttgtgcaagggagactaactaaaaataccagcagtttttgtttcccgaagactgtgttaaagtgagctttagagtcgagccctgtgtactgtatagtcctgtttttctctgactgcattgtgctagttctcttttcaaatgtgaattaaattcagttatgaaagattattaaag

SEQ ID NO: 203587 - DNA, 572 bp, Homo sapiens
tgtggagagtaaactgaagatgtgcaggccaacattctggaaatcctatgtcaatgggtttggtttggaacctggacttctgcatttttaaaagttacccagagatgcttctaaagatgagccatagtctagaagattgtcaaccacaggagttcattgagtgggacagctagacacatacattggcagctacaatagtatcatgaattgcaatgatgtagtggggtataaaaggaaagcgatggatattgccggatgggcatggccagtgatgtttcacgtcattgaggtgacagctctgctggactttgaattacatatggaggctctccaggaagacgaagaagagaaggacattctaggcaaaaagaagactaggcacaaggcacacttatgtttgtctgttagcttttagttgaaaaagcaaaatacatgatgcaaagaaacctctccacgctgtgatttttaaaactacatactttttgcaactttatggttatgagtattgtagagaacaggagataggtcttagatgatttttatgttgttgtcagactctagcaaggtactag

SEQ ID NO: 203588 - DNA, 572 bp, Homo sapiens
cagcaccgttcgtctcgtgtgtctgtagcaaatacttacctttttatactttcctgctaagactgtagcagcacccaattagtcatgttttaggcttttcttccttgtgtttttggtcattgatcagctttctttttttttttggactatttcctatgtactagatactgcagtaagtgctagagatacactggtgaataaagatagttccttggcccagagaattttacagtttagtagggagacaaaggagttagcaggcacttaggaagtaggataataaatgctctagaagcagacaacttaaagtgctgtgggagcaaatgtgtatccagtgcagccttaggtcagtgagcggcttcttggaggactcactgcctaggcggaaaccttgaaaggatagtagtacatactggctagaaaggaattgagggaagaagggattccaaataaagggaactttgatccaggttggtagggagagcaggagtgcttgagacagagagggaaatatagaacccgtagcatggttgtagttaaaatggaattagtcgtaagagatggcaggagtt

SEQ ID NO: 203589 - DNA, 526 bp, Homo sapiens
tcgatctcgaggatcccgtatcgcccaacaccagcctctatttccacagagagaagtgggatggcagctagaaaggattatgctttatatcaaagttttttctccagagaggaagaatttcaaaagtaaggtgtggctgggcgtggtggctcatgtcagtaatcccagcactttgggaggttgagtggggaggatcacttgagaccaggagttcgagaacagcctgggcaacagagcgaggccttgtctcaatcatcaatcaatcaatcaataaagtgttttcctgcaaagtaacatacacacatcgtagtagaatttctgtctccagaggcaaccatcttgaacagtttgtttttatccacacacttttttggcaaacatatggacacttctgtgcacgtacagaggcattcttttcttttcttacaaaagatgaattattcattgtatattatctacaacttgctttttttttacttagcaatatgtggtgggcattttcttgtgttggggatacatagatcta

SEQ ID NO: 203590 - DNA, 123 bp, Homo sapiens
ccatatattctcaaagtccatggaatatcttgctagtgattcctctttgcatatgtgatttacattttaaatattcaattattattcccagaattccttataccaacagctaaatttttttag

SEQ ID NO: 203591 - DNA, 1408 bp, Homo sapiens
atcttgcttgactgcaagctccgcattccgggttcaagagattctcctgcctctagccttctcgagtagctgggattacaggtgcctgccaccacacttggctaatttttgtatttttagtagagatggggtttcaccatgttggccaggctggtgtcgaactcctgacctcagtgatccacctgccttggcctcccaaagtgctgggattacaggcattagccactgcgcccagccgtatgtctccatctttttatttcttgcaatgtgttgttaaagaagtcaggtggtatgtgtacacaagtaacgtatacttgttgaatatttcttatttatcataccctgtctcgttccaaaaggattttacatgacttataattttaatataatccgggggagatgggcagattcagctctgggaggccagcagaatggcttttaggtcctccttggattcagaaaatacttcttgaaagatatttgaggtaaatcttacaggattagaggttagccagatgaaaagaaatcaagaggaggagagaggagcccccacaaaggactgacccagggcaataacggggaaagaacttggaggtacagaggcagaccttggtgtttcccagggtgtgggacgttgggggtagtaaggctggagtgggtagaggaaagggctagggtgacaccacggggtattaggtggaactgagggaaacagaaataggagcagagaaaagggaatgagaacgggaaagagggaggtgggaaatagaagagggagtttccaaacagcaacaacaacagaaacaagtgttttgggttgtggagcgtttgccctgcagagagctgggtctgcccttgtcccttttggggattatggatcagtgcgtggagccgcgcggccacatccaccattcacttgcacttgagtgacagccaagctacagtcatgaatacgtttctttctttttacagaagaacagtaaattgactttattccttataaaggtgatactggagaatgtgacatagatttgctggcacatgggtttcctatgagcaaaccccagaattggacacacgtatctggtgctgtattggaatcatcccaaaaaaccaaggcttgcattgcatatctatctgctgtctgctgaaggagccctgtctgtgtgcccaaggaagtgacatccttgccaagggctgtccctgtcgcaggagatgaaggagccctgtctatgtgctcaaggacagtggcttccttgccaagggctgtccctgttgcaggagatgaaggagccctgtctatgtgctcaaggacagtggcttccttgccaagggctgtccctgttgcaggagatgaaggagccctgtctatgtgctcaagggcagtggcttccttgccaagggctgt

SEQ ID NO: 203592 - DNA, 424 bp, Homo sapiens
attaaaatattctacattgtgaaatgtgcacaggggtttccataatagaggaggtttcatttcagaaatgtatattttctacatcaatttagtagttgatccagtcagcaaatttgtattgaattttgggctcatcctttgtatcagaccctgagaataaagggcaattttgcccaagttattattcttagtctttgaaacactgggggagagagtaatttttctttgttcacttgagatcgtattgggaatttttgcatattaattttcatgtagtattttactgtgaaaatttgtttttctatactttgatttcattttcatattcaggttagtgtcaatgaaagagtataaatataatgtttaaatggactatacaattgttctatgtggcattcacaacaacaaatacattcatatttct

SEQ ID NO: 203593 - DNA, 200 bp, Homo sapiens
gccgagcgaaatacattgaggcggggaaagaacaaatgagactactaagccaagtcgctctgaaagatgagtgagagaaaacttggcagatcatctggcgcaaaggtaggaagcaggtttaattctcttcttggtcaaatgccacaatagcgtgaactgggctcactatgactattttttttttttttttttgaggcgga

SEQ ID NO: 203594 - DNA, 445 bp, Homo sapiens
gatgcttagtttacaaagtggggaagatgtttttagttcactcaccatcaggggtgagggaggattcaactcagtttccccaaaacatttagccctggaaaagctaagttcaaagcaagctgaagtttcttcctattagaaagcacactagtaaatccagggaacaatcagtcttcccttcttggtcatggctaagatggctcatcagttagggcccactttctgtgaccttgatgcagtgtggatcccagcttttcaagatcagtgtggtcatagaagtctctggtccacttggtgtaccggtctctggaacctcttgtgaagacagtcagtcctctcatatggagaatgggcctggatgttatgggacagaatactacatcatccatttggcctgggaaattcctgaaccgtcccaaatgctccagatattcactcctaaaat

SEQ ID NO: 203595 - DNA, 331 bp, Homo sapiens
gttacttgatctctatgactttagcaaagtagcagaggattgaatgactgctaatcatgaacatgtctgatgttagcaaaagcaacaactcaaagcaaaagggagacatacatggggaaaacgaacacaaatacttaaaattaaatacatgacgagactgtgtgtgtgttttaaaaaatgatattgggccaagtgcagtggcttaagctagtaaccccagcagtttgggaggcaaagacgggaggatcacttgaggccaggaagaccaggctgcagtgagctatgattttactgctgcaccacagcctgggcaacagaacaagaccctgcc

SEQ ID NO: 203596 - DNA, 232 bp, Homo sapiens
aatcacatcttggacccctcagggtgagaaaggatgggatcaccacatctgctaaggcaggccgggactcactgcaacacagaatgttcccaggagcctcaaagcatagtgtcagctgaaaattcactgacccatgagctgtctgcctccctcctccattgaaagagcagtggcctgccccggttctaaaagtcctggggcttctgcaagctgataccgctttccaggacaa

SEQ ID NO: 203597 - DNA, 497 bp, Homo sapiens
  misc_feature (3)..(3): n is a, c, g, or t
ccnaggattaaacgaccaccctcctctttcttccatttgaccacattccctgagggcagataatttggttcttatctttctttacatgaggtgggcattggggaggggaagaagctatcttcctcatacctggcacaatataggttttctatatatttttaaaattatgtataaagcatggaggacatccagtggatgatactatgtgtaccttcaacttaaaaagaaaaaagaagtcaggccgggaatggtggctcatgccagcactttgggaggccaaggtgggaggatcacttgagaccatgagtttgagatcagcctgggcaacgtaacaagaccccatccctgtaatttaaaaaaaaaaaaaaaaaaaatgtaatcccagttacccaggaggctgattcaggagattcatttaaccccgggaggcggaggttgcagtgagccaagatcgcaccattgaactccagccgtgggtacgagcgaaactccttctc

SEQ ID NO: 203598 - DNA, 311 bp, Homo sapiens
caccttattgaaaagagtagcttttatggatacccttgttctggtgtgtattttgaaaaattaatcttgtttgacagccccatggcattgagctggatttttgaataagataaatcattaatatgtcacgcttagctcagcccttggttacaactttctgtcctagcctgtttaagacttagcacttcagggttgaaagttcatatgactggctaaaaagggccttcatactatatttgtattctaattactagagttctccatggttctctctcatgtgactaattcagggatactctttgaaatgctcc

SEQ ID NO: 203599 - DNA, 546 bp, Homo sapiens
gagttacagaagtaaattgtctgtatcatgcatactgtatcgactgtgtaaatatgtaaatattcttgactgagtagtaaaccgggctttagtagcaaaaaaggagtgtttcactttaattcactagcttttataagtcaataaaatttgtaacagttaaagggttattattccaatcaataaaaattcttaagaaatcaatccatagaaaaccatttacctattgaaaaaaagagcagagaatgtgaagaggcaactcataaaagcaaaattgaaaaaaatatctgtgaagatgcattacacttctctgctaaacagagggcttcaaagtaaaatacagtaagatgccactttttgactaagagatttgatgaagcctaaaaaataaaaaaaaattaaaaaaaacagactcttgcccactactggaagaagcataaactgtagtgagcttttggaagggcagtttggcattgtgaactttggcaaccctgctgccgagttgttgccttagtttcaactctaggaactcatcttaataagacattt

SEQ ID NO: 203600 - DNA, 435 bp, Homo sapiens
ttttttttttttgagacggagtttcgctcttgtttcccaggctggagtgcaatggcgcgatctcagctgactgcaacctccgcctcccaggtacaagccattctcctgtctcagcctcccaagtagctcgaattacaggcatgcgccaccacgcctgcctaattttttgtatttagtagagacaggatttcaccatattatgctggtcgcgaactcctgacctccggtgatcgacccgcctcagcctcccaaagtgctgggattaaggcgtgcgccaccgcgcccggcccctgctataatcttttcagaattcgtctgcaaggtcttcaacactgttaccctgaacacacttccggcatgaaatatgaatgccctacatttcttaaattgtgcatctaacaatggagaagattagtctctaaaaattataattcc

SEQ ID NO: 203601 - DNA, 183 bp, Homo sapiens
gggagggagggaggagaaagaaacgaaagaaggaaggaaaggaagaaaggaagaaagaaacagagaaagagaaagaaagaaaagattgatgacagggtctcactctgtcgctcaggctgcagtgcagtggcaccatcacggctcactgcaggcttgacctccccaggctcaggtgatcctccc

SEQ ID NO: 203602 - DNA, 580 bp, Homo sapiens
ggtgaaatataaaaggaaatctctcacagatgcaggggaaataaataaaaaaaaataaagtgagaaggtaaacaagcatctattttttaacctggcaaatgacatagaatcaagagttgctacctatacctcttcaataacaatcgccctaaaactgaaccatggaattcccccaccctgatctcagtctcgattctgatccacgcacaccttgtcagaactaccagttacttgacagatacatggctgctggggcaaaagacttggcacagggtgtgccttccctttgagggtggtgagaggagagtgtttgagaccaaagacggagaacatgtcggtgtggagagcatctgcaagctggagtcccaggattcagattccccatgtccccacacatgtgtacataacagaaactctgacaagcccccacattatcagtgctgcatttacaaaatgggtagactatcattgtcttagttttcttagctttctataatgtgaatacacagtggcactgcatggaggttagaaagcacagagtctaggttccaattccaactccttcagtcacctgctatgt

SEQ ID NO: 203603 - DNA, 443 bp, Homo sapiens
taagtagcatataacccacaacagggctatagttatctaaaagaaaacatataaaaacataattacccacttctcaagaagatgaataataaataagttactttggaatgtgaaaataaggcagtagtagcaatacacacgagtaaataagaagtgaaaaatacatcttgtcatctatattattccaaatctctttgtagaaagcagcacatgctcattgtgataaaatctgaaaaagttcaaggccaggagtcagagttcttaccctggacttcacttaccagctgtgtgagcttgggcaacacatttaacctctctgagcctcagggtcatcatctgcaaaatggggcttaagaacacctgccctaccacctcatagggtagtattgaaggagataaagtatgggaaagggctttgaagtagataaagttctatactgtga

SEQ ID NO: 203604 - DNA, 779 bp, Homo sapiens
ggcctggactccaaggaagctggtgggcagagcagtcaggaggaaaggatagagagggaggaagaagggaaggaggagagaacggagaaggaagaagtgggggaggaggaggaaagcaccagaggggaaggagagagggagaaagaggaggaggtggaagaggaagaagagaaggtggagaaggagacagaaaaggaggctgagcaggaaaaggaagaagacagcctgggagcggggacccacccggatgctgccatcccctccggggagcggacatgtggctctgagggctcccgctccgtcctggacctggttaactacttcctgtcccccgagaagctgacagcagaaaaccgctactactgcgagtcgtgtgcctccctgcaggatgccgagaaggtggtggagctgagccaagggccgtgctacctcatcctcacactgctgcgcttctctttcgacctgcgcaccatgcggcgccgcaagatcctggatgacgtctccatccccctgctgctccgcctgccactggctggtggccgtggccaggcctatgacctctgcagtgtggtggtgcactctggagtgtcttcggagagtggtcactactactgctatgcccgtgagggcgctgcccgccctgccccttctctgggaactgccgataggccagagcccgagaaccagtggtacctgttcaatgacactcgggtgtcattctcttccttcgaatctgtcagcaacgtcacctccttcttccctaaggacacagcctatgt

SEQ ID NO: 203605 - DNA, 612 bp, Homo sapiens
agttcttgggaaggttagaagctagacaggtaccccacaatgtctgcttacagggtttaccaactccttggagatgtttagttgactcaggcagctacaggtttccaggaaccttcctctccatcttaaagcaaaatcccactaaatcccactttgcattatggtgaagagtgcaaacatctttggaaggagttgcaagtagttctaatttcaagcagctgtcacagaatctcctctctgagttccctgggcttgctatgggctcaaaagcctggaaattcttacaggtgataatcagcttgatgcatttcaggcttgcagcagtaggagtgagtggagggcagcaggtctgaggggtttctcactgggccttccacggagatgctccgttttagacgtaatgggcggagtttcatctggaggagccaggccgaggtgaatgaaagggaggagacctggaggagcgggtcttctgttggcatccccaagcctggtgctgctgcagtggggactctacccagaaggtaaggattccagcttaggccacggtctccttgttgccgggatgaaccgaggagatgttggggcaagtctacactcttgaaatggttt

SEQ ID NO: 203606 - DNA, 752 bp, Homo sapiens
tcaaagtgctgggattactggcatgagccactgcactcggcctgctggctgattcttagagaagacagcagttttgaccattctgtggatgcctgcaagtgcgcatttaggtgatgggaatgcatgccatgaactctctctttcttgccatatgctctcttggttttctagggcagctggtgaatactgttctatgcatttgtatgcccatgtgtgttagctgtgtacacagtccttgctcattgaggctgcaggaaaaatatctgtggctttgcagtcagtggcacagagcatttcaagcgtgtctgctctctggcttttgaccagggttcagaaacccacctctgttgtcgatatatattcccggaggaccccgtgggtctggcacgaacacgcgcgcacacacacacgcactgcgtgggctggcttgctgaggggaactccttaagcacggaatggttcttgttcttggtctaagagtggtggggagtcttgagtgcagataggcttggttggaaccttctaggacttagatttccttctccgtgggtagaacaccttttcatttgttaggccataaagttgtaactggatacctgtcctctcttgctgtctcttgagctcagccacatgtttatgaaaaatgcccagaagccaccgtggaagcatattgaaccagtcgatagccgagggtggcaaagatgattatgagtatggaaggggaaagaggctgggagcggtggctcacgttg

SEQ ID NO: 203607 - DNA, 1811 bp, Homo sapiens
ctcagtcacaggccaggcccaacagtggcccctcagagcaaggagggcaagaagggcccccgcctgcctgagaaggagactctcctgagcctgccagcaaaggacactcccccaggtgttcctgaaaagagtcttggcggcagcagcctgacagagacagaggctgcccccagcctgaccctgccctctgtggactacattccccaagactctccaactcccagtgtgcggcagatccggaatgagctggaggcccggctctcctcagcagcagagaaggaggctaagcccagcataggatctctgccccctaagcctcggctagaagggggaagaatttgtgaaaacggggctgatgatgacaaactctccaagcctgtggccaagaatctgccacctcaatccaccaccctgctgccaactacatcactccagcccaaggctatgttgggaccagccataccacccaaggccacacctgagccagccataccacccaaggctacactttggccagccacaccacccaaggccacacttgggccagccacaccactcaaggccacatctgggccaaccacaccactcaaggccacatctggccctgccatagcatctacagccacaactctgcccaccaccacatcccaactgatggcagagaaggactcaggcccagctggccagccagagaagccagcatctcaagaagtttccactccctcccaggcaaggggagaggggtccccctcagaggccactaggctgcccacacagggagcccgctcatctgcagccttcccaccaaagacatctcctggtggaggagaggtgccatgtctctacaagccccactgccaccagagcagcctcagccgtgaggttgctgtggtgatgcccaccctggccagaggaggggctgcagggccaggggagcccgtggaggtgaaggagcccccagggctgccagccaagcctcctgcctcggcccagcccactgatgaactcctcaggcacccggtgactggggaggtggtggagcggggctcgccgatggccctgctcctggcggccaggcagagggctcagaagggaaggtctgtaggggctgccctgggtcggtcctctctgccaggaagtctccgtgaccacagccaccaagccgaggccagctctgacagcatcttccacagccagggcacgcccaactccttcactgtggtgcccaagttacccaaggaggctgagaaggactccccgctgacgaccgaaatacccaataagtgggggccgcggctgggaagagacgcagagggcacagagctgagccgcaggcacaactggacaaagccagagccccaggcccctgtggcctgggaaagagtagctccctccaacctcccccagggccacccgctgcccaagtccttctcctccccaccttctccttcgaacaagagggaggaggaggaggaggagttcaacttcgaggtcatcccaccgccgccagagttcagcaatgaccctgagcccccggccccggccctccagtatctgggccgccagagctcccctccccggaacaactactcagacttgaggcagctcccgaacgctggccccggggcgcccccggctctcggcttctcgcgctttcccgcgggcgcgcgctacgccggggctgggggcctggagcgcttctcgggagggggccgctcgctcataaagaagcgcctgtacgtcggggagccgcaccgaggcccagggctaccccacggtggcaccggccgcagcctgagctctcccaactg

SEQ ID NO: 203608 - DNA, 503 bp, Homo sapiens
  misc_feature (33)..(34): n is a, c, g, or t
  misc_feature (37)..(37): n is a, c, g, or t
  misc_feature (50)..(50): n is a, c, g, or t
  misc_feature (56)..(56): n is a, c, g, or t
  misc_feature (124)..(124): n is a, c, g, or t
cactggcagatgagtctggaacagactcctttnntanaactgaacttgancacatnaaaagttgtaaaacaatctccatggtaattaaacttgcattcaacaccatatggtaacagaagatggnaaaggataagattcagatcttagacctttccaagtagggcatgttagatgatagaaggattagttgcaagctggatctgagctcaggcttgggcatgaaggaaactgtctcccatgtggtttggaagagttaggggctccctgagctctattgtgaactatacgggtttcatccaaggaatggtatgatgtgggcataaaaccattcttcagacaactgaagatggtccccttctgtagccagaaccacaaatatcgcctttcttcaatctctatttaagtgtacctattttgctgaggtccagattaaataattcaaaaccatctctagttgatagtatgtatcatggagcaacgggccaaaaccacagtattctggg

SEQ ID NO: 203609 - DNA, 451 bp, Homo sapiens
ggcttcttgtgatggttggcaagcccaaatctcagcacatagcacggtggtttgagtgtatagtggcaggttggctattcttcaggactgaggtgaatgtacaaatacttaatgattgagttcttgttcataattttggggtttggtctaaggacccttagtttataaattctctgattactttttaagaagaaaagtgatcttgaatttaaagaaatgtaagggatagtggtggggtgggaaattcattatgttagaggagatttcctggcattggaagggagattttgaaattaatgctgtagtgaaacacaagaagattaaggtgaggaggaggctggtcatagttttgtatttgaaatgcctgtcttgcctctcagttagtagaattagtaccataatctaggacccttgacttcttaacaagtttactctgccttgcaaccatcgt

SEQ ID NO: 203610 - DNA, 348 bp, Homo sapiens
tccagaggctcaggccactaaaagaataagatttaatcataaaagtataaacagattctcctccaacactttactaccacatcaacagggctccagtataataacagaagattataagtgagagagctacaaggcacagaacctatttaaggagttcataaggaaacccaaagacaataggaaaggagagaaaaaaacactagagaaactgaagtctctggcacctatagctacaataagcattaaacacaacccagctcctagccaaattaacataaagccgcataataaaagcctattacctgatacataatatctctctttcaactaaaaaattacaaggctaaa

SEQ ID NO: 203611 - DNA, 263 bp, Homo sapiens
ctaatacatcatcctggttcaaacagtaaaatgtaaattcctcttctatcccaacacccatcttttagttcacttgaaagagacacatatcagtaccagattcttgtatatctctctagaaataaccatatatgtacataggcatatcagtaccatatatagtaatgcaaattgtaacataactatgcatacattttctgtaccttttctcaaagggaaataatacatcattagagtttgaatattaaaagtaagatcaagca

SEQ ID NO: 203612 - DNA, 448 bp, Homo sapiens
ccaaatggtccagagtgactatactatttcacattcccaccagcaatggaggagtgactctggttttgtattcttactggcatttggtgtcatcactgttttatttttgctcttctgataggtgtctagtagtatctcattatggtcttgatttgccttttcctaatggctaatgatgttgaactttctttttctattacagactttttgtgttagaaacagacatgattcgggatgatttttttcctggcttacatgaggagagaaataagagataaggaggttaggttagaagctgttgaactagtctagttgggaacttcagaaggcttcgtgggtggccagtgtgagaacagagagaatgatgggtaagtctgcatggctggatgggaaggattatggaaagaaaaagtaagatgaaaatttgggtatcgatgcctggtgacca

SEQ ID NO: 203613 - DNA, 246 bp, Homo sapiens
tactactttacaccaaagtaaactgtgtcatttagatctctgtctaatctctgctcttagatttaaaatcccttaatggcagaaattgatttggtctttgtagcccttagtacttatcacatgccttgaatatgatagctggtcaataactgctaaataacaaatgctttggacggtagtaacccgattctgtagtcttccccagccacaccacacgtctccctcctctgtgctatctcatgggct

SEQ ID NO: 203614 - DNA, 112 bp, Homo sapiens
tacagcttctctctatcccatctctgtccaggagaaatagaatatgagctacaaatataagttaaaagtttctagtagccatattttaaaaagtttaaaaaaaggcctcttg

SEQ ID NO: 203615 - DNA, 1300 bp, Homo sapiens
  misc_feature (12)..(12): n is a, c, g, or t
  misc_feature (14)..(14): n is a, c, g, or t
  misc_feature (1111)..(1111): n is a, c, g, or t
  misc_feature (1146)..(1146): n is a, c, g, or t
  misc_feature (1300)..(1300): n is a, c, g, or t
aagtagaacagngnagaagggaaacatcatgggaagaaagactatttgtttctgattgcaggggtccttggggcatattatgtttatactcctctctcagataatattgaggaactctggtgactggtgtggatagctacacctgtgaaaatggtaacaaatttgctttgtttaattatgactttctgtcaagatgaacagctgatagacttgatgctgttgttgtatcaaccaactcatagaagacccagatgtcaagatcaaactcaagcttcagtctttaatatatcctgcccttcagacgcttgacatggatttactatcacatcagaaaaaaactagactctctagttctgtccaaaccattcatggtcaggttctgtagggaatactttaccacagacagatcacttgaaaaagtcatgttcttcaacatgtaccaatggaatcaaaccatctgttcagatttgttaattggagttccttgctcactgagaagtttaagaaaggccacttttgttatattccaactcgtggtagttctgagctagctaaaaaatatccagggttcctagatgtgagggcagcccctttgttggccaatgacaagttacatggtttacccctgtcctatatcatcacctgtcaatatgacatcttaagagatgatggactcatgtacatcacgcgactgtagaactctggagttcaagtgacacataaccacagtgaagatggattccatggagcactttcctataatgggcttaaaattgagtatggaatagaaaatcagtatatgagttggctaagtgaaaatctatagtaaaaatgtaagcaatggtttatttaaaatgtataaggctcagaacaggaaacaaattagtgaaaatcaaagggttgatgtttgaattggtctttatcatctgtgacctttctaaggtcctcatagccatagtgggttttggttttgtttttatttattggccgctagcaaattcttctccattttatttattatcctgttattcactcacttctgtgaagatactttagtattttcttctgctaccattactcacttgttaaatctctagtttacagctatagntttttgattgccgaatagtattacagatgagaagnaagttttaaacaaacacgtctgatttgtaaaatgccagttttagtcaacatgaatttagagacttaaaatgtttccctgtgagaactgatatgaaatatgtgccatctcttttaaaaagcatttgcctcaatataatgctgtttgcctgtcacn

SEQ ID NO: 203616 - DNA, 613 bp, Homo sapiens
  misc_feature (12)..(12): n is a, c, g, or t
  misc_feature (14)..(14): n is a, c, g, or t
aagtagaacagngnagaagggaaacatcatgggaagaaagactatttgtttctgattgcaggggtccttggggcatattatgtttatactcctctctcagataatattgaggaactctggtgactggtgtggatagctacacctgtgaaaatggtaacaaatttggctttgttagttgaactcttgggaatcaatcatttcatgaatactgcaacgttctttgtgagctttcaagaagtcccacctacatctgatgaaaatgtcaccatgatagagacaactttcagtaacattcctgtccgtgtatacatgccaacactaaagtcagagatactaagaacgggcttagtttatattcatggtggtggttggtgtatgggggatgctggtatgtgttccatattaaaagttttagtttatcatataacatacattttactgaaatgttgactccatcatatcaagacaaacatgttagataacaaaacacttcagctgtccaaaatttatttctttggagctatgtagatttaaaagaactattttaaatctcattctgaaagagggcataataaataccaaaagctgtagcaaatctcaggtaagaagagaa

SEQ ID NO: 203617 - DNA, 1230 bp, Homo sapiens
  misc_feature (12)..(12): n is a, c, g, or t
  misc_feature (14)..(14): n is a, c, g, or t
  misc_feature (1041)..(1041): n is a, c, g, or t
  misc_feature (1076)..(1076): n is a, c, g, or t
  misc_feature (1230)..(1230): n is a, c, g, or t
aagtagaacagngnagaagggaaacatcatgggaagaaagactatttgtttctgattgcaggggtccttggggcatattatgtttatactcctctctcagataatattgaggaactctggtgactggtgtggatagctacacctgtgaaaatggtaacaaatttgctcatagaagacccagatgtcaagatcaaactcaagcttcagtctttaatatatcctgcccttcagacgcttgacatggatttactatcacatcagaaaaaaactagactctctagttctgtccaaaccattcatggtcaggttctgtagggaatactttaccacagacagatcacttgaaaaagtcatgttcttcaacatgtaccaatggaatcaaaccatctgttcagatttgttaattggagttccttgctcactgagaagtttaagaaaggccacttttgttatattccaactcgtggtagttctgagctagctaaaaaatatccagggttcctagatgtgagggcagcccctttgttggccaatgacaagttacatggtttacccctgtcctatatcatcacctgtcaatatgacatcttaagagatgatggactcatgtacatcacgcgactgtagaactctggagttcaagtgacacataaccacagtgaagatggattccatggagcactttcctataatgggcttaaaattgagtatggaatagaaaatcagtatatgagttggctaagtgaaaatctatagtaaaaatgtaagcaatggtttatttaaaatgtataaggctcagaacaggaaacaaattagtgaaaatcaaagggttgatgtttgaattggtctttatcatctgtgacctttctaaggtcctcatagccatagtgggttttggttttgtttttatttattggccgctagcaaattcttctccattttatttattatcctgttattcactcacttctgtgaagatactttagtattttcttctgctaccattactcacttgttaaatctctagtttacagctatagntttttgattgccgaatagtattacagatgagaagnaagttttaaacaaacacgtctgatttgtaaaatgccagttttagtcaacatgaatttagagacttaaaatgtttccctgtgagaactgatatgaaatatgtgccatctcttttaaaaagcatttgcctcaatataatgctgtttgcctgtcacn

SEQ ID NO: 203618 - DNA, 1313 bp, Homo sapiens
  misc_feature (1124)..(1124): n is a, c, g, or t
  misc_feature (1159)..(1159): n is a, c, g, or t
  misc_feature (1313)..(1313): n is a, c, g, or t
gtattccttagaagcaactcattaagttcagcccacactcaaggagcagggaaaattgaactttatctcctataggctacagaatagcacctaaatatcattttccagatcaatttgaagatgtatataatgcactaagatggttgttatgccaagatattcttgaaaaatatcgtagagagcctaaaagaattggcatttctggagacactgctggtggaaatttagctgcagcagtgacccaactgctcatagaagacccagatgtcaagatcaaactcaagcttcagtctttaatatatcctgcccttcagacgcttgacatggatttactatcacatcagaaaaaaactagactctctagttctgtccaaaccattcatggtcaggttctgtagggaatactttaccacagacagatcacttgaaaaagtcatgttcttcaacatgtaccaatggaatcaaaccatctgttcagatttgttaattggagttccttgctcactgagaagtttaagaaaggccacttttgttatattccaactcgtggtagttctgagctagctaaaaaatatccagggttcctagatgtgagggcagcccctttgttggccaatgacaagttacatggtttacccctgtcctatatcatcacctgtcaatatgacatcttaagagatgatggactcatgtacatcacgcgactgtagaactctggagttcaagtgacacataaccacagtgaagatggattccatggagcactttcctataatgggcttaaaattgagtatggaatagaaaatcagtatatgagttggctaagtgaaaatctatagtaaaaatgtaagcaatggtttatttaaaatgtataaggctcagaacaggaaacaaattagtgaaaatcaaagggttgatgtttgaattggtctttatcatctgtgacctttctaaggtcctcatagccatagtgggttttggttttgtttttatttattggccgctagcaaattcttctccattttatttattatcctgttattcactcacttctgtgaagatactttagtattttcttctgctaccattactcacttgttaaatctctagtttacagctatagntttttgattgccgaatagtattacagatgagaagnaagttttaaacaaacacgtctgatttgtaaaatgccagttttagtcaacatgaatttagagacttaaaatgtttccctgtgagaactgatatgaaatatgtgccatctcttttaaaaagcatttgcctcaatataatgctgtttgcctgtcacn

SEQ ID NO: 203619 - DNA, 423 bp, Homo sapiens
actagagcaatttttgtggggcatttaagctgcttcacagttaagacacctaggacaaattatccctatctagatagtcccttgcaagtactgagttttcaaatgttaacataattattttttaaattggtttaaatctatttactcttcagcctctgccaagttccatcgtgttttctactatgtaaagcaacataagaaactattacttaccatggtggaggaaagaagattgtaattaccagatacacactgccaaaaaaattgtaagggtagcagcaataatttaaatgattctgaaggttcctgctattgcaaagcatagaaatatcagattttcaaatgacatcagatgttttaaaactgtggctttcagcctaggcaacatggtgaaacctctctacatgaaaaaaatcaacaaca

SEQ ID NO: 203620 - DNA, 296 bp, Homo sapiens
ctacaatgcccaggacagacgccacaacaaagatcggctggcccaaaatgtcaacagtgccagggttgaaaaaactcgctttaggagaagacaagaaaagaagaaaatgcttcataatataaaatatcctaatattctcttatgctacttcttctataagcacaaatagacaaagcacacactgtatcttaaaattccacatttagagttaatgagaattgatgttatatgacaagatctgcagccgggcaggagggagaggacaggtcagctctgatttcccaacataaacccct

SEQ ID NO: 203621 - DNA, 401 bp, Homo sapiens
ctgtctgcttgcttctacactggcccctgcagatggagggggtggggtacaggggttcctataagaagcagacacttggggtttttcccaggtcctgttgcaggagggtgcgtgggctggtttccctgaaggcgcctgggcgtgttggtgttaactgatctgagatcttctgtggccctgatgtctatgagcatgccccagcttgcagggggctgagtagccgggcaccaccaggaggctgcgtgccctgtgcttgggtgtacccatgccctgtcagcatcgttggtctgttagggtcagggacttcggcttcttgtttagtaccctccatcccttccagttgatcatcagaaacattctccttagatgcggctgcctgaccccggtgagggggcctgcct

SEQ ID NO: 203622 - DNA, 507 bp, Homo sapiens
aaggacacggattggaagctttaaatgccatgttactacttgggtataagggtacacaaggtggtatttcatcttcctaacgcacataatgtgtagcacatggtgattagacagtgtaaaatctattgcagtcaagattttacaatctaatggtagcagttaacagatgagagtattagctaatgtacaaaataattggaaaaatgtatgaacacattttggaatgttaagaatgaattccagcttttgttttttctagtacaagaagctacaggtgcacatgtaatttccaatatatactgaataactttcacaaagcagtgtttgtgaagagttggatttggtaatactaggatttagtttggttgtaggggaatctgtgtctgttacagggtaggttttccttggacttctgtaagcaggagtaccttcaacaagggtgataaattttggcccccagatatgtcattgacatttacatgctttgtaattctatttgggtcagtt

SEQ ID NO: 203623 - DNA, 555 bp, Homo sapiens
tgaatcagcagacagaatggaactaagaaggcacaaagaaatcagagtgactgagtggaggaatttctaccaaacctgtgttgcctaccctactcacttctttctcatatttcagagccactggaaatgatgacatatatcctcagggcaaaaggggaagcaggctttctaaagaagtaaatcaaggtacctgaaaagcaatagagctaatgtgtatgctgtcacacaagagtgaagcttccttattttttgcatggatagacttgcttgtgcaaatccattaatgcaccctaaagttaaaactgccagccaacagcccttagtcagctatctcattaagggatgcagctctagagatggtgaagagacaataaagtttaccatattttgattaaaaggccacaaaagagaagtaacaaggagtaaaaacaaaactaatcaccataaaatttattcagaaaatgtaagaaaacccctttaaaaaattctatttgatgttctcaaagagagggggaaagatactgcatccataaaataagaacaggttgccattaa

SEQ ID NO: 203624 - DNA, 1662 bp, Homo sapiens
tggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaac

SEQ ID NO: 203625 - DNA, 344 bp, Homo sapiens
cctgtagctggccactagagcggtagctcccaaccctggccgcacaccacagtcacgtgtggagcatgttacaagtttccatgctttggctcaacccgcagagattctgattcacaaggtctctggtaaggctgaggcatcctatagcttataaaccctacacaggacctttggaattgtatccaggatggaaaggagctataccgtaccagagactagcttctggctttgtaaaccaaatagcaaagaaaaatcttcagcccttgtaccaaaggaagcaggctgctctgggcctgcagaggcctcagacttctcaaacctatgcaaacactctttctacacag

SEQ ID NO: 203626 - DNA, 305 bp, Homo sapiens
tttcactaaccaggctttggcaccttgtatcacttaaaaccagttccattgttctctccttctgtatcatattgctgagaatgcttttggttttatctattaacattttttatgctacagatacaggcagaaatttatctactaggatctacataacagcattatgttgttgataagggaaacaatttaaattttaaagcatgactaatggccgggtacagtggctcatggctataatcccagcactttgggaggccgaggcaggcagatcatcggaggtcaggagttcaagaccagcctgacca

SEQ ID NO: 203627 - DNA, 543 bp, Homo sapiens
ggtcctgtcacccaagctaggtaggcaccatcaactgagagagagagagagaggtatggggccaaagatagcaatcaggtttgaaaattatgtctaggaaagaactagggaggggactacttctgtagaagaacagctctgccatgacttcctctattgataagcttacacatatcaatagaggcaaaggcttgaattgcaacttatctgagccctggcacaacaccttgtcatccttaagggaggtgtctaaggagctactagaaaggcatctctcactcacctttctatctctcctaagaggctgtcatgacatagtttctcatcacctcccaggttttgatgagatatggggctttctgccccactcccctcatgataggcctgcagaatataaaagcactagctgccatctagatttgactccttagtaatagagtatcctacaactcgcattgcaatcatcagacccagggagaagacatctttcacttattcttctctgttgctatctatggaagtaataaaccatctaaatctaaa

SEQ ID NO: 203628 - DNA, 505 bp, Homo sapiens
ggtcctgtcacccaagctaggtaggcaccatcaactgagagagagagagagaggtatggggccaaagatagcaatcaggtttgaaaattatgtctaggaaagaactagggaggggactacttctgtagaagaacagctctgccatgacttcctctattgataagcttacacatatcaatagaggcaaaggcttgaattgcaacttatctgagccctggcacaacaccttgtcatccttaagggaggtgtctaaggagctactagaaaggcatctctcactcacctttctatctctcctaagaggctgtcatgacatagtttctcatcacctcccaggttttgatgagatatggggctttctgccccactcccctcatgataggcctgcagaataagtgaaagatgtcttctccctgggtctgatgattgcaatgcgagttgtaggatactctattactaaggagtcaaatctagatggcagctagtgcttttatattctgcaagt

SEQ ID NO: 203629 - DNA, 228 bp, Homo sapiens
gatggggttttgccgtgttggtcaggctggtcttcaactcctggcctcaagtgatccatctgccttggcctcccaaagtgctgggattacaggtgtgagccactgtgcccagccacaataaatcatttttaaaaggttaaatttaacctcatttaagtaatacatgtaagtctcatcgaataactcaagtgatccatctgcctcggcctcaactcaggatgcttcttg

SEQ ID NO: 203630 - DNA, 345 bp, Homo sapiens
ttgcccatcacacttaaaacaggaaggcttctcatacttcaaatatttggtctggtcaactctattcagttgacctagtgtacccttgtacctcaccattctatttctttataaccgttagctttcttatattggtttgcttaacttctatctccatccgacagaatgtcggctccttaaggacttctctgtttgttgtcacatttctatgctgaacagagtatccagccacggtacgttaaatagatggatgtgaacatacagccctctcatgaggaaagggttaatagatttttttccttcttgaaaacaaaaaacagtagcatagcagcagaaattggcaat

SEQ ID NO: 203631 - DNA, 473 bp, Homo sapiens
tgggattcagaaccaagtctgtataatgcctgagcttgtgtgctggctttcatggagtcaaaatgtaaaactaggggacagtagggcattactactaataagtcgaataataccaacgcgtggatagagaaaaaaaaatcaagagaattccaggaaaaagaaaaaaacaccacggttagatgttttctagaattttctataattattggagaaggtttctctggggtatttggaggagttctttcagccagaaacaatagccacaacttgtcccagctgtgggatgggcttggcctctttaaaggacagttgagactctcttgacaagaacccaacactgtaaaataaaagacctggccgggcgcggtggctcacgcctgtaatcccagcactttgagaggccaaggcgggtggatcataaggtcaggagttcgaggcctgcctggccaacatggtgaaaccctgtctctact

SEQ ID NO: 203632 - DNA, 451 bp, Homo sapiens
acgctgcattatgtgaacaggtgcgcgggccacagcaactagaaagcaattctcccgctgtactcagtgtcttggctgtttaaagggctggaaagcaaaagccaggacacaagatgaaaggcaacgggattgttcaacttgaggaagagaatgtggaggttgcattaatgctggtctttgggttcatgatgcagaggatattaatgagctccctactgagggcagaatgagaggaaatggatttaagcacagtgcaaggtacttatgaaaagcaaaagaagattcattgaaaagatgatgattttttgtcagaaaggattctttttttttttctgagaccgagtctcgcgatcttggcttactgcagcctccaccaccagggttcaagccattctcctgcctcagtttcccgagtagctgggaagacagacgtgtgccaccatgccaggct

SEQ ID NO: 203633 - DNA, 575 bp, Homo sapiens
ggtgggagagaatgctggatcggcggggaagagaatgtgaccagtgagaatgcaactcggtgcaggaatatctgccacacaagcctgttgtcttgcaaccttgaaaagtggtgtttggatctggagtcagatccagaaggaacttgaatggcagactaacaacaataacaacttctattcatagaggactactatgtgcctgttatttaataaccttaagcagcaggtagtgatattagctctatatttcagctgagaaaactgaggctcaggaggttaagcaacatatccaaggtcaaacacagccagtaagtgatggaagtggggtaggaatccaggcctacatgggtttcaaatttttatttatttatttttgagacagggtctggctgtgccaggctggaggacagtggcacaatcttagctcactgcagacttgacctcctgggctcaagcaattctcctgcctcagcaccccaagtagctggtaccacaggcacatgccaccatgcccagctaatttttttttcctgtggagttggggtctcactatgttgcccaggctagtcccaaac

SEQ ID NO: 203634 - DNA, 537 bp, Homo sapiens
attgaatctaaaaaaaaaaaaattacaaatcttcagggttgaacattttgatgagattcatgcctagggttactttagtaaaaaatagtgagccaatagttgaagtattggtcttatgctatcaatttttattaaagtaacatattcaaaataagttgggatcttaccctaatattttattaactgagaaagtaatataaatgtcccaaatctaatgtaatatggagcctcatagttttgacacatttcccaccatattagatgctatgtcatataattaacattagaattctgtgccttctttttggtgattatatgtgttgaatcatttccaaatattttcatgtatcagatgatattgatgctatttacattactttagttctgactagttatttcattttagttttgtaatagatgaaaattgctatagtttctatgataatagagtaattcacacctatgtcttctctataactctgtgtttcttgttgaaaatgagttctcacttgtgttacatttagttttctgttgcag

SEQ ID NO: 203635 - DNA, 528 bp, Homo sapiens
ctatgaaagatatgtggaagtaattacaaaataacaacaaagatcaaattgtatgttctaagaaagaaattctgaagaatattataatgggaaaacaaagcagcaataaggatatttttcataagttatttgataaattccttttggaaaaatgatatgtaaactgaggcatgagtcccaaaaaatgagaaactgtgagccatgaaaaaggatgagaatgtgcatttcacacctaggacctagcaaggacaaaggttctgcattaaagagtacttagcttgttaaaggattgtgagaagaaaaagagtatattaagttagcatgagaatggcacaaagtgaggttgggaaaaaaatttgccctgtaaagagttgaaatttattttaggagcaatggcatataacatgaccttctttcccgaaaatctcactctgtgtatactaatgcttggaatggaagagtgcaaaataggaggctatctcagtaggcaaaaaattatggacatccacaataactatgggtatctta

SEQ ID NO: 203636 - DNA, 396 bp, Homo sapiens
gggaagtggagcaagggcagggataatttgtaggcattcaagctagaattattgccaagataggtggcttcagccacctctttgtacagaagagactgaagcacagagaagtggcttttgggaggatacaatggcatagagtagagagagcctagggcgaaagttctcaaccctggccacactttaaaattgctggaaggcatttaaaaagaagccccatggccagggctcatccagaggagttaataggattctgaagttgggccctggtcagtctcaaagtgattcaaacagcaggcagaatggagaaccactggacagcctggttggcagcctctgcacttcctgggttcagatctcgctcagctagtatggtacttgggcagttcacctgtc

SEQ ID NO: 203637 - DNA, 650 bp, Homo sapiens
caattgttatccgctatgtagactacgaggtaccgagccagctgcagaaccacatgatgaagcacaaggacatccggccctacatctgctcagagtgtggcatggagtttgtgcagccgcaccacctcaagcagcactccctcacccacaagggtgtgaaggagcataagtgtgggatttgtgggcgggagttcaccctgctggccaacatgaagcgacacgtgctgatccacaccaacatccgcgcctaccagtgtcacctctgctacaagagcttcgtgcagaagcagaccctcaaggcacacatgatcgtccactctgacgtgaagcctttcaaatgcaagctttgtgggaaggaattcaaccggatgcacaacctgatgggccacatgcacctgcactcagacagcaaacccttcaagtgcctctattgcccaagcaaattcaccctgaaggggaacctgacacgccacatgaaagtcaagcatggagtcatggagcggggccttcattcccaaggtctgggaagggggagaatcgccctggcacagacagccggtgtcctgaggagtctggagcaggaggagccctttgacctctctcagaagcgccgggccaaggtgccggtgttccagtcagacggggagagt

SEQ ID NO: 203638 - DNA, 722 bp, Homo sapiens
caaaggatgccatttcctgagacacgtcaaggtatctgcatcttagacagtggtgttaccatgtccgcacatcagtcagtgcattttctcttggccccaggccagtaatgtggttgtgtacactggtcacagctcaaaaaactgaaaaatgaactctgagctttactgcaaagaatgccagctaacaaaaataactctgccagagcagtgccctggacaggtttgcagctctgagatctaacagtgctgatgtatgggagtccagtagaatgcttaaaaagaaaggaaaaaatagaaaaaatccatctgctgtgccgttaacattccaaaaaggtaatgcccaagaactccaaatgggtcctaatgtgctgtttaagactcagaaaactcagctttaagttctacaccactctgtgctcccagactgggaacaaaaacagggtatttccgtgaagtgcaaatagatgattgtatggaggaatcagtgggtaggaattattttgctagcatgttaaaaatacttcaggtgtaggcatttcaagaaataataaagcccaatactctaacccttagaccagaacttggggctacagatggaatacaatgctttgaataaaactataacccctaccagagacctctttgaaaacacagcagtgctagtatggatgtgcttcccctagcatgcaattccccatggatccagccttattgcgtttctc

SEQ ID NO: 203639 - DNA, 428 bp, Homo sapiens
ccctggagagtgaacacgtagtttccagcctgggttgggatcgggtacttctttgagggatcttaagccaccatgacaaagggagggtgtggctgttgtcaatgaactcaccaggccaaattcagcccaaagatatgttgtatctagctcgtaccctgttataatttttaaaaagtaggtgtccacatttaaaagttgtggattttttaaaatgtttaaatccacatttaaaatggttaaatccacatttaaacattgccaaccacggtacttagcaacatctggatatttgaaagctcccaggtagccgagtgtggtggctcacgcctgttatcccagcactttgggagactgaggcgagaagattgcttgagcccaggacttcgagaccagcctgggcaacataagcaagaccctttctctacaaa

SEQ ID NO: 203640 - DNA, 746 bp, Homo sapiens
gacagagtcttgctctgtcacccaggctggagtggaatggcgccatctcggctcactgcaacatcgcctcctgggtacaagcagttctcagttctcatgcttcagccacctgagtagctgggacgacaggtgcgcaccaccgcacacggccaagtttctaaagtttgctctttcattttgtttgctttttatggctagcctctccagtttgaaatatacttaaaatgactgaattttttttaactggatactttactaaactctattctctaaggggaaacaaagttcactatgaaagttattacttttcagtacatgcaggcctcattgacacacattggtagaagctatatatttgaagaaggaatatctaacttagagaaaatttgcacgtaaggaaacaagtcctatttaaactcatttgaaaatactgagttaattgaaggcaaaagaatattagatgacacctaatactttcaaacttaatttaaaaacaaagaaagttctaaatatttttctccatgatgttccttcttcagttttcaaatcttgctctcacagggctgcatttcacctgcggctggtaaaatgagcatggaactcagcccacactagctaggaagggtcctacagggagctcctcaagcccagcacacctccccgccccctgggctgtgcctcatggagcaccatccagaattagtaaaaggtgtttccccaaaaaaagagctagagctccaagtttg

SEQ ID NO: 203641 - DNA, 178 bp, Homo sapiens
ctggtattcttgttggcatggagagtggtgattacagtaaaaactggtacaaactttttgatggaaaatatgtctgtatgacctagaagatttaaataattgtgtatttttcaataaaaatatttaaagcataaaattagaattttagcaattatttctgatagcattataggtaatt

SEQ ID NO: 203642 - DNA, 268 bp, Homo sapiens
actgtatatacagttatatgttccacataacattcttctcctgaggtattaaaacagaatattatttctttagttgatcatcagtaaagtagttgtcttgtgtttgggaaccattgtgaaagaaaaatatgtaggtttgctctgatgtttctttccctagtgcatcagttgaacttgtgagaatggacttcactgcaaactcattccatttgttgtaacggaaaaagccacagccaaggagccagaatattctcactctaggtttagt

SEQ ID NO: 203643 - DNA, 411 bp, Homo sapiens
  misc_feature (67)..(67): n is a, c, g, or t
  misc_feature (75)..(75): n is a, c, g, or t
  misc_feature (81)..(81): n is a, c, g, or t
  misc_feature (117)..(117): n is a, c, g, or t
ctttgtattcccccttgggttcaaagggggaaaccgtttccaaaaaaaaaaaaaaaaaaaaaagtgnaattgctnacccanatctacagttaactttcgttttttaatgcttgatgnatttgcatgtcattcttgggcacacattatggagaaatgttcattttgttctctcctacctcaaatttactggcttggaaagccaaggattgttcactttagttcacaatactaaaatgagtcagtccttgttaccttgtaagagaaaactcacttttgatctcacttaacttattggaggttatattgtgagcaaagggaagacatttgggtgaagtgctgcctcaggaaactaggaacacacagtccatttgaaaaggtaagtccaagagagtggtctgtagaaactgaatc

SEQ ID NO: 203644 - DNA, 393 bp, Homo sapiens
agcaaaaatacaggttaatgacagctcagatttgcagccatggcctcagagatatttatagccaggatttcttgctggttttgtctttgctggtttctgggctagagtgacatcctaagttggtcttgggcagaaatgttcattttgttctctcctacctcaaatttactggcttggaaagccaaggattgttcactttagttcacaatactaaaatgagtcagtccttgttaccttgtaagagaaaactcacttttgatctcacttaacttattggaggttatattgtgagcaaagggaagacatttgggtgaagtgctgcctcaggaaactaggaacacacagtccatttgaaaaggtaagtccaagagagtggtctgtagaaactgaatc

SEQ ID NO: 203645 - DNA, 581 bp, Homo sapiens
gacctgacctccaaaggcaggaggaaggaaaccacatgataaaaatcatcactctgaggggaggatgctttctgcgcagctagggctaaggaagttgtttcaaaacagactcaagaaacgtgtaggctgctgctaggagacttgggtccaactgctccctccagatcctgccacacctaaatgatcccaagaagataactatctcggagaagcagtgtgaggtaatggtttaatgctagggcgtggtcaacagccaggtgcaaaggccggctccgccacactaataactgtatggcattctctccaagccttgctttcctcatctgtaaacagagataacgcctgaccctatctctagcattcttctgattgtgaaattagataatgtatgtcataaatagcacagtctggtacataagtgtccaataaatgttggctattgttactggaaaggtgtctgtttccttcattagaccagttgaggggacctgagaacaaagacaaccccaacatttgtgtccccccacaaaaatttcttagatttaattatgagtttgtattttccatacggggttcatgca

SEQ ID NO: 203646 - DNA, 474 bp, Homo sapiens
gacctcagggaataggggtcgaaggggcggcgctcgtccgcggaggtgggcgggacggcccggggcctccggcctctagagagcgggagtgaccctcggtttctggcctccgaggggcgggagcgatcctcagccatgtccctagtgtctggcttccggctgatttttaaatttttggtagaggcgggatcttgctctgttgcccaggctggtctcgaacttgtggcctcaagcgatcctacctcctcggcctccccaagtgcggagattacagacagagccactgcgcacggccgtggtcagctttgaaagctgggtagatccctttggctcatacgcctttctgctagcttaccctgattctgcttctggttcagatagtattttaatatttctagtgtgtctttttctaagatatctgaaatctttttgtggaatgaagtggcatgaaaaataaaccaataatcattagta

SEQ ID NO: 203647 - DNA, 182 bp, Homo sapiens
gtggaggaggggtccagggtggggcgcctggaggcggagaccgggctccagactcttccagactacccagcacccggcaggtggccagggcctcgatggtgctacccacgcctgcccacgcccatctcctggctcagactcgcagcctcccccgattgaaggagcgccagaactctccctgg

SEQ ID NO: 203648 - DNA, 219 bp, Homo sapiens
ggaagttataaaaatttcaacataaagcgcagatctatcgtcttgttttctgctattcagagcactaaagacactgggttttgtgtctttatctgtgggtttctctagtttatccatttgatttactgagtttgtgtgaaaatattgattaaatcttttcttagaaccagttgagaaccatttgctactttccccagctctgatattaacttctaattt

SEQ ID NO: 203649 - DNA, 288 bp, Homo sapiens
caggcaggacttctatatctaccattgaaactctatattgactgtcttaagcaaatcactactattattttcaataaatgtgaatttttacattccacatacaggaaactaattaagaattgagaaacacattagggatataatgtcatctatagcatctcagacttcaaatggcttacaatttagttgggtggacccaggacataattcacaaggtccagtgtaaaatgaaaacgcaggactcctcattttaaaattattaggaaattcagtagagcaatagaagag

SEQ ID NO: 203650 - DNA, 552 bp, Homo sapiens
agaactggattcaccctccccaccatgtagttgtttggtggctttgggtgagtccagtaacctaagagttttatttcaagaaagggaaaggaggtagaaggttggcaataatacctagtttttcaacttttgggggttccgttgaataaaatgatgtcagtaaaagtattttgtagagtcctagaaaataatgatattattgtctctcccatccctccatcatcaacactgtagcagattcactgttttgttcttaccaaatcagtatttagcattgaatccactttaaggccaacaagagggtagcgtgcacatttttaaagagctgactatttctcactatttctcaggcactagatgattgtgggggttcaatgcattgattaatttgcatatcagtcattcagaatgtatggccatccagataagggttatgctggcttaagtttacaatctagattatctataaagaccttgctgagcaaattaataaagtaagcacgattgagacagaaaaacagttataccaaaacctcttcaggagttcatttt

SEQ ID NO: 203651 - DNA, 158 bp, Homo sapiens
atgcagcaccaatcttggggcagaggtgaaatcaccacccggctagcgactggcaaggctcagaaggacttgctttcctaaaatctcctcccctggtctcataattccctgtagcagcttggggcttgggtgtgtgcacacctaatttctctgagaac

SEQ ID NO: 203652 - DNA, 328 bp, Homo sapiens
caaatgttcacacgctaacactgccagtaggttgaggaaaggatggtggcaacgtttcccagtgactgcaggcttgtgtcctcgctcagggcacactccccagaatccaagcctaaggtaaggaggccaaattagtgtcatgagaggccctgtgggaggggttggaaccagagggctgcagccacagaaggacctttctttaccctggtgggcctgatgtgcccacgggagcacaatcccttgatctgcagcttccaccccagagtgtgctggacacacttctgcacactgaacctgagcctttttgcttcacccgcttctgtggaat

SEQ ID NO: 203653 - DNA, 289 bp, Homo sapiens
atgttgcctgaactttgactggtttaagttggtttcatttatttcataagaactcttgttaaggggtgcaccttggtattttgatattattctcttgatagtcataataatagttccctggtgtgctgcatcctctcaagtcataaatgttttgtatgcagccatacattgagaattgaatggtctcacttcaactaggtcagcaagaacataaagaatcatttacctagtgtgaagttgtgacttgtgaacttcatagtgacaccaataaagacttgtgaactccata

SEQ ID NO: 203654 - DNA, 231 bp, Homo sapiens
agaatcgcttgaacccgggaggcggaggttgcagtgagccaggatcacgccattgcactccagcctgggcaacaagagtgaaattatgtctaaaaaaaaaagagagagtgaaaatatagagatagcaagtattatagatatgctcttctatgattgacagtacttctgaccagtcagtggcaattattagtgcttgggcatgttttggtatacaatttctaacagactttt

SEQ ID NO: 203655 - DNA, 405 bp, Homo sapiens
acacctactgagtctaaaaggagaagttagagtaagaggaaagagaatgaacataaagagcagcatgggcaaagataagatgctgggaagggcaggacgctgcaagaagttcagagttgctggagtggagttgagaatctcaagggcagagtagatgacaaataaccaccacttctgcacacaaggagtatagtctgctctaataaaagcttgtctgctataggctggttgtgaggagccactgcgggggtctagcagtggggtgacagaaacagatctgcatcctaaatagactgccttgtggctgcgcagaggacagaaggcagtgggacaatccacataggagactgaataagagagagttgaacagggattgaggcaggtcagtgatggcaggatggagag

SEQ ID NO: 203656 - DNA, 267 bp, Homo sapiens
ccactgttcccagctgagcacatgacatgcaccatcccagctatctgtgaggcaggtacagtcatcagcccgctttacagaggaaggtctggggctaaaagaagttccaccatgtgttacagagctggagcttgctccccatccttttcgttttgtttcgttttgttttgttttttgagatagagtctcactctgtcacccgggctggagtacagtggcacaatcttggctcactgcaacctctgcctcctgggttcaagcgattct

SEQ ID NO: 203657 - DNA, 309 bp, Homo sapiens
acatctcaggttcctctatataggtaatgttaagactatactttttaaaaatgttgctttagattaacgttattttaaaataatagctaatcaaaactttatcttattaaactctaaaagcatagatatttctctagaaatacagatgatgaatgggtggatagatgacagttaatagatggattccaagggtttaaagatgatagatagatgatagatagataggtagatagacagacagatagatagatagatagatagatagatagatagatagatagatagacagatgacagatagataatagat

SEQ ID NO: 203658 - DNA, 854 bp, Homo sapiens
cttctgcaggtaatgggaagctagagagggtttaaagcaggaatgaggtgggaaggcactcagaggagactgatgttaccggagacatacttgtggaatctctggcagcagtgtgtgtgatgggccagggctggggctgagtgaggggatttgccaggcagggaaatcagctgggggctggcagcaacagtcctctccagctgctctcagtggggttgggatggagaggagaggactgatgtatgagaatactggttgggggttgggtaatctcaacatggggactgctgctgtgggaggtgggagagaagggaaagcatgaggtgacttcagagtttcaaacctgtgaggtgtccaggggaaaataacaaggcatgcctctggcactgatgtagaagtcagactgtggcattccaggaagtgaaactaccaggaaatcgggaaaggcactcagaggccacaagtcactgtgatccaggacaaagttttccttaggtcttggagagctcaacattcgaaatggagagggcaaagggagacctttatctgctgtgggaacagaataaactgtctgggttctgtcctgccttcctcagaacgcagcacagctatcctgggatctccagtgctccttaacagatctagttatcggtccccacgggcactttctggaacctgtagaataggcaagcattaaatgcagtcattcagacttcctcaccctaacatatccttttgcataattggctttaggtctagatttgattagttaatgattctagaaggcctggagaaaataatgccatggttagccggccctcctgagaacagatttcttattcaccttttttgcc

SEQ ID NO: 203659 - DNA, 435 bp, Homo sapiens
aaggaattagctttgtagatcactttgtgtggcgtgggcattttaatattaattcttccaattcatgaacacgggatacaattttacttgtgtattctacattttctgtcattaatgttttacagttttcaatgtggagatagttcacctccatggttaaacttatttgtaaaaattttgttcttcattaagaagcaaacaacagacactgggttctacttgagtgaggagggtgagaggagggaaaggagtagaaaatataaatattgggtactgggcttagtatctctgtgatgaaataatatgttcaacaaagccccaacatatgtgtttacctaatgtaacacaccttcacatgtaccttcaaatgtaaaataaaagctagaaaaaaaaacctttctctactattaaaagtgtatctggctatagctatta

SEQ ID NO: 203660 - DNA, 280 bp, Homo sapiens
atccctattgtcacagaaacttccagagaagcagacagtaccactgtgtatttgaacattcactaaaataatgttttctatggttagaaaaacacatacaaacacatacacacactttgttagagtgtcttataacttaagctcttgttcctaaataaaaatatatttctggaaatttctttcagaggaggactaacttctacacaagatgcattgtacacattgatgagttaaacagttcacatgaaaataaccctttttatttataggctttgggaac

SEQ ID NO: 203661 - DNA, 367 bp, Homo sapiens
ctgatactgagattttcctattcctccagcaattaaaaacagggagggaaaggagaaatggaagaacagatacaatcgcccaagggtaataatctgcaaagatagtaatgcctacttttttcagaaattatgaatatggattagctacattttttattatgcataagctatacattttgtgtttttaatataagaaatttttgccagtcacagcgcatatgcctataatcccagctgctcaggagtctgagacgggggatcaagagatctttgaaccaggagttcaaagctgcagtatactgtaatcatgcctgtgaataggcactacactccagcctgggcaatataatagcaagatcccttctca

SEQ ID NO: 203662 - DNA, 475 bp, Homo sapiens
gtgataaagaaaaaatgcaaaacttaatttcacttccctgctacactgctcattcttttttaataaccctctcttatcagcctcctggcagcttttgcacttcctgtgcatgttaattactttattaattacattgatatctttggttctgcccagcatttcttggtactttttgtttgcaacgtgcacccattttgccttgctcattggcatatgcgggcccagttcccatttctaaaagggattctttgagcctcggtaaacacatggctttcaattagtcgcacaatcatcatttcccatttttcaaatcagccacgtcactaatagagtgtttttaacattctcccaaatagaggctgtattgttaagtttctgacattcttcctcaatccttgttttctctccacgtcacagctcaaagaaccccatataccctagcatggagtgagatgctagacactaagaagtctag

SEQ ID NO: 203663 - DNA, 133 bp, Homo sapiens
agcactgggtgagaactctggagtctaaggttcaagtcccggttctgcctccatcaagctgtgtgccttagggaaatggccttctcttctgggcttccttctccaaaaatgaaggggctggacttgcagattt

SEQ ID NO: 203664 - DNA, 433 bp, Homo sapiens
cagagtgtgatcaaagcccagctcagctctcctctggtcgccgaatacctgtctggggcacattggagaggagcaggggacctgactgtgcccatcaagacagcgactgccattttctgtgcctccaggactggggtcatcatcagggctgtgcatacagtagggacaaaaagctctcatttttccatctggcattcctcatctctggatcggcatgggcagcagtaaattccaggagagaccttagccaaccatcccctttgtttcctgaaagaagagaggtttatgttctcctggaaggctgaccagcagtaacttagggaagccacaggccagcagcacactgaaatgcagatgtgattagataaacgagggagcaaaggcatgttgtgtcattatagctttacataaactctccttttccaataagctc

SEQ ID NO: 203665 - DNA, 347 bp, Homo sapiens
cttgagccataaagatctactccctgattctctaacttgcatagggtataagctcgggtctcatgcgggtggaagtctgggtcgtggaatgctgagtgtctactggtccacttatgataggcagaactggtgctgcgcgatgaaccgtgcgccgggttaaagcgctcgatgccgactctcatcataccccatataagtggtcggttgatatatgacagcaggacggtggccatggaagtcggaatccgctaaggagtgtgtaacaactcacctgccgaatcaactagccctgaaaatggatggcgctggagcgtcgggcccatacccggccgtcgccggcagtcgag

SEQ ID NO: 203666 - DNA, 341 bp, Homo sapiens
taccccggaatttgatccaactatactcaaactttaaatgttaagaagcacggatcactaggcagtggagccgaggagtgaatgcgagtgactagtggagccaatatttggtaagacagaactggcgctgcgggatgaaccgaacgccgggttaaggcgcccgatgccgacgctcatcagaccccagaaaaggtgtaggttgatatagacagcaggacggtggccatggaagtcggaatccgctaaggagtgtgtaacaactcacctgccgaatcaactagccctgaaaatggatggcgctggagcgtcgggcccatacccggccgtcgccggcagtcgag

SEQ ID NO: 203667 - DNA, 434 bp, Homo sapiens
tgctttaattttaaacgaatgtgtagacaaaggattcctggacatcctccagtttatctcatgctagaaaagacagcaagaaataccaagttagaatgttattaactctgaaaaattctctttaggtcccatgtgtaaaatactatcttaaaaaccaaattggccagtcatggtggtttacatctgtaatctcagcactttgggaggccaagccaggaagatcacttgagaccagcctgggaaacatggcaataccctatctctacagaaaaatttaagaagtagctgggcatggtggcatgcagctgtggtcctagctacttaggaagctgaggagggaggatcatgtgagcccaggaggttgaggctgcagtgaaacataattgcaccattgcagtacagcctgggaaacagagccagacactatctcaaga

SEQ ID NO: 203668 - DNA, 571 bp, Homo sapiens
tagttcagggcttatctctcacctggcttcaggtgatagcttctaaggcacttcttggactcctgcctctccaaacaccaacccctctccctaccaagccactccccacactgtgcatgcaaatccacttggaaagttaagagagaagaataatgtttatgctatggacagtaggtgccaggctctgtgtcagcaactctgcatgcataatctcattctgtttcacaactatattttacatatgtggacacgggcttaaagagtcatttgctcggtcaccctaagggaagaatcaaggaaaaagggaggcaggaccccagaagtatgccaacatataacaccctaaatcaaaggtcaaatgccgcacttgacctccaagatgcctgcttgggcctcttccaagtgtactttcctttctttcattcctgctctaaagctttttaataaacttccattcctgttctgaaaaaaaattattcatgaatattttatacttttatcctattatgaatgaaatgttctaattgtttaccacaagtacatacaaataaaattgctttgtgtatattga

SEQ ID NO: 203669 - DNA, 218 bp, Homo sapiens
attctggaatccggttctgattattctctggagagctacttaagagctgcttcagggtttaaaatccctcattcagacctaatcttgaaataaaagactacatttaaatgaaaaatacattacagctttctctttagggccgtcagtactgatgggcaggataaaggaaggcattgaaggaaaatgaaggagaagagtaagagagaaaagaaaaatgg

SEQ ID NO: 203670 - DNA, 264 bp, Homo sapiens
atcagattaaaaccagatgactgttacagaaagaggccagtcctcagcaatggcaaaggaagtaacaggatcacaaccctgaaggatacatccaagatatttcaaatcagatttgaaaatcaacagaaatcaaaggcaccctaatccagatggcaggtgccacgctgacggcaggcagtattcacacttcccatgcatcgactgcctggcatggaagctcccatgccatctccagctgacagatggggcgggactgaagcacag

SEQ ID NO: 203671 - DNA, 485 bp, Homo sapiens
acctgagctgggtcgctctttctgaccattcctcccccagcctgtccattccccattggtgggggctgcactggccccagctcagggcatttgaggaggagctttttgtctgaattctgaatctgctgagttcaaaagtctcagagattctaaaatcacatgatcacatttcaacttgcttgtaatgaattgggtgacgcgggatccaacctgtccgggagcttgtaatgaattgggtgatgcccattccgacctgtccgggagccagggtcccagccttcaggcccctgccccctgctctctttcagagcagactgtgggtgtttaccgtttggtgacacttccgctccttctcttttcctgtcttcttccttccattgttcctctttctctgccacttcttcccaaatggttcatcccaagcaccatcatgagagatcagaaataaaaccagtgaggaaggaaataaagatattgtagttctc

SEQ ID NO: 203672 - DNA, 716 bp, Homo sapiens
aattaataggcttctcaccaggaatttatcgtttagttaggctcagatatcacacacaaaacattaaataattttgaaatcattatttaaaagcccaggaggccctacacttacccacaggaaggaatctatgagagatctcgccttgacccgcaggcatcatgcttgttcagcctggaaagtgaaatggggcaatagaaaggaatcagacagccaatctctgttttttgttaagttttgtgtgtgtgtgtgggtacatagtatgtgtgtatatttatcaggtacatgagatgttttgatacaggcatgcagtgtgaaataagcacatcatggagaatggaatatccatcctgtcactgtttttaacacatcactccttgaatagcatgtatttcttacagcacatttattagacccatttcacttctttcttcagatcccacataacgtctcaagaaacattgtatttgcaaaatagcttccattggccacacttagatataatgttcacagaacatttgttatgctaggctcttgtctgtttgttcaaaatgtagaccaacttcaactatgaatttatgagttcaactatgagtttctaggcagcataatgggcatcttgtacctaactcgtggggctcagcttccaagatattcattcgttcattcattaacattcattcatttattcattcaacacttgccaagtgtgtact

SEQ ID NO: 203673 - DNA, 475 bp, Homo sapiens
cactttgcataagctgaaataagtcaaagttcctctaaactgccaacgtcaaccacaacatttttccagggaagataagcaggttggagtatcacgttgcacaagcatgactcttaacgtgcccacaacatccatgcaatgtgctctcagggtggcagctgcggctcctgcacccctgttgacaggcgacccccatgggttcccagggactggaagtttatttgcatgaagcttatcaagttccttctaacgtcccccaaacatatgtgcccagaacaaattatgtatcgtctctgtcttcactgagctacaccctgaaaacagatgtcaacaacgaacgctgcctggatgggaagcagggagcaaagtccccttggcttctgtccccatcaaagcagacgggggtggagagagaaaacagtgacattgaagattaaggaaaaattagcccaggaccctttaccctttactttct

SEQ ID NO: 203674 - DNA, 328 bp, Homo sapiens
ggcgctcagaggatccctcataggtcgcaggatggtttattataaaggctcttttttgattttcctatcttatttacctgaatttagatattttaactttgttaaaacaaactatatgtaatgaggggcctttgaaaagtggtcttgccttttcctgatataatgtgggaagataaaaagctaagaactaaatatttactttttattgttgattcactgaatgaaaaaatttgctttttctgtttttttaaacctataactagagatgttaatctgactatctgaaatggattcatgaaaaaatctgagatctgcgaaacacctttta

SEQ ID NO: 203675 - DNA, 335 bp, Homo sapiens
taactcagatgttggttaattagtaatatagggatactccacttgttattgcgactttgatctaaacagctctgtaaagcccattttcacatttttaaaataatatgctttagcagcaggtgaggaaaacttaaggcatggcacatttattggaaaagcagcagtgggcggcttggtttaatggcaacaccactagataactgtctaaggccctttccagatccaatggtcaaggtaacaggtaagtaagatagactccaaaggcaggggtttgaggggagtggggagtgctggtgagacatcagaatgaaaattgtttatttcacatggagctc

SEQ ID NO: 203676 - DNA, 881 bp, Homo sapiens
cacaattactattctaatactcttctgtttttaacaggtatttagcacacttcttgaaagcataacaaatagatccattaaatatattaggaatgttttaggttagtagagggtatgattgaataacatgattaaaaaaaaaaacaccagaacttttatttttttagtacacacgaataaggcctccatcaaagtaatgctcttagaaaagtatttacttattccgacaatgattcctctgcccagcatatttttggaattcttttaatgatattttctgcagcatttatccaataaacactgacgtaactgatttgccttttggtctacaatacaatcttataaatatgctctgtgttaaaacagaatatccctcttttctttcccctccctctttccatattcagcagaaacaaagaaaatctcagaggtctcttcttatgtctctgctaacaataaaaagaacagcttttggggaagtgggctgctttatcctgtagccctcctcagatgccaagactgctgggctggccaccagactcacgtcctcaagagagtgtctcactatgttgcccaggctggtctcaaattcctggcctcaagcaatcttcccacttcagcctcccaaagtgctgggactacaggcacatgccaccatgcccagccgcaagtgtttatccccattccatagggggtgaaactgaggcacaaaaagaggaaatcaccatcaggatatgccactgcagagagatataagatgagagtaattcagcttcatgggttattttcaaaaagtaaggaagaaactgcaacaagaactgaatcacgctttactacagcattgccttctacttcctccaccagccaactgggagatgaac

SEQ ID NO: 203677 - DNA, 715 bp, Homo sapiens
taactcagatgttggttaattagtaatatagggatactccacttgttattgcgactttgatctaaacagctctgtaaagcccattttcacatttttaaaataatatgctttagcagcaggtgaggaaaacttaaggcatggcacatttattggaaaagcagcagtgggcggcttggtttaatggcaacaccactagataactgtctaaggccctttccagatccaatggtcaaggtaacagcagaaacaaagaaaatctcagaggtctcttcttatgtctctgctaacaataaaaagaacagcttttggggaagtgggctgctttatcctgtagccctcctcagatgccaagactgctgggctggccaccagactcacgtcctcaagagagtgtctcactatgttgcccaggctggtctcaaattcctggcctcaagcaatcttcccacttcagcctcccaaagtgctgggactacaggcacatgccaccatgcccagccgcaagtgtttatccccattccatagggggtgaaactgaggcacaaaaagaggaaatcaccatcaggatatgccactgcagagagatataagatgagagtaattcagcttcatgggttattttcaaaaagtaaggaagaaactgcaacaagaactgaatcacgctttactacagcattgccttctacttcctccaccagccaactgggagatgaac

SEQ ID NO: 203678 - DNA, 358 bp, Homo sapiens
aactcttccggcatataacatttatcaacttatgaggtcacattaccatgataccaaaaccagatatcaacaagaaaactataaaccagtatctcaaacagatatatgtaaaaattgcaacaaaacatttacaaatagatgctggcagtttataaaaagctgaaggatgcccatgtaagcaaaaacaaaaaagaaaaaaccaagaaaaataaacccaaacccctcaaacaatttcgaacacaaaacattcttctcacgccggcatccctgcttgcaggtgtgaggggggcaggaatcagcgaggtgtcctgggctgagtccccggagtgggaagaggtggccggaagaagaaaatgat

SEQ ID NO: 203679 - DNA, 461 bp, Homo sapiens
cagagaattttataatttacatctggtcttagtccattcagggtgctataacagaataccatattctgggtggcttatgagcaacaaaaatttatttcttacagttttggaggctgggaaatctaggatccaagcacggcagattttgtatctggtgagggccagcttcttggtttgtagttgaccatcttcttgctgtgtcttcatatgggaaaaagggcaagggaactctccagatttcttttataaggatactaatctcattgattaggtctctgccctgatgaactaatcacctaccaaaggcttcatctcctaataccttcacattagatgttagaattttaacgtatgattttgtgggggaggacacaaacattcagtctatagtgcatctcttgtgcaggatcatgctggacactgcagttgttgctttgggtgacatttaaacattgagcata

SEQ ID NO: 203680 - DNA, 513 bp, Homo sapiens
cactagaatggctaaaattaaagactgatcataccaagtgttgatgaggatgtggaagaattggaaccctgagactgccagaaatgttaaaacactctttaaaacagtttgacaatttctaaaagagttaaccatgcattcatcctatcatccagctattctactgatatgtattttacccaagataatttatagcacatatccatacaaagccttgtccataaatgtttatatcagctttatttataataaccaaaacctggaaacaaaccaactgttcactaacaggtaaatgaacaaattgtgcatttctatataggaaaaaaactacacaacaatttaaaaaatgaactgttgatatgcccaacaatgtgaatgaatctcaacataatcatgacaagtgaaggaaaccagattaaaaagagagcacatactgtatgccttgatctatataaaactattgaaaatgcaaactagtaatcataatcattcattgactggtgagacagaaga

SEQ ID NO: 203681 - DNA, 494 bp, Homo sapiens
gaggggcacccgccagatgccagttggagctctcctgtatgaagtgtctgtcaacacctgctgggaggtatctccccatcagaaggcaggggggtcagggacccacttgaggaggcagtctgtcccttagcagagctcgagcactctgctgggagatccgctgctctcttcagagctggcaggcaggaacatttatgtctgctgaagctgtgcccacaaccgccacttcccccaggtgctctgtcccagggagatgggagttttatctataagctctgagtggggctgctgcctttctttcagagttgctgagcttagagaagaggaatctagagaggcagtcagtctggctacagtgactttgtggcactgtggtttttttaatgtcaaaagtacagaatataaattccacaaattgtgacagtcaacttgatgttgattctgaaataaatttaaattgcattattaaaagatggtttgtggcccagtgcggt

SEQ ID NO: 203682 - DNA, 314 bp, Homo sapiens
ttttgcttttgctcaattggtttcctttttgatcatcttcctaaagtttttcagttttgatttaggaagtttgttttctgtcgataagaatattaacataacagttttaaaattaacatagggatcgagaaccatgtacctagtggtatttttagtacataataggtctgcaataaacaaaattcttggaattttgacttgatggttttattcttttttttttttttgagacggagtctcactctgtcgcccgggctggagtgcagtggcgcaatctcggctcactgcaacctccacctcctgggttcaagtga

SEQ ID NO: 203683 - DNA, 336 bp, Homo sapiens
tttagtgagcaccatcccgggtttatctccagataccaacagtctatagccttaggtggggaaactgaggcacgggggcttggaatcactttttcagcgtcacacagcaggccaggggcagaggagaatttgagaccatgctccatgaacctcaactatgaggctaaggtggggtttctcaacctccacactgttgacagctgaggctggataattcttcatggttggggggctgccttgggcattcattgtaagacttcaagcagcatgcctggcctctacctgctacatgccagtagcactctcttagtcctaataaacagaaatgttgaggca

SEQ ID NO: 203684 - DNA, 357 bp, Homo sapiens
ttactatacaaggtaaatgaatataaaaacaaaacgaaacaaaaacctcttcctatttacataaggccccaacctaatatttagtgatatatattaatgtgaacaaggaactaacgaagactgggaagaaattcacagacttgagagaagaaatggcaggatttcctgggaacaatttcatgtaacgtcaaaggtggtaaaaggtcaaatagaatgaagatggagaataccggattttcttacaaaatgatttcccaggagatctcatcaaatgcacgaggataccttctcagtttcacctagtgagtaaaagactggtaacatagctcacttacaatttggataaacaaaactaaa

SEQ ID NO: 203685 - DNA, 239 bp, Homo sapiens
gcattttgtaagtgtcatgtaggaggtatcatgctgaggtgctgcatgcagtgttacactcctaacaatagccttatgggggaagttctcttatgagtccttttggtagacaatgaagctgaaactcaggaaggtcacatggtatcataaggctggtaagcattggagtggggctggcagggatgctggacaaggttgcagacatgagagccttcctgagttgcggaagtgtgtggccc

SEQ ID NO: 203686 - DNA, 559 bp, Homo sapiens
tcggctcgactctgaggatccccacgcgcaccgcggtcaaacttggaaaaaatcctaatattagaagttatctttaaataggatctttattcagaagcaaatgtaggaaactgatcaaagggagcaagctgcttttgttgaagcaggcagcagaggctaaatggtgttgctcacaagactaggggcttggggaaggatcagaggggctcaagaagtagggaaagggtgaattctggtaggccatggctgccaggtgaagttggaactgaaatctgcagcattaggtttcagcaatgaaaggaacagctgggaaaaacagcctggtctggttagttgtgggcctgctgcatttggagaaagaaacaagccaagctaggaaagcacagtacagaactgggtgcagggggaggtgggaagtcaggaatgatcactgtcctctctctgtctcggtttcctcctctgaagtcctttgtcatttgaatgctctttgattctctctctccattattccagtgttcccctttgaaccgcggtggcgtggggtgcatcaatggatgat

SEQ ID NO: 203687 - DNA, 821 bp, Homo sapiens
tagtgaccatgacattaaggagagaaggaagagaagtaagccgaggcgtctttgattgtgtagtaagggtggaaggtgattttatcggaatgggaggtgatacctagggggttgtttagatcccgtttcgtgcaagaataggaggtggagtgctgctagggctgcaataatgaagggtacgatgaagtgaaaggtaaagaatcgtgtgagggtgggactgtctactgagtagcctcctcagattcattgaactaggtctgtcccaatgtcatgggtcaccagtcgtcacgccgcaccgtcaaacttggaaaaaatcctaatattagaagttatctttaaataggatctttattcagaagcaaatgtaggaaactgatcaaagggagcaagctgcttttgttgaagcaggcagcagaggctaaatggtgttgctcacaagactaggggcttggggaaggatcagaggggctcaagaagtagggaaagggtgaattctggtaggccatggctgccaggtgaagttggaactgaaatctgcagcattaggtttcagcaatgaaaggaacagctgggaaaaacagcctggtctggttagttgtgggcctgctgcatttggagaaagaaacaagccaagctaggaaagcacagtacagaactgggtgcagggggaggtgggaagtcaggaatgatcactgtcctctctctgtctcggtttcctcctctgaagtcctttgtcatttgaatgctctttgattctctctctccattattccagtgttcccctttgaaccgcggtggcgtggggtgcatcaatggatgat

SEQ ID NO: 203688 - DNA, 307 bp, Homo sapiens
caagcagttaatacagactcatttcagtactctagcaattaccacacaatacttcaaaagcttgacttgctgtaatcactcatacttatttactgaattaactgtcataaaattatgacattatttctaaaacccaatgaattactgtatacatttcctgctacatgtgggatgtactttattcacttgagtttgagcaaataaactacttatcaaagaaaattttgagtagagggcacaagatatttggtgtatgtttgctgttgtgtgtgtgcgcgctctatgtgagtgagtctgtagtactgct

SEQ ID NO: 203689 - DNA, 987 bp, Homo sapiens
tatatatatatatacatatacatacatatatgagttggagatggaaatttgttttaaatatctaacagcttattggctgcacttccaaatcagagcagaataaaatagaaagggagaaataaaataaattatacataacttactaatctgggaacagctgaccattattattattattactattattattattattttatcatcatcatcattacaacactagcaaaaagaggcagttcaaatgtaaataaagtcatcaaaaacaaacaaacagaaaaacaaacaaaatgaaatctctgacatgcaggatatgatcagctcctccaagcaaaaccccagagcaagtcttctgagagagagaaaaataaaagggattcttttttatttatatgtaaaaatccaactttagggtggtgtttcggggggtgagataggaaaatgatgactggagtgaaaactatagcacatcaagctactagttgcagtatttactatctatctgatacttcaatacaaataatggcaattgacttgaaatgattttgcatttatttgtacaggccctacaactgccttggcatttggctggcaaaatctacataagcagtcccatcacattcagttgttgctctttgcaaatactctgcttgaaccaaagttggacttcagtggattaatctgacagcaagggaagagcagtggcaaggatccctgggtgcagccaggctccattttattgggctgcaatgacttttaattaaatcctactttttatggcatgaactacatgtggcccacacttctgaaatgctaaaggcctccacctcacttcatggaggggtgaaaaataccttataaaatcatcagtttcatttcctgatcgggaaaggatggaatgttgaagaaataagctaattctatttgtctgaaaaaatggccaaatatattcaatgaaaacaatgattgttttgctcaaaatatcaacag

SEQ ID NO: 203690 - DNA, 605 bp, Homo sapiens
ctaaaaagatgtgccatgttgcaggatttctctaaggtttgagacattttagttccagtagcttcttcgttaggaggtgctgctcctagatgcaaatactttggatttattattgcttatgcagtcatcagacaacctagccacctccaccaattttgctacaaatgcatttgccccataaactcaaatggtgccaactgctatcatgggtttgaagacaaatcctaaaatttttgtagcaaaaactttgaatagcctgcctgcttttcctttttaaaataacatttactatttttaaaaataaaagtagcacatattcagtgtagcactttttgaaatataaaaaagtgtgaagatgaaggaatagaatattattgataattccatcacccatgtgtgagtatgttaagactccctgcggaccttggagtcttctgcctgattcacgttagatgtggttttctttgttccaccactcctcttctcttctctgctcatagttgccctttctctcatgtctcctgtctccttttgtgtctgtgattttggctcattgactctgcctttggggtactcacttgcttcctttggaaacttcactgggg

SEQ ID NO: 203691 - DNA, 438 bp, Homo sapiens
gaactgctgggtatcttaacaccatcacctactgagttcagaatgggcatctgaccccccaagccccatctcttcctctcactgtcaacccttttttcagttaaagcggctccatccttccaggtgcttgggccagaccttgaaaccactgactcctttcttattccccacatccaatgcttcagcaaatcctgtcagctgtgccttcagagcacctccagaatctcagtggacccactcccatctcatcaccatctttggtcctgttttatttattttttgaaatggagagtctcactcttcctcccaggctggagtgcagtggtgtcatcttggctgactgcagtctccacctcctgggttctgcctcagtctcctgagtagatgggactataggcgtgtgccaccatgcctggctaatttctttttcttttttct

SEQ ID NO: 203692 - DNA, 1076 bp, Homo sapiens
attgctaacattcatttgttatgaactatggattatgtaatcacctaacaacccatgagacacaaagtactattacgtccattttacaaatgagaaaacaagtacagagaggttaaataattcatccaagctctcatggccaggatgtgataaagcctaattttgaatccaggcagtctagtttttgagcttatcctcttaatcattatttgactctaaaattcattttagtacagttttatgaacagaggactcaggtatatgcaaaagtgtaaagtacagggaaaaaatggagaaagaacgtgatcacattccaagttgaggttaatagtgccttgaatgtgcccagttttcctgggtagaggggctaggtttgaagttgatccttcccagttacggtaactctcctacttcctccaaggtaagtgtttttcctggtgcagttaaggtgcctcatgatgaaaatgtcatctaactctctgcatctgtttattttggtaccatttaaccaacatttgttttgactgagttttcaagtaggccttgccttccacacattggctgctttctaggaactgggaaatgttgcttcttaagggtcttcacgttggtggttagtgacagaattgtgcagtctctagacgaaggtgtagatggatttgggtgtacaccatgtgcatatggagccttatttcagtttcattgtgcctgctgtaatactaaatctgagttggaatgtgttacacaatttttatgaacataatcaacttttgattatctttgtccatgtagagaaatagcagtttttgtaagcttaaggtgatttgtgttttgtttggattatttctaaacaaacatgtttccatatgagaggagctgattattcaggcattcaaataaaagactggaagctatattggtgagagatggaacattgtcctgtttctctgactctcacactttatgttaagcagcaacttgagcagagtctatggccctgtgggaagtggctgagtaatttacttaacagagcttgtctttgataatagcccaagttgggggttagtggtctgaga

SEQ ID NO: 203693 - DNA, 271 bp, Homo sapiens
cagtgccagatgataagacaatgcagaagcaacagtgccagaacacaaagttgatgttagacatccgacagaagggttccgattattcaagattgcttttgacttccttcatggcacagacccttctgatacaggcactgaaaactacacaaatggagaaaaaaggatgagtatcatatacaaatattttttaaaaaaatgaaaaagcaaaaaagttgaattacagtgtttctttaaagttgcaggtgtgcctgcttcatgcctccccttc

SEQ ID NO: 203694 - DNA, 662 bp, Homo sapiens
gagaatgaatttcctttgaatcccaaatatgccaaagactaaatgaatactgatatagtttcagatactcttgaatagtgctattaaataaacaacaacaaaaaagatccatgtaattcaatcagcaagactttggagtaaagggaattccttttgacaacattttgtttattgaaaaataaacgagagacccttcctcccgcaagcaatttacaatccaacagggaagataagacacacctgcaaataactgaaactacaccttgaaaggtggtaagtcccaaaggagaggtataaataaaacacttatttcctccacctccctattccaacatcacagtaagaatttcaggagtggctagcaagcaaatctagctcgtgactagttcacagcagccccacccatggtgcttcggtggaggctcaggaatccctcgaagacagagaccagccagaagtggctgagagtcaacgccattacttcccacacctccttccacacacattaaaaaagggttgcagtttgcttattataaaatgcttcctgaaatacagtgaagtgaacaataggcagttttcaaaagtaaacagtataattacaacattttatcactttttaaagtgtgtgactgtctctcagagtattttcctagtatgcattt

SEQ ID NO: 203695 - DNA, 311 bp, Homo sapiens
gggtcgtcagaggacccaaaagtgcactcttctatatctactgttactttaatggaggctcctagatgtcagctatttgatgaaactgtctcctacaacttagtttttactctaaatatatatttctcttctttaatctataaatctcacaaagaaagttagttctcagctttggtaattgtctgcctggcaagtggtctcttcctgggtgtttaaacaaacttactctgttttctgaattcttagccaaagcataaacttagttgtgagatttgtagatatagaagagtgcactttaaggatcctctaga

SEQ ID NO: 203696 - DNA, 108 bp, Homo sapiens
tccccttgtccaactctctgatatgaactcgacttttagatgaagatgttcactgggcaccaagaacaaacctcctgttcacttccatggtgccctgaagaaatcctt

SEQ ID NO: 203697 - DNA, 137 bp, Homo sapiens
ggggagaaatatatatccatactaacatacagtacatgttgtgtggtaaagtagcacaaatgggcaaatatttaggtatttaaattagttattttgaatatttctcaaactgaagtataatcaatctttcttttttt

SEQ ID NO: 203698 - DNA, 410 bp, Homo sapiens
ctgagattacaggtgtgagccactgtgcccagcctaaatataaaggattttaaatggacagttgaggtggggatggaggcagatgaaattgttccagtagcttattttgcaattacagtattcagttgagttgcacttttaatgttttaaccaatcaaaatgggctgagcacggtggctcatgcctgtaaccccagcattttgggagactggggcaggcagattgcttgagttcaagaccagtctgggcaacatggttagactcctgtctctaccaaaaatacaaaaaattagctgggtatggtggcatgtgcctgtggtctcagctactcgaggctggattgggagggctgcttgagcctgtgaggcagaagttgcagtgagccaacattgcgccactgcactccaacc

SEQ ID NO: 203699 - DNA, 567 bp, Homo sapiens
tgggttcaagcaattctgcctcagcttcctgagtagctgggattataggtgcctgccaccatgcacagctaatttttgtatttttagtagagacaaggttttgccctgttagccaggctgggctgttctcgaactcctgacctcaagtgatcctcccaccttggcctctcaaagtgttgggattactgtgccccgtcttaatcagttatttttgagggttatgggtaaacatacacaaaggtgaccttaataccaaatgtgatagagtgatctgcatcttacttatttaaaactatatattctgagagaatttggtcagagaattcgataggattatccaggaatgattaaatcaaattgacatggtctttacttgcagacagataagctgtttgtatacatatgtctatgtgatactaactttgaacatcaagactatatatttgcgtgcatatgtgtatatatcttttcttttcttttttttttgaggtggaggttgcagtgagccgagattatgccactgcactccagcctgcgtcacagagttgtttttgttttgttttgttt

SEQ ID NO: 203700 - DNA, 473 bp, Homo sapiens
cttccagacctgtatattaagggacattactgtaagtaggaccaaaaagagtcctcggtaattctcctcttctggcaagaaaatgagtaaaacatactaaccgcattgtccaaggaatagaattggtcaccgacatgacaaaaaactcaaaagttccaggaggtggttgtccatttttgatccctattctgttaacctatctggcttctgccaaagccagatggattatcagatgaatgcacattagcataaacttaaatcacacttgcagatgctctctaggatgtggtaccttcactgagaaaacatggtttctggttctttgtatgaggcgtttgatttggtgaatgctttttaatctacatcgattgggagagaaaatcaaaatgatttgttttggtgaggtaagaacaaaagcactgcttcactgttttatgtcatggctacgtcacttctgttttcagtttaattgg

SEQ ID NO: 203701 - DNA, 649 bp, Homo sapiens
gtcatcccaatgctgggattacaggtgtgagccacatgcccggacataaaatgactttttaaaaaactgacaataccaactgctggtgaggatatggagcaactagaactctcctaatggagcaactagaactcttgtacattgctagtgtgaatataaaaatagtacagccaccttgaataacagcttgcagttttttatacagttaaacatacacttaccatacgacacagcaataccactctgacatatttacacaagtgaaatgaaaacttatgtttgcacaaaaacctgcacatgaatccagcctgggtgacagagcgagactttctcaaaaacaaataaataaataagtaaaagtcctcccaataggttaataaagattataagagatggtggtggggggaagtaaaggcacaggcatcagtgtaaatgaatactgcatggctctttcaaaaatgttctcaaggaagatttaatgacaagaaaatactaaaaaagcataaatggtgaggaaaaggtatatacaaccatatacacagtatgagtctgaggccatagaatattctgtgtatgaatatataagatcttttgttgaataaacgtgtattgagcacctacaatgtactagatggtagggatatagcga

SEQ ID NO: 203702 - DNA, 393 bp, Homo sapiens
accttggagacataggtttcagtgagccgagattgcaccaatgcactccagcctgggtgacagagcgagactttctcaaaaacaaataaataaataagtaaaagtcctcccaataggttaataaagattataagagatggtggtggggggaagtaaaggcacaggcatcagtgtaaatgaatactgcatggctctttcaaaaatgttctcaaggaagatttaatgacaagaaaatactaaaaaagcataaatggtgaggaaaaggtatatacaaccatatacacagtatgagtctgaggccatagaatattctgtgtatgaatatataagatcttttgttgaataaacgtgtattgagcacctacaatgtactagatggtagggatatagcga

SEQ ID NO: 203703 - DNA, 594 bp, Homo sapiens
tgacaatgaggaaaaagcatgaggaatacagtggaaaaacaagaagcgtggtgctaatgaactacaacaggaactccaggtcaagatcatggactaagacatgtaaaggcctaaatttcaggtttgcaaaaacaaatccccaaatataaggtcatttccaaattccacaccaagagtaaattttactctgcaaagaatcttttattcaggtgacctttcagtctttctcatctctctttaaagtgtttcatgatcaatatagtagcagattgggaaattttactttgctttttgcttcctactcacctccattggtctctcacaaatttaaagtcagacctgatttagaaataatgacctataaacctgaacaggtgagtgatcacgttaatagtgaattacaaaccaaaacctcccttctgtggaatccatccacccactcccaaaaccataggtggaagtcaaggcctatagcactcatgcatgtggaggaggagcccagagagaaaaggcatggaatcaaaaccacaccacataacattcccagttccttgcagaaggtagaggtaaataagcagagggtgacaagatagt

SEQ ID NO: 203704 - DNA, 593 bp, Homo sapiens
aaatgaatgccaacacctgaaatctgaagagctcactcatcctgagcaccacgtgtaaatatctccctgtgagtacatatgccatcaccacaaaggaattcaagcactccggggcagaacacagctaaagcttgaaataagtatttttttatttttttaaaaacttcactccttctctagatgtctgtatgaataatagcttctttacattttacgaatatcatgtataaatatcagggaaaacagcaggtagtccgacaatcagatgctggtaccgtgagctgagaatcttggtgccagtcctggaccaccaggcctcagctcactgcagctagagtcagggtggcaggtgactcgtagggaaattttgagagcaggtataaaaccgtgacattcttaattcccttggtgataaatgggtgtgctgtaacgtgagaacccctgattcgtaatctatacggtaacttgcagggtgttttgttttgctaggataatatgttgttagcatcttgcttttaaaaagtttatttttctaagctaactcatttaggtgtagcctaggatttgtagcctatttcatattttttgatagg

SEQ ID NO: 203705 - DNA, 318 bp, Homo sapiens
tcagcctgggcaacaaaaggagattcccatctctacaaaaaatttttaaaaaatcagccaagcatggtggtgagcacctgaagtcccagctgctcaagaggctgaggtgcaaggctctcctgagctcaggagattggggttaccgtgagccgtgatcatgccacagcactgaagcctgagtaacagagtgaaacactatctcaaaaaaaaaaaaaaaggaaagaaaaacctgttttccagggtaaaaccattttccatgtctcatttctcctcattgaattaaaatgaataagaaaaacccagtcactttaaccaagg

SEQ ID NO: 203706 - DNA, 266 bp, Homo sapiens
tacagtcctgtctacttgggaggtggaggtgggaagataacttgagcacaggaggttgaggcagcaatgcgcagtgatggcgccaccgcactccagcctgggcaagagagcaagaccctatctcaaaaaacataagtaaaataaaatatatgaagcaaaagccaacagaattgaagaaatagacagttctatggtaatagttggagactttaataccccactttcaataacgggtagaacaactagatagaagatcaataaagaaa

SEQ ID NO: 203707 - DNA, 445 bp, Homo sapiens
cccctaaagatggaattctactgggaagtagtagcaagaaaaagaaaaccatgaaaaggaccctggaaccgccatgacctttccaatggggaataaggaagttcctggagaagggcagtctctgctacagtaactgcatgagtgggagaggcattttcctttggcaaaaatttcctggtcagcctgtatcaaaacctctttttcccccatggaaaaaggctgacaactctgcaaaaaaattaataaaaaaaaaaagaaaaaaaaaagagccatacagaattccctattttttgcctcataccatctggttggggttggagatctaagtatagaatggcaacggcattgatttaggacccaacaaaatctgtaagtgtctggaaaggcgatggcatggctagagtgggtcccttcactctgtggcctgcgctgtaggctttacact

SEQ ID NO: 203708 - DNA, 533 bp, Homo sapiens
caactacagcatgattacttcagttaggaaggggagaggagacagacattaatgttttgttgtagagggagggggaaaaaaaacagtggagagaagaggctgtgattttggtatgcaggatcattgacataagaggaaaaggagtggttgagatttgaagaaggccagattatgcttagccagaaatagtggtcgagatacaacacatctttttttattttgttttaaagacaggttcagctgggtgtggtggctcacacctgtaatcccagcactttgggaggcagaggcaggtggatcacctgaggtcaggagttcaagaccagcctggccaacatggtgaaaccctgtctctactaaaaatataaatagccgggtgtggtggcatgcgtctgtagtcccagctactcgggaggttgaggcccgagaatcacttgaactcaggaggtggaggttgtggtgagccaaaattctgccactgcactccagcctgggtgacagagggagactctgtctcaaaaaaatgaaataaa

SEQ ID NO: 203709 - DNA, 399 bp, Homo sapiens
aagacaaagagaagatattaaagtagccagagagaaaaataggtaatacaaagctggcagcaaacttctcaacaactatcaaagccagaaaacagtgcaataatacctttttctttaaaaaaaaaaaaaaaaaaaaaaaaaaaactgttatttcaagttcaagggtacatgtgaaggatgggcaagttttttacataggtaaatgtatttcatgaggatgtttttgtgcagattatttcacccaggtactaagccttgtatctatttagttatttttttctgatccctttcccctccttcctcaccctccatactccattgtgccccagtttatgttgttcccctctatgtgtccatatgctctcatttagctcccacttataagtaagaacatgcagt

SEQ ID NO: 203710 - DNA, 620 bp, Homo sapiens
cacacacacacaggcatgcacatacacacgccctgttgattctggagaaccctggctaataagttacatgtcacttttacttcattacagttattaactgcatttattacctgctacagtttgaatgttccctccaaaattcatgttgaaatttaattgccattatgacaatgaagaggtgggactttcaagaggtgattaggtattgagggctctgccctcataagtgggctaatgccactgtggagagaatgggttagatatcttgggaattcaggcccgttttccctgtctcatgtgcctgctttcccttcctccgtgggatggccctgtcggatgctgatgccaggctcttggacttcccaagcctccagcaccatgagccaaataaaactggtattctattatagcagcagaaaacctactgataccttgccttacattgctttatgcagaaaagtcttttcttcctccagagaatatcaagatacctcaatgatgaggagcagatgccttttacttttttgtagatgagtttgggcaaagtgacaacaaagggcctgcagtactggggtccctgatgaagacgtatttggtgatatctggaaagcaaatttgtg

SEQ ID NO: 203711 - DNA, 740 bp, Homo sapiens
ggtgaaagcatggacaatgagagcagctgtaagcatggaaaggaagttaggtggagaggcatgttaaaagaattttgacgatacttagtgtactggacattatcttatctgaccagaaaaatatatcctttattttccaaaagttgcccctctcccactccagccatatgattatggaggggactgaggtgcagccatgagaatgcccttggtagaactcctaccaaaaagagcgcacttgaataagggcctcagctgctgcacttggaaatccatctccatgtatgcactgagaccacatctcatacaggttgctgccaccagtaactgagtgtgatagggacaccaagggagctccattccaggaagacaagagactacctttcagcaactttgcctcaggaactacctgataatcttgcagaaccctctatagactgcctagcaatctagacccaaactattctctcttttaccttcacttagagtcagattgcatcatggtctgatggcttcccagccatttccagcaccctccctatatatatatccttttacacagatatataggttgtatatgtctaagtatatctaataaaatccttatacatttaatcctgtttggcatctgcttgttagaggacatgaatgaatgcaactgccaatcctattctttctctctggctctgtcttctgtctctctgtctccctctctctcttttacacatacacatgcccca

SEQ ID NO: 203712 - DNA, 811 bp, Homo sapiens
ttcaccaggcaggctgtgttcacattcaggtcacaactcagcaaccccaggaataataacaacaatccctcttgttggtagagtactttttcatcatatattttgtctcattttacctcaagttctttgtgaaataaggctgggtataaatgaatacataactgtcctgtttttgccaatcctacaaagtgtgggtattactcttctaacagttgaggaaacggaagctcagagaggtaaaataatgttagcaggtggcagaactgaaacctaaacccaggtctatctggttccacagctgctttcaccatgacacactgcatctaacttgctatttgtagccattctgcagtagtataagctaatgtatccgagggccatataataagtcagcttattggttgggaatagaatctaggaatcctactactaggttgtcccctcctctatcactaggatacattaattctaactgtaactgaagtgttggctgccagggtgaaagagggagagcaagggagtgtaaggagctaagattggtgcctgattctagacctagaaatttaaatgagagacatagtatgtggcacagggaaaaataaaaaccgcgggcttatgggctttggagcccagccgacctcaatttaagttctatctctagtccagacatggtggctcatgcctgtaatcccaacactgagaggctgaggcaggaggatcccttgagcacaggagctccaggcagcagtgggctatgattgcattactgcactccagcctgggcgacagagcaagacccctacctcttaaa

SEQ ID NO: 203713 - DNA, 454 bp, Homo sapiens
agtttggggggaataattatttacagcatgcgcaaaagaacccatattctataggaataaacacaataaaggggttgcatgataaattccagtttatattgagtaagttatgttttaaaatatagatgcagccttggagaccaagaagaaataaaatatttataaatgtggggtgggcacagtggctcaggcctgtaatcctagcgctttgggaggccaaggcaggtggatcatttgaggttaggagtttgaaaccagcctggccaacatggtgagactccgtctctactaaaaatacaaaaaaattaggcgggcgtggtggcgggtgcctgtaatcccagctacttgggaggctgagacaggagaattgcttgaacctggcaggcggaggttacagtgagccaagatggtaccactgcactccagcctgggcaacatagcaacactctgtctc

SEQ ID NO: 203714 - DNA, 457 bp, Homo sapiens
ccccagcaccagtctggatattttcttatctttcatttcattacctatctcttaagttgtgtctatcagagccatctactgatttcttaaattgttatattatttttcaattctagaattttaaacatagtgtccagttctctcctgaagttgttccatttggtcatttaattcatgaacattttaatcatagttattgtaagacaccggtcagataatgttaactacgtgaatttcctggaggtctgtttctattgttcactttctcattgttggtcgaatcttgtgtttttgcattcctatttcttaagcagactttgaaaacaattaatagagaaaatttgagaaattagaccatgtcctccttcagaggggctttgtttttgcttctggctatccactagatctgaggctgggcttcagtccttgtgaggacaggcccataaccaattcacct

SEQ ID NO: 203715 - DNA, 527 bp, Homo sapiens
aaaaaaactccacctaaaaaataaatttaaaaagccatttttagcttttagggacaagtgagaaagaggctgtcgaaaaacaggccaccatggccgtctttgcacacccgctctcaagagcaaggcgagattgcaccccaagctgtgcctcagcatagcgctgctttgaaaattggcatcacagagctgcctccaacatgaactttcctcagaacctcagcctgttgtgtcctccagggaaccccgggaggaagcctgggtgaatcctccctcagtcccactttccagataggaggccgaggcccaggcggtaacagtgccgagcaggaaccagagagctcaagccctgggcctcctgcatgcgtagagggtttgcctctgaaaacctcaccctgtataccgaagaccccaaaaggggaccctgggtctgctcaccaggttctccctgcagtcctcggaaattctggagctccctgtcccatggcagtaaagaaaagagtgccatcccattccagcaggtacagcta

SEQ ID NO: 203716 - DNA, 234 bp, Homo sapiens
acttctcagaaaagtctttaaagattgagaagttgttgagctcatgggtgttttcaaaattctcacttttgtttgagagctcatattttattattgtaaataaacaccatgagttactttcgttgaagtgattggctcactttatttcaagagaattactgccaaatacttgagtctgaatatctgtggcttgtctttcagttggactttcaagtaaaaacaatattccttaaa

SEQ ID NO: 203717 - DNA, 329 bp, Homo sapiens
cttgccttatttcttcttctctttggtgacctacattgtcaaaactaccaattccaggttaactttgttggagaatttcccccacccccatccagtgggtcacccaggagtaatgtccctccagcaacgttccccctatggcctccagcagagctgatctgcctctcacacaggtcctggtgtctgcctctgcaccgttccctaaatgcagccaccttggcaggttccaggtggaagttggtagaaggcccctgccaggtcacagcaatgctctccttgtcaaggcatggaccagggtcattcagacacattcagatactgcactgaga

SEQ ID NO: 203718 - DNA, 373 bp, Homo sapiens
gacattagtttataatctattttagaatattttatagaattgatgccaactttattgaagtacaattgataaataaaaattgtaaatatttaaggtgtatggccaggtgcggtggctcacgcctgtaatctcagcactttgggaggctgaagtgggcggatcacaaggacaggagatcgagaccatcctggccaacatggtgaaaccccgtctctactaaaaatacaaaaattagctgggtgtggtggtgcgtacctgtaatcccagctacttgggaggctgaggcatgagaatcacttgaactcaggaggtggaggttgcagtgagctgacatcgcaccgctgcactccagcctggtgacagagagatactc

SEQ ID NO: 203719 - DNA, 247 bp, Homo sapiens
gtttgtagcaaccctgctttgagcaggtctgttgggaccatttttccatcacatgttcactttgcatctctgtcacattttggcaattctcacaatattttgaactttttcattaccattatatctgttatggttatctgggattagtgatctttgatgttactgatgtaattgttttgggagccactaactgtgcctatataaggtggcaaacgtaataaacattgtgtgttctgactgctccaca

SEQ ID NO: 203720 - DNA, 718 bp, Homo sapiens
aaacaacacagagcatggcctggggcgtgaacaaatgggaacttaccataataaaagtcacatacattgtagagttatcattacaaagataacctaattttatcttgtgaacctctctgtagtctcctagacaattgaagacaccctggtttgtcagaatttacagacgggacttgctgatccaataaaaaactatggctttgtgtcttcccaactctaagtcaataatgtcagctaaaggattgtcattctacctccctagatgttaactctgacaacttctcggccaagcatttttgtaagacagtcatccaggtagccacagcttgaaagtgaagaatcgagaaggaaggtttggtcttgccaattataggaatttggcaccaggttccaaagcatggtatggctttgctcatctagcccctggaatgtgtacatggctagactgatcctaggctatgaggaccacccaaggtaggtttgagattcctgagaaatatctattctctgactccctgtgctctgcactccccaacaaaagaatgtgacattatgagaatggaacattataatattattgagaataggcaacctgggtgtttagagatcagtaaaaacaaagttaacaaaaataatggatgccagatattaaatgacttctttacacttgctgctttaatgtgttatttaaagcacactagattttggctaaaagggt

SEQ ID NO: 203721 - DNA, 189 bp, Homo sapiens
atgactgggctttaggatatattaatatataacttatgataaagaaaatcccatgtaaaagcttagtagcattgttgtaacagtaacatatttcattgtacttcagggtcgtccagggatgcagtcttaccatccaggagttcaaagccactatcaacactattttcctgatgacagcaccaactatag

SEQ ID NO: 203722 - DNA, 443 bp, Homo sapiens
cagtttcctctttgtccctgacccacatttcccacagacagagaaggcaaagtatctgcctgagaaatgcctcgactcagctgcctagctcacttgctgctttacctgactcaaaagacagcagactcagaagaaaacaaaaggaagggggctgggtgcagcggctcatgcctgaaatcccagcactttgggaagccgaagtgggcgaatccacttctcgaacctgaggtcaggagttcgagaccagcctggccaacacggcaaaaccccgtctctactaaaattacaaaaattagctgggagtggtggagcacacctgtaatcccagctatttggaaggctgaggcaggagaattgcatgaacctggaaggtggaggttgcagtgagctgagattgcaccactgcactacagcctgggtgacaagagcaaaactctgtctca

SEQ ID NO: 203723 - DNA, 490 bp, Homo sapiens
aataaggttcaaatcatttattatcagtattctttctttctttctttctttctttctttttgagacaaggtcttgccctgtcacccaggctggagtgcagtgacatgatcatggctcactgcagcctcaacctcttgggctcaagcatccctctcattcagcctctcaggtagctggcaccataggctcatgccagcaagcctggctaatgtttttaaaatatatactatttttagagatgagggtctctctttgttgtccaggctggtctctaactactgggctcaagcaatcctcctacctccacctcccaaagtgctaggatcacatgcatgagctaccgctcccagctggtactctttcttattattagtctgtgattattctatttgtaagaaaagatcattgaccaccagtgcagaattatggtaaacttatcttgttttgtttttgaataatgtcagaggctgttattttgcagagtatggtg

SEQ ID NO: 203724 - DNA, 325 bp, Homo sapiens
aaaaggcatcagaaaaatacgagaagtgaggaaaatagaggttgcttttgttacggtaggttaagatagaagaaataaagaaatatttttatacaacagcaaacgaacaatattaaatacaggcaaaagatggtagaaattctggaacagtatccttcagtaggtgagaaaggtgggatttgcagattttgaattaaaggaaggaacgtgggtagaaaaattagtatgttgctatgcacagtacatgagtgtgagtgcatgggcagaagtatagtggggttctgctgttatctgattctttcaattgtttgatgtgtaatgttaa

SEQ ID NO: 203725 - DNA, 690 bp, Homo sapiens
ggcttgggcccattttatagaagaagattgaggcccatcgaggagctgggctttcctggaatcaccttggtctcctgactcttcacttactattgttgcctgtctcccagttttctctaaacccatataatcccaagtgaaacctgaggtccattgtgtcttaccggggtcctatcaggatcctgctgggcagccgtactgcacaccttccaggcgagggaagctgccacgtaggcagccgaggcaacaggggaatcccgtgggatgagacttgtccttcctcatccctgctctggctcaggaggccatgaagagccagggctgagtcctagatctggcactaacttgctgtgtgacttgggacgagtcctggtccctttctaggtctgtttctcatctgtgaaataaggataatggtagtccctgcttcgaagatttgttaagagggatggatacgttcatatgtataaaaagtctcagcacagcctgtcatccagctgggactcagtaagtgtgagctgttatccttattagtaaccactgcacactgtccccctgcagacctacagactaactatgggctcagctggggggatgtcctacccctgcccatcagtcctggctctcccatctgcctcccagccccaccctgttcactctgtagggatctgcagaccctggcccgcattg

SEQ ID NO: 203726 - DNA, 400 bp, Homo sapiens
gtttcctgagttttttgaagattatgttgcagccttgccaaaggagaaggtgtacttgccctgcatgtggaacatttattttatccatgtagcttattagtggctaaagcagcatcttcactgtgcaaatattgtgcagtgtttaataaaaacagccttgggctctggtctgggccttgttgccttgtaaccttggacgagtcaatcaacaaatcttagcatttctgtcttcatttctccaactctgtggagcctgcagaactatttaaaatccttagcagattcagcccccttgcagactgttggtctttcctgtttgtctttgtttccattgggtgctaggactgaaatcttcaaagaaagtgatctgtgtgaaagtactttgagatttataacatgc

SEQ ID NO: 203727 - DNA, 520 bp, Homo sapiens
ggatattgtggcggctgtgcttttccgtcctcctaatgtgcattttatccttcttaaacacatggagttaaaagaaatcaacgcggaaaatgacccttctattcatacatttgctaaaaaacaatgaaagtggatagtttttattttttaagtggggtagatacatacgcatctccattgccagggcctgagagggcacaggcacacccttcagacaacgttgctttaatgtggaggttttgtttgacatgcttctattgtcagctcatgctatgactcagaaaaaaatgagcaagcacagaaggggtacggcagtctcaatgtgtttgcaaagaataaagtaagtctagataatgcctggagggccttggtgagtcacttgggccgggaaaagttgcctttttacacatgcgtagagattcttgccaatttgggaacttatttatcacaattgtaaaccagctgcctttgtttcaataacaatttctgacatttattactgtcaaagaaaactttaggc

SEQ ID NO: 203728 - DNA, 402 bp, Homo sapiens
aataaaagaaagaaaatatatttttggctctgttcttaagtatataattgattttacccatttataatatttgaaatgaaaatttataattcatttttgttattgaccattcaaagcttagggagcagagggtatgcaaaagaatttgtaattttgtgggggcggttccaagatggctgaataggaacagctccagtctacagctcccagcgtgagcgacacagaagacggatgatttctgcatttccaactgaggtactgggttcatctcagtggggactgtcagacagtggatgcagcgcaccgagcgtgaaccgaagcagggtgaggcatcgcctcacccaggaagcgcaaggggtcagggaattcccttttctagccaaggaaaggggtgactgacgg

SEQ ID NO: 203729 - DNA, 406 bp, Homo sapiens
gaatcactgttagagcacactgcttataagagaaacctgacccaagtatttgactgctcctgcacacagctcttaagtgtagataattaaaattgctagtcacactatgaccgttgtctctgtagaaagggtaggctgtgtcatctcactcctttgttttgataacttcttgacaccattgtgctactaacccttgtctcgttgaaattcagactcctgttttaaaaacactgggtctctgtgatttcagtgctgtcatgaatacatccagtattgaaaggaacattcggaaacttccagtacaataatttcccttaataaaagacaaaaattagatccagggagcaagtaagttgctcaagagaaatggaaaactagaattgctatctaggatgtcatgttaagc

SEQ ID NO: 203730 - DNA, 846 bp, Homo sapiens
ccacgtggggctgtgaagctctggaaatgagattaacgcaactgaagaactgaatttttaatttttttaaaaaatttagttaaccttacttgaaatagctgcaggtggctagtggctgttggatttgagggtaaagaagcatggtagagaaggcaggtgggacagcctcccatctgcgcagagatctatatgtcaccgccaccgacaggaagacttgtgcatcctaacccttagcctccttgtgctgtgggcaaggtccctgctgttgcagaccccactaaattcccagtccgtgcaggtaactgttgtgcttctgtgagcccccgccagtactctgggtggggacatgtcttgctcagacagagatcaaaggagagctaagagagggagagagatggacagttaaatattgaaggagggcgttggcctttttttacacagcacagggaagagactagtatgtggagggagcacttacatttggtagatgttcttacacagatcagccacctgaacgtgtgtgggatatttttattacctatattttacatttctattgtctgtattatttaccgtaactacatttgacatctacatattgctatgttttagaagcagaggtttattttcacctctttcctgaaggccatgttttataaaactgacatgttatctagtctagaagggaaggcccagctgggcatggtggtgcatgcctgtaatcccagctactcgggaggctgagacacgagaatcgcttgaaccgggaaggcggaggttgcagtgagctgagatggtgccattacactccagcctgggtaacaagagagaaactccatctcaaaa

SEQ ID NO: 203731 - DNA, 400 bp, Homo sapiens
ttatgttatttatttgcatacttatttgttgtgcttttctagattattattgtctcagaaacaataccataagctccttgagactatggatcatgcctcttgttttgtaggcatacgaatgccaactgtccgggatgctgtccatggtcctgaacttctgccatgaagtctaagccaaggggatgcagacaaaagtaaggatttcctattaactgtcataattgttttggggtataaatagagacaagaaaaggatccctggacttgacatgtaagccaaatgaaaatctgttatgtgatcacttccacgtagggcaaaaaattgatttataacatatcaaacacttcagaaacattgataagtaacagaaatttcaccttgaattatggattctgagac

SEQ ID NO: 203732 - DNA, 435 bp, Homo sapiens
ttaggcctcaaaaagtctccacaaataaattttcatggatagtgcctagcacacaatttaaagagtgtacatagattcactgcattatgggcacaaaaagagaaaaaggaaaaagcagaaacatcagtttgcagaaataaactcgtaagcacttcaggcagtgaaaatgtcagccatggattgatcgtaaaacaatcaggtttgctgtgtttaaagaaaaaaatatatgcaggaatagaaccctataaaaagtgacctaccaaatctaaaaaagaaccaaatggagtaataaatggaaaatagaaagactaaactttaaaaatttgttggatgtgtttaacaaaagattaaattctaccacagataaaattagttaactgaaacataggggagaatgtttcatctagcctgtattattgagacacaaagagatgc

SEQ ID NO: 203733 - DNA, 543 bp, Homo sapiens
aaactgagttggtagggtaagtgattgggacatgagatgatgagagagagatgtattgactgttaggaaatttaatttttatgaaatcagcattatggggaaatactgtaatctgattcattcctgcagaattcccaggaggaagaggcccagcctcgggagttgaaatgtttcattatgtacatgcgtgggaaaaagatgaaatgtggtttccgtgtgctgattttctgtaaaacatctattagtatgagagtagccaggctaggcaacaaagcccccaaaccatcgtagtctagggaaaagtgaacccagaaggcatttctctgatggatgctgacatcaggagcaataagtttgaaagtagcaagaaaaagtaatgacagtaaaataatgttgaaatagtagctaaggaatgatcacatgctgaagatgaggtcagtcctttattcctcatcaatccctgcttaactttgcttttagaaatgtaaggttccccaaaaatgaggaaactgcaaatgtaagctttttataccaactcagttt

SEQ ID NO: 203734 - DNA, 654 bp, Homo sapiens
ccttgtcttaggcagtactttttggtctttgtacaattgcaaacgtgtcttatctcatgggttgtggaataacggaactaaatcagtttcaagactggtatagtttacaaataaacatggataagatcttttaagtcttcattcagaactcaaaaaaaaccgcaagtaaatccaatagctgaattcacttaatattcttctcaaattacaacacgatttcaaataaatggctttcttttattgttcctataaatcttctaccagccaactcaaacaatgtttaagaaaatggccaggcatggtggctcatgtttgtaatcccaatacttcgggaggctgaggcaggaggattgcttgaagctatgggtttaagaccagcttgggcaacatagtgaggcctcatctccttaaaaacatttagaaacttagctgggcatggtggtgtatgcttgtagctactcaggaggctggggtgagagtatagcttcagccttggattttgaagctgcagtgagccatgatcgcatcattgcattacagcttgggtagcagaggtgagacctcaactctttaaaaaataaataaataagcaaaattaactcaggtttattaatagtggcagcaaaaaaaagaaaaaagaaggcataagtcaag

SEQ ID NO: 203735 - DNA, 396 bp, Homo sapiens
gactttaattcttaaattcaaagaaatgttgacagctttaaaagaaaaatcataatagacactaggtaaaaatagcaaggaagagtttattcaagactatggcaataggaggccaaaagcagtggttaatacttgtaatcccagcatgttgggagtctgaggcaggtggattgtttgagcccaggagtttgagaccaggctgggcaaaatagtgacaccttgtctctacataaattttttgaaaaattaactgggcatgatggcatgtacctgtagtcccagctactcaagaggctgatacgggaggatcccttgagcctgggcattcaaggatagagcgagacatgatcacaccactgcactccagttggggcaacagaaggaaaccctgtctca

SEQ ID NO: 203736 - DNA, 382 bp, Homo sapiens
atcaaattttataatttgtaaactggactatgttgtgcatcctttcatagtttaggatgattaagagtttggaccttataagtaaactgccacattttgaatcataggccccaactgggtactactagtgaattctcagagtcattaatctagattgtttcatgcctctccttatcttcatctataaaaatggataataggactaactgcttcacaatctctttgccttgaattaggtgagataatgcaagaagaacaacaaataccatacatgtgatagtcattaataaatttgagttgttattatctaattattaaggagaatttagaaaattcataaaagcaaatgaagaaataaatcattccttgcctattacccaaa

SEQ ID NO: 203737 - DNA, 371 bp, Homo sapiens
aggtatatagtataatctcaatttatgcttttgcccttagatgccagaagttaatattctttcaatacttattctcgtagaagcaaaagagatcctgtttgtgtgatgttcctacagcctctgctgtactgtattatgaaagctcaagaaataggagttaatgatgaggcacagcaggaagaaaaatgtctctaagatgccaaacagggaaaatttaggaagaaataagaaccaaaaaataaatcagttgatcagggtaaaaaatgtcttatgctctgaacttataactctatggagtaatttccactaatgatctcagtgtctacttaactaatcatgtacttttctagccagaaagacagtacttgtag

SEQ ID NO: 203738 - DNA, 260 bp, Homo sapiens
gcagtataatccaggttatgaattgtaaatcagatgccatgcaaagtactcgcgaaaattcaataaagctttctttgctcccagcacagcaaagttgggcctagggaggcaggaggaggcatgctggaacttggaggaaaggagacctgtgactggggaggagtgggtagggagtgggtgggcagggtgtgggggctctgaccctgcttggccaagacttctcagggggaggagctgcccattttcctgttggaggagtc

SEQ ID NO: 203739 - DNA, 473 bp, Homo sapiens
atcaggtgagaatcctgggttattgtactcaaaactaccactgaggagtgtggttcctgagaagttaagaaacgttcccaataatcagtagttactttctgggaccaaaatgaaccccttttttctggggacacagtcagtagagacagtcgataaggttgctaatgcagtaccacttccagaaaaaccagtcaagtcactgtgttccagaggtggtagttagtgatgtctacaggaatggatgacatcatctcaaacttagcatgcgattgtgttgaagatatttctagaagactagtgcttaaatcaagttctaaaaatttttctgctcgtttatcaaaatacttgacttagctctatagtttaaatacttgtatggtacttaatgggtaataaatgtatgaaataattttactcattgaagactttgatattttcaaaaactgcttgttcttccattcacaaattaataa

SEQ ID NO: 203740 - DNA, 138 bp, Homo sapiens
atcactttacactgaactatattgcttcagagttaattacatgtattttgcttttgataaatgaaaatactagatgcaattaattgaaagacaatcaatatgatcccacgattagacatcccaatgaaacagccagag

SEQ ID NO: 203741 - DNA, 662 bp, Homo sapiens
cgcacctgtcatcccagctacttgggatgctgaggcaggagaatcgcttgaacctgggaggcagaggttgcggtgagccgagatggcaccattgcactccatcctgggtgacagggtgagactgtgtctcaataaataaataaaagacttttggaaaggtggagactctagactgcaggagatgtggccgccccgaaaactggctgaactttgttaaatacaactcatgattagaggaatgaatagtgctgtgttttaactttgtaaaatacaactcatgattagaggaatgaataatgtcaactcacatctctgtgactagatgcaggcttcttaggatatttgtaacttgaagaaatctggaaggacctcattctctaattgcccattttcccaatttgctttacaaatccttctgtggaaagtctttttgaaaatagcatttttgctccctcttagcctctggggttctgaacgctttggcagtgaccattgagaatcaccctgccttccatcagttaccttgtatcaccttataaaagtcatttggccgttgcagtggctcacacctgtaatcccagcactttgtgaggctgaggccagcggattgcctgagtacagaagttgaagaccagtctgggtaacatggcgaaaccctgtgt

SEQ ID NO: 203742 - DNA, 446 bp, Homo sapiens
tccaggggtattaatcaatgttttgattaattacacgtacatagaatttaagacaaagtaaaggctcttccatccccgcaagtccccagagaaaatttataacagcaaagtatcatcattactaaattagagcgtgaccagcctactggtcttgcccaagtccacgctgacttgggaaaagtgactgcctgccgtgatggaagggaagtactcaacccgacagactcagccctttttaaaaactggaagcaggggtgagtcatggaactccctctgcagcagcacctctatcttcccagccctgggctggcgacagagggggaaaaaaagttggctgaatggaccagcaggtgagatgaagagttgattgtcttcaaacgtaaaatatctcaagcaagaaaagaagaaaaaagtctcttcaataaatgttggcaatattttcgaaa

SEQ ID NO: 203743 - DNA, 289 bp, Homo sapiens
gtccggccaaggatgagcaaggaacaaagagcttttagaacattaagcatacatctaaatttatttgacctgaggatccagcctggcctctcaagagcagacgctcacatgataaaacgtgctgggaactcaccatgtactcagcaaagggaagcaaagagggggaaaaaaagttggctgaatggaccagcaggtgagatgaagagttgattgtcttcaaacgtaaaatatctcaagcaagaaaagaagaaaaaagtctcttcaataaatgttggcaatattttcgaaa

SEQ ID NO: 203744 - DNA, 273 bp, Homo sapiens
tgaacccaggaggcggaggaggtggaggttgcagtgagccaagatcgtggcactgactccagcctggggaacaaagtgagaccctatctcaaaaaaaaaaaaggaatatatattattaacccaaagactgttttgttctagcttctgtttttgcttttcgcctttggctgccttgtgaataaaatcttaaatgaccgtgatagaaaaattatgtaaagtagtattcactaaaactttacttctgtaattcaatatgaagaagcttcacgtcta

SEQ ID NO: 203745 - DNA, 525 bp, Homo sapiens
gcttatatgtctatttggttttataatttaggagaattataaagaatcagggaacatatgttctatttgttttagtgttatagtggtagaaagcattgtactttatgctgtgtcaatattcgcatctcagaagtattagtatttgcaatttgtaaaagatgatgtttgaaataaactattttcaatgaaatttaccatttgaaaatatctacttgcaaattttgaggaagaaaacaacttttgaaactgagcaccatttagaagttttattcatgttatacctagaacaaaaggaatttttcaaataaaatgttaatgacaaaagccacatttctacgtattcattatagaggttatcataaggactgggataggtataatttctaagagctaaaattaaaattggtctgttctctgttagccagatgttggtgttggaacaatgtaatgcattgcttaacagtaggaggcacccaccaggctaatttatgggatgaggaatgttaaggccaatcaagtgatcta

SEQ ID NO: 203746 - DNA, 310 bp, Homo sapiens
acacacacacacatgcacacatatatatagatgggactgtttgggcaaaccagtatgtttggtcagcctagctatactaccccttgtagcctatatagtatccaatgtagttctaagaaaatgggaagcaatcaataaagctttgataattgaccaataaacctaatagttattgcagtaggctgaataagggctccccaaagatgtccacatcctaatccctagaacctgtgaactcctgagggctcaggaggaagtgaggaacaccttgagtgtatagaacacttttaccatcttagagaaatcatcc

SEQ ID NO: 203747 - DNA, 258 bp, Homo sapiens
aaatgtcccagcatgttaacaattatctccagatgatgagattatgggtagtttattttctttacaattgtgatattgtaaatactgtatttggtttctgactccatttcctggcatgcaactcctaaaatccttagatctccaaagtgatgtcttgtttatgctaaaacaaaatgaggccgggcatggtggctcacacctgtaatcttagcactctgggaggctgaggggggagaattatttgaggccgggagtttg

SEQ ID NO: 203748 - DNA, 305 bp, Homo sapiens
aataacgtttttgagcacctccagtccctgtgataactattttaaattctgttaatactctcataagtattattacttagctctactttgcaatgagaaagcagactcggaaatgttgaatgattatctaagggcgcatagttcaaaagtggtagaaccaggtgacaaaataaaaacttcatccagattaaatttaaaggagtttaattgagctatgaacaatttgcgaattgggcagcccccagaatcaccacagattcagagagactccagggatgcctcgtggtcagaacaaatttatagac

SEQ ID NO: 203749 - DNA, 440 bp, Homo sapiens
attcttgaagtgtcacttctcttattttttccgtaattctttcctactgttgccatacgtcttacatgtggagatgcaatagaaataaaattgcttctgctaaaatcacaaccttttagtctgaaggcaaagctgctttgttctagaatgcctgcggtattaagaaatcaccatgtgtccttttatttttgagttttaccatgatttttactagtgcctacttcaatgagttcttccaggatgcaggctattttgatgacatcttaaacaaagggaataagaattgtctttgccttaccttccttttcccacctttctcttcccacttgtcagagaaattttgcatgacagaggtgaatctctgtggaaccttctaggggtgtgaccatctgcttgccctggagagaatcagtctcttctttccaagaaacgatctgtca

SEQ ID NO: 203750 - DNA, 390 bp, Homo sapiens
ggtgcttgctgaggacaaaggaaatgggtgatggaagaagttataaagagcagctaagatcatgtaaccggttgcagaagtggggactataattatgagtattcttccttattttgtcataaatatatctttgtgtgtttatatacatgtattaattaaatgattttgttttcttctctcttatcctcttatcattacacgtatatattaatagtagttaggtttatgtcatagtatttaagttacaggatatcacgagagaagagtgggcatcacccaagtacatcacattctcttctgcagaagggttagcacgttttcagttgtatgcaggacagttgtgttatgttggatgggagtatgactttgttattatctttactgggagat

SEQ ID NO: 203751 - DNA, 497 bp, Homo sapiens
ctaaaaatagcaattaaaaatcccatgttaccaaaacaaaacaaagaaaacagtacaagcatagggactgtgcatattaaaagtaactaaatttaaaaagtattaaaagtaactaaatttaaaaattaaaccagcagcagcagcagcagcatctgaggcttctacagggaaacaagtggaaatagttcaacccctctgtacagttcctggggcagtcccagagcttgagcaggtgggagggatgagcattctgtccctgccgcaggggccattacacccacaggggcagcgcccacacaaggggtctcggctgcagctggcatgactggctcagccacaccaatgcttctgtgtcctgggcagcctggcttcccaacccccaaggagtcccaagccactgactaggtcctagaatagacaacccatgtcctgggctctggctggctctccagtcagttccttcacatctatcctagatagaggagcccttggagtct

SEQ ID NO: 203752 - DNA, 689 bp, Homo sapiens
aaaatcagccggtaccggcatgtgctgtaggccagcgaatttattttgtatcatgaaagagaagaggctgtatcagagaaaattccacagtgtgctaaatattattttgtgaaagctgttcttcagttacacgtgcacacacacctgtatgtatgcatgtatgtcaactagactgcaatacaaaggccactgctttaaagaatggttcatgatccagccttattcagccttactcaggctctgaccaacaagcagcagagcaccacacgatcacacggtaattatatgagtaacgtgaggaactgaacaaagaacagggtgatcgctggcctacagcagctgttttagcaccagaatgcctagtccaaaacctacatttttataatgaaaaagtcagattgctctaaagcatactgacttataaacagatactatagcttctcttactagagtcctcctccattttaagaagctatcaattacaagtaccaaagagtcattaatttgagatgctttttttcatgtaaacatctctaaagtcagaatgtatctttgagtctcttacaatcattatcagccatttttcccccacattttgacttctatgaaattggaatcttagattcaatgaaatactttaacagttttctgaaagaataaaaagaaacaccacccaatatgtacctaaa

SEQ ID NO: 203753 - DNA, 379 bp, Homo sapiens
caaactgccactcttaactcttgaagtaaataatctttgctggcaggactatgctgaatctccttaggcactctctaatcagatgtcctaggtcctcccaattcttagacatttaatacccatttttctcctccttttattcggaccttgtatcttccatttagcttctcaaatcatccaaaaccgtatccaggccatcaccaatcattctatacgacaaatgtttcttctaacatccccatgatatcaccccttaccacaagacctcccttcagcttaatctctcccactctaggctcccacgccgcccctaatcccgcttgaagcagccctgagaaacatcgcccattatctctccataccaccccccaaaaatttt

SEQ ID NO: 203754 - DNA, 490 bp, Homo sapiens
gttggaagaaaggttttcaaatattcccattgcaggcatcaccctgtttaatcctctctatgaccccatggggtgaatagtacctgcctctggattgggaagagcagaacctgtgatcatccaacagagaaaaaggtgaattctctccttaaaaatatggggagagggaatgctggccaaaaagcaaaatggattctaagagacaaaaagaaaaggaaaagaaaagtctgccaaacaccatgactatccctattttgtaggtgagaaagttgaggctcacagaagttagataattgcctagaaattgggaggagctgctggaattcaaacctgatttcagcattagcatctcagtccacaaaggtcaggccatggtccttgggacaactaccatggactgtgtaggccgccctgcacttggaaagttgaatctctgattaatggggtcaggaagccagcatcctggctggacaggggaaccttgcaaatg

SEQ ID NO: 203755 - DNA, 562 bp, Homo sapiens
tattgaaaaataattaagatagttaaaatatagaacttgggaaatggcaaagataatacagaaagatcctgcgtacccacccttcacccagtttctttcattcattacatcttatttaactacggaacaatacaaaaccaggaatttgacacaggtacagtgtttgcatgtttttatctcaagtgtagattcccgtaaccgtcaggatacaaactcttctatcaccacaaaaatctccctggtgctttttatactcacacctagcccctccctccaccatctctaactcctggcaaccactaatatgttctctcttaacttttgtcagaacattacgtaagggaaatcatacaatatgctgccttttgatattgaattttcttcgctcagcctaatgccctttaaatccatccaagttgttgcatgtattaatggctgtttctttttattgctgaggctgtatcaccgtttatttaaccatccacctcttgtagaacattttggttgattaccattttgagctattaaaaataaagctgctataaagaatcatgtaaaggtt

SEQ ID NO: 203756 - DNA, 241 bp, Homo sapiens
ccagccagaggacgatgcggctgtgagagcctgcaagaaggtgagcttctgagagctgccgagggccgagctccaggaagaaaagaccccgctggaagagtaaggctgacccggtcagtcaggttccaccctccctgcacaccgtcccctctcttctgaccccacgccccctcaccctggaggactcaggaagcacagctggtggacagggctgcaggtataagattcgctcaagactagg

SEQ ID NO: 203757 - DNA, 521 bp, Homo sapiens
ttataatttgtgtatttgtttatagtagttttttggtggactctttcagtttttccaaatataagatcatatcattggcaaacaaggacagtttgatttcttctattccaatttggatgcctttatttctttctgttgtctgattgctctagttaggacttccagtactatgttgaataacagtgatgaaagtgggcatccttgccatgttccagatcttagaaaagaggctttcagtttttcaccattcagtttgatactagctgtggcagcttccatgagaatcacgcagtttgaagaagcatttcactgaaaaatagggattgctgttctggaaagacaaaacaattgtctacaattctaaagaagaagtgaacacaataattaaatcaatgttattctgggtctaaagcttatattcttaattactatattatcccatcttaaaattttaatttggaaattatatatctaaatattataatcaataaagttgaacacacatgatgaagtgtgaaaag

SEQ ID NO: 203758 - DNA, 697 bp, Homo sapiens
catagtggtgcgtgcctgtaatcccagctacttgggaggctgaggcaagagaattgcttgaacccaggaggtggaggttgcagtgagctgagatcgtgccattgcactctagcctgggcgacaaagtgagactccgtttaaaaaaacaaaagataagcatctaacattttaaatgtattttttcagtatcaggaattttgctaagcatttgacatatattatctcatttaataacctgatgaaataggtgcttttattatcctattaatatagatgaaggtgcttaggcttgtggtcatagagctaataaacggcagagttaggcttctaattcaaatggactgactgtcacctgcctcttaacgacacactatcctcatttctttagtaatccataattattaatgatgaacaagagagtttgagatcaagtgatatactgttgtttaaacgttcctagaaaatagaactgaaagaattttctgtacactgtttttccctgatcagcccagaaatctcattagtaaaagattgatcccttcttttctccctctctcttcgttcttactttcccacctcagcatttcatctatttagaattatatttaattatcttcacagacaattcctaggccttaattaagtttattttagtgatggtttcattagctgtcttttttccaggtggctttaaaaa

SEQ ID NO: 203759 - DNA, 313 bp, Homo sapiens
atgatcgtgtgatctgatggcagtgttaaatcactaaggagacaaatatgaaaagtgcccaggagtgtgtctagcacatagtgagggcttgtaatggcagcgagtgcttttcacaaggcaagccacatcctgtttcatacctgactttgttgttctcatggacatcgtgcagtggttgactgtagactctggagctagtccctgggtctgcatcctgacataccaactgcgtggattgggaaacttgcttaggctctcttgtctcagttttctcatctgtaaaatggggattaaaaactccacccacttagta

SEQ ID NO: 203760 - DNA, 529 bp, Homo sapiens
agatgcaccatattctgagatacagatcttcttcattatattcagctactgaattcagttgcatcactcaccacatttcatgtttacctcctcacccaacacactgacagaggcagttttcagtttcttgatattagaagaaatgcttcagtaaatatttttatattccctttgtgcttctgagtttctctaaagtgtaaaattagaagtggaactactgtgtcatatggtattcaagtttacatttttacccaatgctatcaaactctttttcaaagtgcagttatttgcttcccaccaggagtacatacatgatttccaatttcctttattcccactgtgacttcgtagtatcagtctctttagtttttgccaatatggtggatggtggagaggggactggttattgttttactagcattctgattaccatggaggtagcattttcatttctttattagccagttgagttttactttctgaatgacctcttcttcttttccatttttgctgttgggttattgctttt

SEQ ID NO: 203761 - DNA, 313 bp, Homo sapiens
gaatgagcagtccgacgggcttcagaacttgagtttggcagtttcacaaaggaagtgagggagggggagaaggataggtggtcaaatgggagaggcagaatgaggccagatccctagtagtctattaggttatggtaaggaggttgggattttattgtaagtcatagtacattggtactacactgtaatttttcaagtggggcagtggtgagatttacacatgaagtagaaaatggtggccctgtatgttattagtagaaagaattgtgtggtgaagaatagaagcagagagatcagataggagttcattgtt

SEQ ID NO: 203762 - DNA, 343 bp, Homo sapiens
aaaccatttggtgcaatatctcagtgcaagtctggcttggaacaggatagctcaggaggaggacaaagcccttggggcacatattccttggagctgtcatcccaagaaggtatttcagtcatggcctagtccagaccactgatctaatttggaatcatggccttctgagagccccagcgaccttgggaagccatggtaaccacaaagggaataacagctccccctttttgccctaaaacatgctccatctgcagccctcccccatctcaggaaaggacaactccattcttccacttatgtcaagaaccttggagtccttgcctcctttctcacacccaagata

SEQ ID NO: 203763 - DNA, 188 bp, Homo sapiens
ttgtaccactgcactccagcctgggcaacaaagcaagactctgtcttgggggaaaaaagtgtgagttaaggacttgctgtgtgtcagggactgccttgggggctggaggcacatcctcgaacaagacagggtcctttccctctagatgcttacattttaaggacagaagacagggaaacaaacagaga

SEQ ID NO: 203764 - DNA, 341 bp, Homo sapiens
catttctatatcgttgaacagaacttggtcatttgggctcacctagctgcgtgggaaatagaaaaatatactctgagcttgtgcccaggaaaaaaaaaaagacaaaaaaagatgatgttgactgaaaattgaaaggaaatgggcaaaccagggaactggaggttttactaaaatcagaaaaagtttgtgctaggattaaggaaaagaaattatgaggtgggaggttaaagtcagtgagtggcatgttgtacttgaaagtttaagagtaaagagcatgccacctgaaagtcagagatgttattggagtaagagataacagacactggagggaggggcacaag

SEQ ID NO: 203765 - DNA, 303 bp, Homo sapiens
tcccccagtctccctacatattgcccccatccacatccatgcacctgcagttccagactcttcacaactctgctcccttcaactcttgatgcatcttaaattttccatctgtgctttttggtcaagttcttcccttacttctccaaaaatggagctcttctctatacatacgctctacaatggtacttggctctttggctccgattatacatcaccgagcacttgcctctaatgcttcagtttttctctgtaattaggttgtcagatccggaagggcagagatcgagatttatttctcttgta

SEQ ID NO: 203766 - DNA, 517 bp, Homo sapiens
tcaaaaagggaaattcctctttactgctcacagtaagctgcaaaagaaagttgtcaaggtggcttatgatgctgttgtagcagagctgtgaaaggaagtgctttgctttctctcccgccttccggaatctggcgttccttccccttcggctactgaaaggtgtgtacaactcccagaggggtggctgtaaaagttgactggaggcaaagtggagtggccttattgccaggactagccctacagaagagctttacagagaggaggacagtacatcctatgtgtgttcgccaaaaatgggaaaggtgggtatttaggcaaaacaaaataaaaacctttggaaccctttaagaagttacataccttttaaaggtagtatagtttctcaccaagtgatgcattttagcatgacacttcttgccagaaattttgggataagttggaataaatgtgtttaaaacatcatccaccgccctttttaaattttgtctaaggaattacttaagtatagtatttctga

SEQ ID NO: 203767 - DNA, 332 bp, Homo sapiens
acaccccctaacactgacagatgtgctgtagccacagcaagtgcagccctgccctggggatcacactctccccccgcagccatccctcccctgtgtacagtgagcagaaactgtaccttcttcaacactttccctttgaagaccaccagaaaaaatcactctgcctttcgttgttgttgttaggtctacctggccaggtagacctaaccctaaacctcaacagttaaatcaacaaaactgctcgccagaacactacgagccacagcttaaaactcaaaggacctggcggtgcttcatacccctctagaggagcctgttctgtaatcgataaa

SEQ ID NO: 203768 - DNA, 474 bp, Homo sapiens
gcctttcaacaacttggaatttgggacatttctatatgattgggactgttcaccaagtggatgttgctgtgttttgtgacgagatggagtagaggacaaggggatcatttgtaactgaacatttttagcttgtcctatgggacttgttaactttctattaccgcggcctaatccatacagaactcccaacaactaaatttgtggctgatccaaccaatggcatgagttggactgacagttttagaaaaaatacgctttttggaatttttttttaattggacaagaaccatgcataatattaatagtcttaaagccagagaactgggaatgtaatctttttttcctgtgtctctaagtgactctcaattggagtgatgttggcatttctgacctgtatctacctgctgtttttattggcatttacctgctttattgggcttatatgcaatcttgaatacagatttggacacctca

SEQ ID NO: 203769 - DNA, 460 bp, Homo sapiens
ttttccttggttcttttcctatgcttttgtgaacagtttttctggaaatctaatgcatgatcccccctgctaagaacattgagtagagagcagagggtgatatatgtgtatcccttttctccatgatgatggctctggctcaaaaaacacttttacttcttttagttccttcggatgaatgcagaagacaagcagactgctggactgccagtaacgggcatatccataaggacaaaaaggagggccaggcgtggtggctcatgcctgtaatcccagcactttgggaggccgagacaggcagatcacttgaggccaggagtttgagaccagcctggtcaacatggtgaaaccctgtctctactaaaaatataaaaattattttttttgaggcggaggttgcagtgagctgagatagtaccactgcactccagcttgggtgacagagtgagactccgtctca

SEQ ID NO: 203770 - DNA, 374 bp, Homo sapiens
ccctgcaaaaatccagatatatttaaaagttatgattcactcttctaaaagagtcacagtgaaatctcttaaaaaagtaattaccccaagggtttcaatttccctgcatcctcaccaacatattgtctatatttcttttgggtgttaagtggtctctcactgtggctttggttacattttcctaatgactaatgatgttgaacatcttttcatgtgcttattgccatttgtatatctttggagaaatgtttattcagatcctttgtccatttaaaaaactgggccatcttttcattgctgagttgtaagaatatatattatggatattagtaccttatgagatacatgtctgcaaaatttttctcccattctat

SEQ ID NO: 203771 - DNA, 297 bp, Homo sapiens
aattttggaacatcaggaaggaagaaagaacaataaaaagagtaaaatatgggtaaacacaatagactttcccctccttttgaattttctaaattgtatgatggttgaagcaagaattatagcactgatttggttttcagtatatatattggaaatatttaaggcattatgttacagatgaaggagggtcaaaggatataaagggaggtaacctttctatatttcttttgtactgatgcaggcactttggaaaataatttcactatttgtttaaaaactgaacatactctgtatggg

SEQ ID NO: 203772 - DNA, 413 bp, Homo sapiens
ggactaaaagtcttaggtttctttccatatagattaactgtgtcctcacctcaaagaccgggcctctgaagctttttcaagattcacagaatctctcttaacttgtgctagatcttttcttgaaaaaaagccaatcatgacaagcagatataatccgtttaaggactacgggaagtgtgcagccttgtacggacgtcccattggaaaccctcggagtatggaatcaaactcctgtaaactttcctcttgcaaagtaactttgtttagtaattgcaattaattcataatcaaaatgtggcttattcatagcacttaaaaaaaaatcccaaccaaatccttcctagcctcaattttgtcactatgaatgacatacacagaaaaaataaaaaacatttctgtgtaaaaagtcgcag

SEQ ID NO: 203773 - DNA, 461 bp, Homo sapiens
ttattttacaacaagtctactaatgacaaattctcttgatttttcacttgagaacgcctttatttccctctcattcttgaagaatattttcattggatatagaattcttttacaaaattgtcacataatataaaattcaccattttaacaattttaaagtgtacagttcagtggtttttggtattttcataatgttgtgcaaccatcactattatctaattctagaagatttcatcacctgaaaactctgtacccatgaagcagtcattcctgatatcccccccgtccctagccccagcaacccctcagctgctcttcatttctatggatttgtttatcctggatatttcattaaatggaataatacaatgtgttgcctttttttctctggcttctttcacttagcatgtgcttttcttttcttttcttttttttttttttgggagagagtctcactctgt

SEQ ID NO: 203774 - DNA, 254 bp, Homo sapiens
aagtaatgtgtaatagctattaaagctgaagatgagtatgccccagaactcagcaattccaattgttgatctacagagaatctcttctacatgtgcacaaggaaacaatttataaatatgccctttgcagtattacttgtaatagtaaaaaaagtggagaacgggaaaatcaatgctttatagaaaacagctaaaatgaaaaatatctacttgtattaatagacataaatctcaaacatgttagttcagaccct

SEQ ID NO: 203775 - DNA, 657 bp, Homo sapiens
tcttgttacccagaaactatcttaagataatttttaatgtctaatatggcttcctttctggacaattaagtcttgaggacatgaactcccttctatgctgcattagaaggagaggttattaaaatgtaataaatcattttccagtccctttgggagaaaactttttatggagccaattgcaacaagtttctgacagcttattctcgttagttaaaaaaaaaaatccaagaaatcactattaatgagaccatgtttcctacctatgactggaaaacacaactacccagtatgaaatgtttttgagttctctattcaatacacacagattttatactcttgtcacttggatatagtgtgatttttatgatttgggacctttttttccctcagacactagttctgtccatgattaccatgggaatatcttcaggcagagctcaggtaacaatatgagactgcatctttgcatcagggcctctgagaaatatatcaaaataaggacatctatatttgttttatttgattttgatttccttgaaagcagaatcatttaccagatgaaacctttatgctagagtgcttctatttaccaaatagacttaaggtttctagtgtaggatttaggagaactcagctcgctggcattcccagctgtct

SEQ ID NO: 203776 - DNA, 478 bp, Homo sapiens
tttcgccatgttagccaggctgttcccgaactcctgagctcaagttatctgcccacctcggctcccaaagtgctgggattacaggtgtgagccactgtgcctggcccttgtattatatattaatcttgatatttttaggataaataaaaacgtgtgtcttaatgagcgctagatcacataacctgccttatctacttagctatttctcttgaacatctttccttgtcattaaatgatacatgaagcgttttatggttcccctcaccaggagtctgctcagtctggtggacagtatgctgggcttgaaatcaaaacaccgagattcagtcctagttctagcaggtgctagctgtgtttgggcaagttgtttaacctctctgagcccaagctgcatgggtgtaatgcttacctcccaaagtctctgacagcctaaatgagatcactcatctgatcatttctagcttggaacctgccttgg

SEQ ID NO: 203777 - DNA, 592 bp, Homo sapiens
tagggaaagaaaatctgagacgtgagtcatgtaaatggtattcaaaaccacaggaacagaaagaaagaggctaagtcttcgagaggcctaaactcagcttcacacagtgtgcattgaacaaatatgaattatgaagtaataataattcaaccttctactcagcaagcatgggaaataatgacactagcaaaattcactcagaagtgtttattaacagagtttaaacaaaagtgctactgatttttcagtacttggcaaatccaatggtaattcaacctaaaaataattacaaccaggatgagtttcatctgacataaagattaggataaccccaataaaccaacaggatatcttgatataaggggaaggcaatagagaaaatgcttcgggtgataaatctgaaatcttaaaaggtaaaatgaggcatagatactgatgttttccaagatcaagatacataaatttatgacaacattttagtgagtgaaagtcggtgtttttagctctgtcctatttaaatttttctcttggaacccctgaaaatagtcaagagtaggaatgagtactgtagtcaaaatgtcaattcctctaa

SEQ ID NO: 203778 - DNA, 357 bp, Homo sapiens
gagagaggaagagaaacaaccaaatgggactgaagatgaatggctggtgtcgtcacagtgtagtcactgtagatgaaaggccagcgtagatttgttgtgaagagactcctttgactacagcatgtaaaatggattgggcaggggcatgagttgacataggaagaccagggtaggaagctgcaaaaatgacttcacaaaggcctgagatctgggcctcttgaaggatttctgcctgagaggctgtccatctctcagagttcaaaaatgcccgtaagaacagcaaaggcaggcttttcaaatattaggatacatccaggagacacctggggactccagcagcccactcctctcacggga

SEQ ID NO: 203779 - DNA, 459 bp, Homo sapiens
cttttttcagtttgatagaaactcattttttcctagctaaaagctacattttttaaaaacatgcatagaaggtcgcagtccctgttatttttagtaacaggggttatggtaatgagattgttaatattctggggtttttctttctatctctaataggagagccttgcttgagttatgagtcttgggcaggcttgggctctgccaccagctagctggctgtgtgaccctaggcaggtcacttctcctcaccttcattttttttctttaattgtcaacagtaggatggggtctttaaggcccttttgggctctgactaccaattctagcctctggggtaataaacctgccacttgttgaaagctcaccttcagcctgatactgtggtgcattgtttcacttgatctgaactaccccatgcaattagtattaaagaataccaatttttagataaggaactga

SEQ ID NO: 203780 - DNA, 286 bp, Homo sapiens
gtattgttctctggccaactcttctgctccgtcttagtggggacagtagacttggagtggggtttgggctggagggcctgtgaatgtgacgtaagccaccataggggttccattcccagatgggctgagcagggcatggacggggacaaatggaggcccccttcatggaggaatttggccattctgggtggttgcagaggctggatttggggaaatagtgctgcagaaacatggggcgccggcagggcccgggccagtggccgggtgtggggtgagcccatcaggg

SEQ ID NO: 203781 - DNA, 905 bp, Homo sapiens
cgtggtggcaggtacctgtaatcccagctactcaggaagctgaggcaggagaatcacttgaacctgggaggcggaggttgcagtgagccgagatcgcgccactgcactccaatctgggcgacaacagcaaaactctgtctcaaaaagataaatttctaaatacataaagaacttctataaatcagtaagaacattaagaaacccactagaaaaattcacaaagtccataaaagaaattcaatactttcattaagtggaaacaaatattcttagacacttctagtataaattggaaggcaatttggcaggatccattataatataaaagtattacacacacttgacatttcagtatctatccaagagaaatacttgtgcatgtgtgccaggagacatggtttacaagaatctccactgtggtggcatttagaacagagaaaatggaaacaacctctatgtccatcaatagggaattgtataaataatagtgtatgtacaatcaaacactatggagttaaaaagctgtccaatacatatttgtaaatgaaaaacaccaaggagctgaatatatatgagatgataaattttaaataaaccccacacaacttaaactatttttatagataattatttaaggtataaatatccaggacaagacatgaaaaagaacagaactgaatggcagggagagtttggcgtttcccatataatatgaaagctttccaacaggaagatattcatgaattagttacattaaaaacaaagttttagaaacagaggactgtcattctccttctcagtctagtgcctaccatgcagcagctagagtaatcttcttaaaagtacaggccagattatgtgacttaaaaaaccctccaatgggtttccatctcattcaaaataaa

SEQ ID NO: 203782 - DNA, 378 bp, Homo sapiens
atacaggaaagtgctcaaattataaatgtacaacttagtgaatgttcacaaagtgagcctattgatatagccagcatccagattaagaaacagggcaggccaggtgcggtggctcatgcctgtaatcccagcactctgggaggctgaggcaggcagatcacgaggtcaagagatcaagaccatcctggccaacacagtgaaaccccgtctctactaaaagtacaaaaattagctgggcgtggtggcatgcgcctgtaggcccaactactcggggggctgtggcaggagaatggcttgaacctgggaggtggaggttgcagtgagccgagattgcgccactacactccagcctggtgacagagcgagactccatcttaa

SEQ ID NO: 203783 - DNA, 258 bp, Homo sapiens
agacccaggtagagagaggtatgagacagaagatgcatcttaggaaatgcgcattggcctgtatagctagggtatagagtggtgacaagtgcagcagagcacagtggcaaaggaggagaggcaggcatgtcagtgaagattgctaatggctgcaaacaagaacgcaaacaacataggcttaaataattaacaatttacttttctaagaagaagttttatggtaagcagttattgactctgatcagtagcttaattaca

SEQ ID NO: 203784 - DNA, 267 bp, Homo sapiens
gtgtagctttggaatatgtaatgggaagccactggatggttttaaactgggaataggatgattatgtttcaaaacataatattctctgtgctggggggaattgtttgaaggggtcaagcggtaaaatggaaaaatgagttaagaggctgggcgtggtggctcactcactcctgtaatcccagcactttgggagactgaggcgggcagatctcttgagcccaggagttcaagaccagcctggacaacgtggtgaaaccccatctctac

SEQ ID NO: 203785 - DNA, 328 bp, Homo sapiens
ttactctgaggcaagagaataaaaatgttttgccattaagtaaaaaatacgaggatgtctaatttggtatttaaaagtataaaatggctgggtacagccagctcatgcttataattgcaatacctcgggaggcccaggcaggaagattgcttgagctcaggagtttgagagcagcctgggcagcatagtgagagctcatctctacaaaaaaattaaaaaaaaaaaattagctggttgtggttgcaagcatctctggtcttagctatttgggaggctggggcaggaggaccacttaagcccaggagggcgaggatgtagcgagctgtga

SEQ ID NO: 203786 - DNA, 543 bp, Homo sapiens
cctgggtgaagaaagaagcggctttaactgagacacatcaatccctgcagctcagtcctgtgatcccacaccaggtgaatgctcagggaaagaatctcctctagagaggatggcagcagtgatgtggggtggggtgggagagcagtttctatgttgtacatacaagccatgttgacattgtatattatacttgcatattcaattccaagcatcctgtaagagacaggatataaaatgccaggaggccttaagtgataaccttaaacaaagctatatagtttttttgtttgtttttttttttgcgaaggcccagtcctagagaagcagagaaacctaaggaaggagaatctgacagatgcctctgccaaaaaaaatgatagcaagattcctgtttcagtctgccttgaatacatctgcgggaaaagcttcagaattaattcatctcattgaacgcacagtattttttaaatgttaaatgctaatacatattccatgtcatctgctaggcggttcttagttgagatgtaaaatatcttctgcccc

SEQ ID NO: 203787 - DNA, 498 bp, Homo sapiens
cagcataaagatactccatagtacaaagtaagctattaattcataaagtatactgaatataaattgcctttcattatgatgtttccacaaataaaaaaaatcattttccttttataagttaaagtacgaacagatattagagatgaaagccttaaagaatttttttagcctgttttattattgttttaaaatttactacagtgtacccctttattgcctgcactgggggcaatccacttctgccttgcacttagcatgacactgctttttattgacatgtaacatacattcagaaacagtgatcagatgtatccagatcaaacatcaccacctaggtcaagaaagatgatattacaggtatcccagaagcccactccacaacccctcctaattgctaacaccatatattagttttgtctcatgtttatcttcaaataaatggaatcaatcacacagtatctattcttatatgcctgccgatccttcaaatctcttcca

SEQ ID NO: 203788 - DNA, 570 bp, Homo sapiens
cctgaggctggacaggtcagcaagtcctaggcacaccatctgatagtcaatactgccccctaggcaaacacttcctcaacttcacctgcttccaactaaagctcttctcaaggacactgcttctctgagtcaatcttcacttgggctctggaccctaccccttccttctcaggggtcccctctatcaaacctagtatctccttgcagcccacaggctttctcagcagcaaataaggaggaactgatcattaagaaacgacaattcttggaagtattctctagccatcttcctttttacagccccaagcactctagaatatcatctgcacctgctggcttccagtatctcacttggccactggcccacttggagctggcttcagccctcacctctccactcagatcctcctactcaggtcatcagggtccttctcacctacagagccagtgggcttttctctgttcttccctcaaggtctctgcagcattagacatcgtggatctctttttctccttcctcaatgtctcaggcaacgctcttccctgcttctctttcggtgtcctggaacc

SEQ ID NO: 203789 - DNA, 364 bp, Homo sapiens
agccaggaaacctagattaacttctgttttccaacacctcatttcctcatcggttgagaaaagggaggaggggtttaaatcagtgttttctacacttttttttcctgctaagcaatagagccctttagttgagtgatgtgttatgtggaaccctaatatgtcaaatagccccacactgagctgcttctgactgaggtagggggctggagaccattctgattgaacccctgttgctccttacaggagtcttccagtgacacccagacctttctgaaacactgctaatacacatgcacacacacacaactgagcccttctaatggtaactctttttctgatgaccactaagataaattgtgggcct

SEQ ID NO: 203790 - DNA, 606 bp, Homo sapiens
  misc_feature (501)..(501): n is a, c, g, or t
  misc_feature (506)..(506): n is a, c, g, or t
  misc_feature (537)..(537): n is a, c, g, or t
  misc_feature (542)..(542): n is a, c, g, or t
  misc_feature (545)..(545): n is a, c, g, or t
  misc_feature (564)..(564): n is a, c, g, or t
  misc_feature (567)..(567): n is a, c, g, or t
  misc_feature (570)..(570): n is a, c, g, or t
  misc_feature (573)..(573): n is a, c, g, or t
  misc_feature (576)..(576): n is a, c, g, or t
  misc_feature (579)..(579): n is a, c, g, or t
tgtatatagtgaggagttagtggagaagagattggaagtatgaaaacaaagacaattaccggagagcaaaaacaagaaaaggaaaaaggaaggaaggagggaggaagtgagtgagggaaggaggaagtgagggagggagggagagaaggaaggaaagagggaaagagagagagagaaaaggatggaaagcaaaagttaagtttggcaaagggaaaagtaaagcttctctagagattagaggggagaagggctatgactaaaacaagtaaatctggagacacaatagctctacagtcaagatcgcctgtatctgaatcctagttcttcctaccataaccatataatgttaggcaagtttatttctcccactgtttccttatctaacctggggagaacagaattattgaaagattattgaaaagatcaagtaattcctgatgcacagtgagtactctaaagtggatagctgaaatctgtgtttgttttttttttttttttttnggaangggaaaaaaaggggggggggggggggggggngaaantanaaccccaatttggcaaaanttnttnggnggnggnggttgttgtttggacccaaaatcggct

SEQ ID NO: 203791 - DNA, 359 bp, Homo sapiens
tctgcataagaattaactagaaataacttgcaaggagagccaaagctaagacccccgaaaccagacgagctacctataagatcttcccttcaaggacctcaattaactttaataaatggaaccatcatattagggggaaacgtatatattgatctctgtttttcaaaaaacttgtcacaaatgcattttgaacatgcagttcataacgaactcaactattcataaaaccatccgtcgctgggcatggtggctcacacctgtaatcccaccaactttcagtttttaatggcagggttcattagtcttaggcactactagggcatataaatgcaaaaccatgcttaacagaaatagactag

SEQ ID NO: 203792 - DNA, 428 bp, Homo sapiens
acctgagatcaggagttcgagaccagccaggccaatgtggtgaaacccttctctactaaaaatacaaaaaagaaattaggctggcatggcgacgggcacctgtaatccagctacttgggagactgaggcaggagaattgcctgaatccgggagggggaggttgcagtgagccaagatccagcctggacgacagagtgagactccacctcaaaaaaaaaaaaaaaaaaaaaaaaaaatcctaactcaatctttgggaaccttcatgccaatgagagcccactgtagtttcttggatcactttctttctttccatgtggacataaggagcaggggtgtccaatcttttggcttccctgggccacactggaagaagaattgtctttggccacacataaaatatactaacggtaacaatagttgatgagcta

SEQ ID NO: 203793 - DNA, 271 bp, Homo sapiens
gggaacatctacactcacaagaaaacgctgtgtaatgctactctttatgtctggggagatagcacacacatacccacacccctctctctacgcctctatacgcatacatcatcactggcaggacagataagaaataatagttgcctttggtgagaatttgggagaaccaaaattcaagaattaagaattaactctctggttcttactcttaagagtatttttatggttgtttgtcgttaaaccatgtgcatgtttactttctaaaaacaaa

SEQ ID NO: 203794 - DNA, 407 bp, Homo sapiens
aggggaggcttctctgaacaagtgatgttcagctgagcgccaacaagaagtcagccacgtgaaaaccagagggacatacattctaagtgacgggaaaagccagtgcaaaagtaggtacccaggcgagagcaaataggtgcactggtaacagaaaggccagcaacctggcatcccagaggctagggcagtgcccactataaaagaaggactcagtaaacagctgctgggtgaatagagggagggagaggaggaagagaaaggaggactgggaggaagctctcttctcattaggggtcttgtagtcctttgagggcaggggggctcacaagttctgccagccgtgggagattcccaactcttcttaccacgccttgaacactgctgcacagaccagcctccacttctta

SEQ ID NO: 203795 - DNA, 697 bp, Homo sapiens
aagaaataaagtggattcctcttccagtttcttgcctagcttaaagccatgtaattcttgccagctcacattgtgacttttctggctttcaacactttgattgggatttaccatttaattaaataagcttaggagctggagggtgggtgctgtccggggtcagttcagtcaacccctggttctctttgcacttcacagaatgtggattgtctctctgttcatgggctctgctgggctctctgagctcagaaccttcagatttgttgggtgggaccacaggtatgcaccaccacacctggataattgtggtttttttgtaaagatgggggtctcactttgttgcccaggctagtcttgaactcctggcctcccaaattgttggtattataggcgtgagttgacaggctccggcataggccattttcaaactcccagattctctcccttttgatgctttttgctgataattatagaaattttactttcctttttccctcctaaatggagcagtattctggtttggaggatggctgctattcaagtagtccttgtcagaagcaagcctatgttgttgtatctaaaggtaaattgcacatctctggcaattttccttgccaacgcgtatactgaagccatcccccagcgctcgcctttgccaggtggccaggcctcagggtggggcttgcttgtcttcccc

SEQ ID NO: 203796 - DNA, 178 bp, Homo sapiens
aatttctggatctgtaagaaaggtgaatttcccagtaaatgcaggagactccatgagcagtgcaaattagtctgttacacaccattttaaaacatataatccatacaggaattccaactggttaacaaattccataaagaaatgaaagttgtctctatgaagagggcacaatgaagca

SEQ ID NO: 203797 - DNA, 90 bp, Homo sapiens
acagagggagaccctgtctcaaataaataaataaataaaacagtaacatacaaatataagtgaatatcctttaaaactataaagaaactc

SEQ ID NO: 203798 - DNA, 333 bp, Homo sapiens
caacaaaacacaagctcaaactatttaaaaaaaaaaaaaaagtccaaaaaagaaagagtccaatattgacaatttcatatggttttatctagcaccaactcactttatcctcacaataatcccacagagtaggtatcattattatctcccctttgcacatgagaaaactgaggccctagaagtgtgagaaatttagtcaaggtcacattttaaatggtggggccaagacctgaaaccaggctggctggctccagtgcccacactcttcaccacgatcagtcttgaaactggaaatggaaaacatggacatgaatctgctattattatggctta

SEQ ID NO: 203799 - DNA, 388 bp, Homo sapiens
caagtaactgctctttcattcatcacggttcccatatatctctataatctattgtagcagaagattcctaagaaatcattttctttctgcctagaaccagtcagccctattttagaaatcctaaagtaaatacttataatccctgtcctctttaagtgatcactcaaagaggacatgacatgttcttttaagtgccaaacagctggttcatttcccaattagaggagagcactgcaaatgatagctctaaataaatatgtaatataatctactgataaggacaatgtaaatatttacaacaattagggaaacaaatgtacacatatttgaatattctccagaagatgaaatctatccattgtaacatttgtcagaaagagtctgtttg

SEQ ID NO: 203800 - DNA, 484 bp, Homo sapiens
ccagggatggcattagcaaaagagactcaatgaggatgagaaaacagagatgacagagacccaaataacatttgaattggactctacctgcaagtggagctttaccatccaggttcttcttggtactccactcccatttgcacattaaagattgtaagagagttggaactttggacatggatggacctctcccagtaaatctagaaggcattcattccaacagcatacaaaacaatactggtgggtgcccacgccacaacactatggcaccataaatatactgctataggaaaagtttgatttccagccattgaacttgacattgaaattccagcctgggtgcagtagggtgagcctgtagtcccagctactctggagactgaggcaggaagagcacttgagtccaggagttcaaatccagtctgagcagtataatgagacccccttctctaaaaaacaaataaatacatacattggcatcaaa

SEQ ID NO: 203801 - DNA, 398 bp, Homo sapiens
ggtttcctgctggcgactgctcaactgcacactgaagcccggcgtgccctcgattgctgtctgttggctccgtctggctcccactgccttggctgagcatgacggacaaccctgaaaggtttctggggtaaaagcttctgtgttctccttgcagatcacatggagaactctgaaggcagatattggcctaattagggctgcagtgctcctaccattcaagggatgggaagggcctcctcggagctgcaggctttcttgttcataccaggaacacctcctctccatcctcgctgccctttgaagatattcgtctagctgcaaaaaataatgaatactccaacctctaaaacactggggtctggagctaaaagaggtagcagacccaatctgtgaaccaa

SEQ ID NO: 203802 - DNA, 706 bp, Homo sapiens
tgtgtttttgaggtcttatccataaaatctttccctagaccaatgtcctaaagtgtttccccaatgtctccttcattaatagtgatgttatagtttcatgcctcatgtttaagtctttaacccatcttgagttgattttagtatagcaagagatagaaacggtttcatttttcacatggatatcttattttcccagctccattaagtgaagagggtgctcttttcccagtgtatgttcttggcatctttgtcaaaaatcagttggctgtaaatacatggatttacttccaggttctactctgttccattggtctatcagtttttattccaataccatgctgcttttaatgctatagccttatatttttaaatcaggcagtgtgatgcatccaactttgttatttttgctcagaattgctgtggctattccagctcttttttggttccatctgaattttaggattttttctatttccatgaaaaatggcattggtattttgagagagactgcattgaatctgtagattgctttgggtagtatggtcattttaattttgttaattctcccaatccatgagaatgggatgttttttgtgtgttcttttcaatttctatcatcagacttttgtagttttccttgttagaggtttctcacctctttggttaaactcattcctagattttttgtagtggttgtaaaagataa

SEQ ID NO: 203803 - DNA, 482 bp, Homo sapiens
gaggtactgatcagtgtagaaatttattcctgtatttatcttagtttgtttggtactactgtgacaaaacacttgagaccgtgtaatttataaagaacaggcatttattgactcagttctggaggttggaagtcccatatcaaggaaccagcatctggcaggggccttcttgctgtgttatcacagggcagaagggcaaaaagagagcaagaggagatcaaatctccctttttataatggcaccaatcccacccataagggtggagacctggcctaatcaggccttaaatgtcctacttttttttttttttgagacaagagtctccctctgttgccaaggctggaatgcagaggcacgatcttgggtcactgcaacctttgcctcccaggttcaagtgattctccagcctcagcctcccaagtagctggggttgcaggcgcctgccaccatgcctggctaatttttttttgtatttttagta

SEQ ID NO: 203804 - DNA, 436 bp, Homo sapiens
aacacgctcccaatactgcctgtggaattttctacaactttcctctagttccattagttacctcctaccccaggactgggcttgataagcctcatgagaggctgagtagatatttaatctctagactaagcctattgatttcctactttctgccacttggtcaaactttggtctccttttataataatgttcttatataataaacttgcattctttcctttttcttccccagaatactgacctttcatacttttaggaactgtggatcagtatttaaaggcaagattttgatcttcaaaaatttttttctccttcttaggcaccagactcttacagttcatgagttagaaactcaagaacaaatacaatactttggtctttctggttctataggagtgagagagagagtgatgtctgcattctacaaatactagcc

SEQ ID NO: 203805 - DNA, 353 bp, Homo sapiens
aactaaatgtgtacttcaataatcaactttttgccagttgattcaatagccaattattgaaatatgggaaattctatagtctatgagctttgaaatcagagactcagggtttatccctaggacccgctctgtaggccaattgtttaaatctccctacacctcagtccccttgtttgtaaaaaagagttaataaaaattacttcatggctgggtgtggtggctcacgcctgcaatcccagcactttcagaggctgaggcgggtggatcacgaggtcaggagttcgagaccagcctggccaacatggtgaaacccctgtctctaataaaaatgcaacaagagcaaaactctgttt

SEQ ID NO: 203806 - DNA, 210 bp, Homo sapiens
agtcttatatatttccctgctgtctaacatatgttgaatgaatgaatgagtcaatgggcacctgttatgtgccagaaattctggtaggccctaggagggaaagtgcagtaagacataattcttgcccttaaggagtttaaagctcagatgtgtcataaggggtgtatcagtggctgaggatgaagggagaagagagaaggaggtattgag

SEQ ID NO: 203807 - DNA, 547 bp, Homo sapiens
cagatcacatggtgagaaaggaagcaggagaaagaggcgggaggtgtgggatgcttttaacaactatctttaatcgagaaagaacaaatagagtggtaactaatagagtgagaactcactcattaccatgagaaaggcaccaagtcgatcacgcaggatctgctcccataaccccaacacctcccactaggctccacctcccagcaccaccacactggtgattaaatttcaacatgaggcttgtaggggccaaacagccaagctacagcagtgtctaaattggacctaatcagatctgaattcagttatgcctgttacaatttataatagggatacattgaagcacctccataggcgggcttactaggtagtgagtggtctgtaaaacatattgggttttatggaaaactgctgagaaaacatactgggcaggaagtgagaagaaattaaaggtctatgataaatctcttcaagtatttgaagaggcagtttacagaattctgtgttgcttcagagggtaacataatccagctcagaataggactta

SEQ ID NO: 203808 - DNA, 654 bp, Homo sapiens
cactaggtggggctccccaaaacattctagataaaacatcttatttttagaaaggtatgaataattgtcatataggaagaaacagccaagaagctccaaaagaaactagatgtcacattctgttaggcatacctaggagacatagccataaaaacaggaatgggatagtaaaggagagaaatgtggattaactcagtgaaaattctaagaggccatgagaagacattccagcctctggctttctaagtggatcatctgaataaatggtgaaaataacactgcaatgggttctacactgtgggctgagactcccaggccaggcagggtgtagcatctttctttctctggggaactgatgagatctgaggaggagagttagctcagtggtccagtggtgatctgggctatgagttttcttcacttctgtcaagtggaatgattctgagctgtgatgtcagaatagcttatgtgtttgataaccttcagagctgtcttgagagtcttacaaacctatatgtagaaaccactgatttctttaaaagctgtatgtaaggtacaatgtgtataacatgctctcttttgtgaataaaagaagggaaggattatacacaagcaaatatttgcttatatttgcataggtaatttcaggaggga

SEQ ID NO: 203809 - DNA, 346 bp, Homo sapiens
atacttatagtgcaaataatgatattaataacttttctaacttaaaataccctttattgagggaaagtttgcagtgtgaacatgaaagctctgaagaacaaggttcctttttatttatttatttatatttttgagatggagtttcgctcttgtttccctggctggagtacaatggcacgacctcagctcattgcaacctccgcctctcaggttcaagcgattctcctgcttcagcctccggagtagctgggattacaggcatgcaccaccatgcccagctaattttgtacttttagtagagacagggttttccatgttggtcaggctggtctcaaactcctgacct

SEQ ID NO: 203810 - DNA, 217 bp, Homo sapiens
ttttgttctcttaaattgccttcacagataatttaagcctgtggctctggtctgtggatcctctttcatcataatcctgaaacatcatttgtcttttttactgatggtacagaaagcaatgatggatgataaaactgatgatgccttaccatgagtcaaggcagcggcaccaaactgtaatagtaaatgtagtaatagtcgtatgttctttagtaag

SEQ ID NO: 203811 - DNA, 314 bp, Homo sapiens
gcaagcctcctcccaagccagctggggagtatggggagggggtggccggaggaacctggcatccccgggttaggaccacagaggtggctctgcctgcagctgggcctctgcctcatcctgactccccctgctttggccatggctcttcttgtccttcctcttctcagtgcaggaggaccctgaatcaaatgcctcatcctggtttgcattttaccctcggatgaagcttgtggcgaacccctggactctgtgtctcctgagtctctgcagacctcgggtcctggacccagagactcttctccctgggacaggag

SEQ ID NO: 203812 - DNA, 388 bp, Homo sapiens
attaggaacgcgacatgctacgtctttttagaattcctcactttactcagttccaagggcctctgctattttattccattccacagaagggaaaacagattcaatgaggtcgggcagtggatggagctgagtctagaacgcgggtctgatcctatgtgaaagttccggtgactccaggctgaagtagagtctggattagcatctctcttcggagctgcttttgggagttgaagggtatagaaagttctagaattacttaccctggaaactggggaaataggtagccaggtgggaggtggggattttctcctccaggatgtcggttttgttgagaaagaggatgacggatgtgcttttgaaccagggtagttccaggatagtcccaaac

SEQ ID NO: 203813 - DNA, 676 bp, Homo sapiens
cggagtctcgctctatcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgggaaattttcttgaatatctttgtaattcctttcctcttctttccttctgaactcctagtatttataagttggacttcctgggttgatcctttgattttattattttctctacttcctaatagattttctcaaattcatgttcctattctatttgagcttttcatttctcgcgcataattttttatttctaagagctcctggcagatgttagaagtgttctggggccccggttgttccttttctcagagcccctcttcctggagtcccggattccctatttcctataatttcctttctgtagagtccagtttccttttgcccttgcattgcatttttcctctgtgttccatcctctcttgtgtttgctttgatctgtgcatttcgctttgg

SEQ ID NO: 203814 - DNA, 385 bp, Homo sapiens
acaggcaaggcaattgaaaaatactgtatcctccctcccagccctttactttgaaaataaaagaagtcccacacctttcatctgatacaatttaaacatgtttatacaaagtgactgcagcaaaagcactgtgtggtagcagcagcactgaacccagacttgaaagagaatacacgtcctgtcctgggaaggaagctgccccccaggctctgtgagagccccctctcagaagctgggccccacaagtgaaaatgagaagccctgtgggaggttctgagagatatggaggattccacccaagagcagtgctcttggacctgagtcactgcaaagggttttctctggatgggtgagaggcagggagtatgcacctgtgtgtacccca

SEQ ID NO: 203815 - DNA, 503 bp, Homo sapiens
agcaccagatgccacctaggcttggctcaggattggcatgttgtctatgcttatgttccattggcctgaacaagctacttatccaagccctacttcagtgagatgagaggctgctccatccactttggaccctgaggaggaggcatcttacagcagcaagagcctggaatgggaagcagtggaatttcaactctgttcatcacttctcagccacgggacattgggcaagcctctgagccccagcaccttcatctgcaaggcagttgctgtggggtatgtgggagcacagccttggaagcctggaagacacgcatctgagttctggtatttgccacctgctggttgtacattcctcgatgttcagtttccttatcgtgaaatggggataaggccacctctcttccttgttggaagtccagtgcaactccctgttgggagcggggggagatatggcatagggactatcagatcaaataagcaaacaaaagtgaagtatgtaacac

SEQ ID NO: 203816 - DNA, 578 bp, Homo sapiens
aagcagttatacagactcaccagttacagtatttcagttttactgcatttgctttatcattcactttctctacatgtttcttctgaatcatttgggagtaaactgaagatactgtggaccttaattaagcgttttatacttcagtgtgtatttcctaagaacaaggacactttcttatgtacccacactatatggatcaaaatcagaacacttagcatggatacagtaccatacagtaatccacaatccattatcccagttttatcagtcgttccaataatatcctttatagctatttttttcattgtccagaatcatgcattgcatctagtcatcatgtctctgggattcttttagtccttcagtttgagtaatttctgttgacctgtcctcaggtttactaattctttccttggctatgtcaagtctgcttatgagcccattgaaggtattcttcatctgttccattgatttggtctgtttttttatttataggatttccatttgattcttatagattccatctctcatctgaatttcccatctaaccttgtatattgtccagcttttccactgga

SEQ ID NO: 203817 - DNA, 625 bp, Homo sapiens
ccctcctagccctcttaccccctcttaccctctctgggccttggtttctttaagggtaacattgggatgataatatctcttacctggttcctcccacctggccccttggccagaccctcatctcttcatgagcaattgccatagacttctggtctcttcccttcagattccctgggggcccagctaatttttgtatttttagtagagacgggatttcaccatgttggtcaggctggtctcgaactcctgacctcgtgatcttcccacctcagcctcccaaagagctgggattacaggtgtaagccattgcgcccggccaagtgtgagttcttttaagctgtgtgaccttggccaaggtgcttaacctttccctgccaagtctcaaacacctctttgtccagctactatgcttccatcaagaatcaataggacctatgtccctacaggtgtcagggtagctggcagaatggtgatgcccttggcagaggcaggcaaggccaaaggaagggctggttctggcagggagtgaaggatcttactttgagaggtattgaatatgaggtggctgcagacagatggtgacgccatctgagaggcagcaggaagtaggtaagaggctaggagg

SEQ ID NO: 203818 - DNA, 415 bp, Homo sapiens
gacacagcaagaaggcatcatttatgaggcagagagcgagacaccaaatctaccagcaccttggtcttagactttaaagcctccagaactgatgtacacaggcaacaaagaaaggaaaatcaacatctctgttccactaatatatctttactttcaatagtatatgtggtagagagaccattctaccttgtaagtggatgataacaaggatctgaggaatgtggccaaagtctcaaatttatccccatatgttcctcggtaatatcccaagcaagaacagctctgcctcgcccatacagtttctgtaatagaactgttaccttaaaattaacctagcctgtaattttagggaagaaaatcagtaacctaattctattcaggataaaataagttaataaaacaattagaactcaat

SEQ ID NO: 203819 - DNA, 295 bp, Homo sapiens
gggaaaatgaatcagcttctctgtgcacccatttcctaaatgtataaaagggaaatgacctgcccatcacagggagaactcagtgagacaaaaatcatagctgggaacttggaatcagctcaaaaatatcaactagcacccctctgttttaactacttctattcttactgttcttggccttgtctgaagtctcagagcaaaccgttccatgatattttctgaaacatatacatgcactgatgatgtagaatccaggatttctcattattgtttttctttcttttttgaggtgggg

SEQ ID NO: 203820 - DNA, 181 bp, Homo sapiens
gatgaaaaggatgacaatgtctatgtgtctgatagattgtggaaagcctaccgccatgttaagtgaagaaagggagtatgtctgctgaagagattaacttctggtctcctatcagtatgtgtggtgtggtagggggactgcatgaccttaactttttgttcttgagaggcctagcattatc

SEQ ID NO: 203821 - DNA, 480 bp, Homo sapiens
cagaacagaatggagtctcctacgtctacttctttctatacagacacagtaacaatctgatctctctttcttttccccacagcacgtgcccagcttcctttcaagtctctggccaatgcaatgtgagcagaagtgaaggggcaactttcaggtgatgacttggaaaagaaagcttagtcctctgcttctcctgtcacccgaaagagaaacagaggcttgtcttgttgaagccagtgtgtttggtgtctttttgtatagtggcttagacagtggcctaactagaagaccaaggctcaaaggaacacattttgagcttctccacagtttgagaacctctacattacctacaccaagccttccccagcactcaatttatggaagaccatttctcttctcatgacacatgtcctcatgttgctttggcctgttttaaagctttctcaactccatctcaataaagaaatctgcagctttgttgga

SEQ ID NO: 203822 - DNA, 348 bp, Homo sapiens
acagctaactaagggcaggcgatacaatacaacagtgcaggccattacccaaaagccgtttcttccaaagaacgcataaggctgggcgcggtggctcatgtctctaatcccagcactttgggaggccaaagtgggtggatcacctgaagtcaggagttcaagaccagcctggccaacatggcgaaaccccatctctactaaaaatacaaaaattagccggacgtgctggtgggtgcctataatcccagctgctcgggaggctgaggcaggagaatggcttgaacctgggaggcagaggttgcagtgagccgagatcgtgccactgcactccagcctgggcaacagagc

SEQ ID NO: 203823 - DNA, 437 bp, Homo sapiens
tataaaacatcacagaagtgaagaggaaattagattctattaatttagtgctttactcagttgtttaaaaaatgtgtctgcctcaagctttcagttatagtctggttcacaataatattaagaccttttttttttcctttttcctcattgttaagcaccagtcctaagtttttaaacattacttaaaaatacatctttaggggttacaccatgtgtcaaattctcaaagatttaaggacacatggaaggcttttttacagttaggagactcagttatttatggcaaaattaccaatgtgatactgaaaaacatttcttccaagagctgtgcacaaataaatgcattaattattgctttaatattaagaactaaaaaacaaagaaactgtttttaaaatttcaaagccactccaataaacttcccagattaacttatc

SEQ ID NO: 203824 - DNA, 331 bp, Homo sapiens
cggccccgtagtgtcataaatctactgcttaaagtaatagtggactgggcgcggtggtcacgctgccactacacccagctaattttttgtatttttagtagagatggggtttcaccttgttagccagcatggtctcaatctcctgacctcgtgatccgcccgcctcggcctcccaaactgctgggattgaaacaccgcacctggcctagagggatgccttttaatgaatccatctaccactgctaattcactctgcagacagtctcattcctggcagaaagacctcccattttttccttcctagggccagaagcactttttccttctttca

SEQ ID NO: 203825 - DNA, 220 bp, Homo sapiens
aaaaatcctgttaggagagccatggctgagaaaatctgtatgtgtgttctagcatggagtttcaccatgtatgagctccagaccttgggggcacttggactgattacaagggtcctagcatttggaaatgatttaatgaataaccatctgacacatatgtgttctattttccacaagaatgtagatactgaaatgattattaaaatattaatttaaatgc

SEQ ID NO: 203826 - DNA, 371 bp, Homo sapiens
ctgtatccctagggtacttgttccgctggtcatgttatggatcaattgagtatagtagttcgctttgactggtgaagtcttagcatgtactgctcggaggttgggttctgctccgaggtcgccccaaccgaaatttttaatgcaggtttggtagtttaggacctgtgggtttgttaggtactgtttgcactaataaattaaagctccatagggtcatctcgtctcttctcttgtagccaaggaatgtcaatgcttctctcctagtttctagtgactggggacaatcattgacattccttggcttgtagcctatcattcctatctctgctactgtcttcacaccaccttctcttcccttaaacctccctatg

SEQ ID NO: 203827 - DNA, 646 bp, Homo sapiens
aaaaaaagaagaagggaggggagcatgttgaataggagagattggcagtgagaaacaatttgaagtttagggctgtggtgcagagaggggatgagttagggtttttgagctcaggaggcaataaggcttgcagagatgtttctctctttttccctctgaactggtttctgcactcctcagtgcagggctccaggctggatacttttgaggacactacttaagttcttttcttggactctgctgccatcctccataacctccctaacctccataacttccctaacctccctaacctccataacctccctcacctccataacctccctcacctccctaacctccctaacctccataacctccctaacctccataacctccctaacctccataatctccctaagaccctatcttagggaggtagctgagaacttggcactgcgcacacatactaggttgaaagagagttgaggaaaccagaaggccaagtggatctgctggcaaaccctgaacctgtctcctgcgcttgctctacagttctgaagttgaaaatccttttcatgcctagcatctgcttgagttataaaccccaaggcagccatgtcatagactagtgttactcttgttttgacttgttttagtgctccct

SEQ ID NO: 203828 - DNA, 167 bp, Homo sapiens
tacagaatatatattttgtcacaatttaatcatgtattcaatagaataaagaagcacagcaaacatacaaatgctgagatttagcctgctaaagtaaggaagacattcagaaagtaagacttacccccaacaaaccctggcctccacttcccctgcttacacatcca

SEQ ID NO: 203829 - DNA, 414 bp, Homo sapiens
atgttacatgtttgagcatttaaactgaatttggacagggcttctatttccagaaccttctaactctatttctttgtgacctgatagtcttgctctccagggtaaaagaagaggatggaaatggctgtggggcgcctgagctgggccctggcatgatggcaagatgccgttctgggttcactgggatggctcaaggggagtttggaaaccctcctaacatgtcatctgaaatctgggaccacagttccggctggaacacttgtcactaaagctgctgataagcaaagggtgtatcactggtatgggtaacagttgtgggaggaggaggggtctgacagatagccggatgattttaatgtttatattccactggggtaagctctaacaaagacccatcatttcccagataaccaa

SEQ ID NO: 203830 - DNA, 348 bp, Homo sapiens
ggcagcagcaatcaccatgacagagaaaaagaacatagagactctgaatgttcctcagccaccacccaattctagttatgaatgtcagctccgtttgtgtcttgccacaggcaaagccctcaaacttttggtgtgcagcacagacacagtatgccacatgcagaggcggtgactcgcagcagaaggagtggaactatgtagtcagcggtggttcttttctggcagacctctcactaacaaaatgaaattggaagagccaaagatcccaaaggactgtgctgtacaggttagagtgaggcaaccttttcaaaacccaacaccagttgagaactgaattggtcccattgg

SEQ ID NO: 203831 - DNA, 617 bp, Homo sapiens
atagacagatataaagttaaaaaaaaacacctatgtgttatcttttgagacattgtaaacatttggggttattttatttccgagatttaaaaagcataattataggcacatcacctatttagttttatactgttttttttgtttgtttgtttttgtttttttcccccacaaaacttcaaacaagaatttaagctttatagttttggtctttgggactgttctaacaacaaattaactctgttaaaattcttatatagtcaatctgctaatttttgtatttttagtagagatgaggtttcaccatgttggccaggctggtctcaaactcctgacctcaagtgatctgcctctcttggccccacaaagtactgggattacaggcatgagccaccacccacagccagttaagtgatttttgacaaaggtgcctagaacaatcagtgggagaagagacagttttttcaacaaatagttgtggcaatactgcctatgtaagagaatgaggttggacctttactttataccatgtaaagaaaattaacttgaaatggactaaagacctaaacttaagagctataagtataaaacaggggcaaatatttatgccactagatgtg

SEQ ID NO: 203832 - DNA, 383 bp, Homo sapiens
aagctagagggacatatttatagactgtgagtaactgcaacgtactagagatgtagcaagagtacatatctcccctctccctcttcgtcttctttgccctctccgtctccatctctctcccatctcccctcttccctctccttttcccttctggcctcttccctctgtcttctcccatctccctctccctcctcatcttcctcctcatcttcctctcttggataacccagctcccgaagcatcccccagctcatcctcctcctctgaggcctggttctcattcaaattgctaatagactgcaggtgagtcttaatcattattaaaagaaggaggggaaacacatgtattgagcatgttttcatatagactaaacatcatttag

SEQ ID NO: 203833 - DNA, 591 bp, Homo sapiens
tttgcttttaggaaaggtcagaagacaagaaactgccccttcctgattttggatgttgttgtctgaagatgtgatggttggtactgtggcaaccacattggatcatgagggcaaaaccaagggaataggagaagttaacaagaacattactgagcccctgaagaaccaaccctagaaccgccctattttcagattcctgttatgtgagataatacagtatttatgtttaattagctcttataagaatattctatgacttggagccaaatgcattctaacggatataacattctggaaccagtttcttaattttgttttataaacagattataaatagagaagcaaagtttttccaactggagtggaataatctgagaggccttctctcatggatggctaatatggtacaggagtcatgaatgaagagaggctgttatatagaacgttctgaactctgatggaggtgctgaacaataaggaggattaacaagtgatgtgacagaagctatccaaagggaaaggaccaatggctcattccccacccatttaaggagccaaagctcttggcaatctgaacatagttatcgatta

SEQ ID NO: 203834 - DNA, 246 bp, Homo sapiens
ttataaaaaaatctaatctgccagtttagcgttttccaccaactcggggagctgaaactttcacaggcttcacaatcttttgcttaggtgctgcctttgtaggtgccttagcagcagccattgcagtctttttagatgcttgcttagcctttttgcttccttagcagccctgatagcttgttctcgttgagttggtggaaaacgctaaactggcagattagatttttaaataaagattggattata

SEQ ID NO: 203835 - DNA, 221 bp, Homo sapiens
tttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttggtggaaaacgctaaactggcagattagatttttaaataaagattggattata

SEQ ID NO: 203836 - DNA, 160 bp, Homo sapiens
tttcaatgtcacagctggatcagagcaacctactatttagtctactattttcatgtgaacacggagtacttgtgtcagctttttcatcttgttaccaatttgacttcattatttggacttttctaaggctgtaaataaacgctaaggttactaatttcaa

SEQ ID NO: 203837 - DNA, 563 bp, Homo sapiens
caggctgttttacaggcagtgttttctggatattcatcagcctggccttaagaatgtcccttttattttgatgccaagaagtcaaaccatccacttctacctcccctgtatgctctgttgtcgctcttctagaacagattccaccttggggatgcagataccttttcccctccagataagaaatacatcaaagtaaatgtgcacaatataagaataaggttgacggtcctaaataccaaagaaatgtcataggacattgaagaagcaatagactagtcatagtggctcagctgaaaggactttggctgggaattctattaatacctctcattgtgtggtgagcattttcttcgtccttgtctaattttcctgcatggtaaccttctctctgtgggtctctgcccgtggccagctgcgtccccatgagaaactcaccaccctcgtgctgaaggaacacttcaataaccctgtaggatataagggaagggggaggggaggcaaagtagagaaacaatggtcccatccttttcttgttgaaatagaaatgagaaggggaaatccat

SEQ ID NO: 203838 - DNA, 679 bp, Homo sapiens
gctatgtagtggtcataggccattgctttgagtatgaagatctcaatgtctccaaggaagtgagtgataaatagctgtatcatgcagttattataggaaacgatcttcctttctgttagtaggtcaatcattagcttgggggccacagtggatatgtagcaaagatctgagagtgcgaggtaattaaggaagaaatacatgggttggtcaattagctaaatgtacatgatagaaatcattatgatgaagttttccatccaaatagcaatgtagcaaaatacaaataatacaaaccaaaaaacttcaatgttcttgttttgagaaagtcccaggagaataaagacagtgacaatattcctattttccatgaaccagtgcagaaagaatgcataaaagccacctgaaaggacattaagcataagtcagtgtcagaaatgtcatggagagtattgatgataatactaatattatgcaactatgtttaagggatatgattacagaatttcagacaatgaaaactgatatttaataaaaatattttctttttctaattagtatcatgatgatttctagaagtcatttttgggacattataacattgataaaatgaatgcattcaatcagtcaatttaaaaaatgtttaaataaatgtattcaatccattttaaacacggttaaa

SEQ ID NO: 203839 - DNA, 384 bp, Homo sapiens
gcagccaggtccctagtggcttcacatccgaggaaactgtggagcatccgtcattctacccgagggttggaataactcactgttgcagatacttccattatgtaactcagccgagggtattctgcacttgtcacagcagaggtcagccatgattctgtagagtagtgcaatgattcaagtgacttttaactattgttgcccaagatgcaatgatagagaatcatggagtttttaagatgagtggttgatttcctttttactccattaaatgccatggcttttcaatgttgcatcatcatctagttctgtatcttaacccttcagcaccctggtacacaccttgctaacaaacctgtaactctgaaatgtaatcgcagaaaaaag

SEQ ID NO: 203840 - DNA, 602 bp, Homo sapiens
gtctcccccccagtaaatagccccacctccaaacccccagcatcctaaccacctcctcccttctgggctccccgacctttgtctccacgggagcctcccctccctagcatcctgtgtcccagctggaagcagatggaggggaggggctgccaaacccctctccaccccactggatgcctcacgggctctctggtgggagccttcctccttcgactttttctctcagagctgatgctgttgagtttgggttgggaggggggacagacagagggaggtgtgtccttgagtttgagcttgtggggagattcgttgtggtggtgagtgggtggtaagaaacaatgaatttgcagggatgaatgcagcctgggactttggaaagcagcctcttttgttggaggctgggtgaagtcagaaagctaaacaaaattgctgatacagttactcctttatcactcctttcttcttcgctgaaggggctgaagttactaggaaactcactataggagaggagttaagagtgcaggtttcaaatcctggctgtggcaattatcaactctgtgacttccagcggagtccttgccttctctgtgcctcaacaccct

SEQ ID NO: 203841 - DNA, 348 bp, Homo sapiens
tccccagcagccattcctaaaaactggcctcttgtagtaatagatcttaaagattttttctttactataccattacatgagaaggataagcctcgatttgccttctctgtgccttctattaatcagagacatgctacaagccaaatgggtgagacatccggtcatgtatggtgacattgtctgtcgccatttgctcatatggagatttctaaacaattaaaaactgacaatagacctgcttatactagtcatgcttttcaaactttcctacagctttgggctatgacccataaaacaggaattccttacattatagaccaggcacatcaaacgttacaacgcatgttg

SEQ ID NO: 203842 - DNA, 448 bp, Homo sapiens
ccagacgtgatgacactcaggaagagcttgcacactggttgttctcaaatccagctttctcttcgaatcttagtggagttctttaaaagggaaacaattttatccataggatcttttctacttttttttttaagttcctgaggtaagtctgatgtgtattcacagttaagtaccgggcagaggtaggagggtgggtttccaaggccagtggaagagcttccataaaggcagggaataccagtcaccatgaatggttttaggaagagcaagtcaagggaggtaagtgtggaggaaagagatgatgtggaagctggatcatcgcgggccttgtgtgtgttgagctcagcaatttgaattttatcccaacattggaggaggagtcatttgtgctttcgaagtccagtttggggctttggcctctggcagcattttggaggaggaattgatg

SEQ ID NO: 203843 - DNA, 499 bp, Homo sapiens
  misc_feature (65)..(65): n is a, c, g, or t
actctcgtaggaaataaatagccctttcaagattcctcagctgcctcaccccatgcacatgtgcntggggtgtggcctagaagggagtgatgttcttactctggtggtctgtgcttctgaacacaggctacatgcacacactgacaactaccaataaacagacaggggaaggtctttcatccagcctgggcaacacagcaagagtctgtctctttaaaacaaacaaacaacaaacaaaaaacacttctgtctagtgatttaaaacaattgacattcttcctagcaattaaatgtaatactgtatagtagtttgtgaagaggttagtaagtcctaatttgaatttgtgttaaaataaaagacacaaaatgcacattaaaatgtttctcatctctgttttctgaggactgctgcatgtcacaggttttaaaaatacacattttctatctgtgacctttcacatacatacctttgtcaagctcaactggagggcttaatctc

SEQ ID NO: 203844 - DNA, 502 bp, Homo sapiens
taccaacatgcatttgggttaagggaaggagactaagtcaaatttagtcaaatcttcctgtttggagctaggcttggtcctgtagtcccagctacttgggaggtttacacaggagaatcacttgaacccaggagtttgaggctgtactgcactatgatcgcacctgtgaacagccactgcactccagcctgggcaacacagcaagagtctgtctctttaaaacaaacaaacaacaaacaaaaaacacttctgtctagtgatttaaaacaattgacattcttcctagcaattaaatgtaatactgtatagtagtttgtgaagaggttagtaagtcctaatttgaatttgtgttaaaataaaagacacaaaatgcacattaaaatgtttctcatctctgttttctgaggactgctgcatgtcacaggttttaaaaatacacattttctatctgtgacctttcacatacatacctttgtcaagctcaactggagggcttaatctc

SEQ ID NO: 203845 - DNA, 228 bp, Homo sapiens
gggattacaggcacaagccattgtgcctggcctgcaatcatttattctaatcttggttgagagataagaaaactgaggccggaagagccaggccacctggctactgggccagtgttctttcctagcactatttctcttcaaactttcaatctagcattgaaggctcttcctacatttctacctttaatctccccttcccttcaacataaccaacctctcagctgggta

SEQ ID NO: 203846 - DNA, 181 bp, Homo sapiens
aagaaaagccaaagaggcaggaggaaaactaggagagtatattatcaccaaagccacgggaagagagtgagttttcagtcctgtctagcattgcaaagagctcagtaaaatggagattttttttttttgagatggagtcttgctgtgtcgcccaggctggagtgcagtggcgtgatctcgg

SEQ ID NO: 203847 - DNA, 265 bp, Homo sapiens
ggtgcattttatcattttgagttctgctttggaaatcctgtgattggaggggtatgtggtaatcaccagtacttagaaactgcctgggaaattcattcgttcattcacccagtacagacagggcatacccacctgcaggccactgccagagacgctggtggagcagagtcgtggagtgtgtgttctggcggagaggcaggtgctgaactgaatgacccaacagtagacttgcagatggcaaaaggtgccgtgagggaaatagaca

SEQ ID NO: 203848 - DNA, 491 bp, Homo sapiens
ctcccacctcagttacttgagtagctgggactacagaagcaccccagtatgtctggctagtttttaaatatttttggtagagacaagatctccctgtgttgcccaggctgctctcaaactcgtggcctcaagaagtcctcccgcttggactttccaaagtgctggattacaggtgagagccacctatttacttcaaatctcacagtatacgcttagctgtcccttgctgccatactggccgtgagtcgtgacctcaacctgttctaaatttttaagatgattaaagtggacagtgcctcacgtaaacaccaccaccagagtgaataaccaggggcccagcttcctcctgaaggtgcatttatatgtttatgtcaaatgcacaatcacaacccttgtgcattattggactgcctgtattaaaagagaatgttttgctgagaaggttgagtgccctggaaggaagttgctcaatctaagtggaaaccaaaccc

SEQ ID NO: 203849 - DNA, 447 bp, Homo sapiens
tgtctttggaaggaaaggaaaggatgggagaggggctggaagcattggctagtagatgatcgaggctttctataccaccaccaaggtgtgtattttctcatcatcctggttgtgtcaggctgtccctagagatcaccctgacctcagtgtttaagaagaagggccagatgcagtggctcatgcctgtaatcctagcactttggaaggccgaggcaggcagatcacctgaggtcaggagctcgaggccagcctggccaacaaggagaaaccctgtctctactaaaaatacaaaaattagccaggcatggtggtaagcacctataaccccagctacttgggggctgagacaggagaattgcttgaacctgggaggcagaggttgcagtgagccgagaccacgtcgttgcactccagcctgggcaacaagagtgaaactctgtctcaaaa

SEQ ID NO: 203850 - DNA, 484 bp, Homo sapiens
catggcagttaggaatcataatcagatgacctgccttccagacccctccaaaccagtttctttacactactcttcaaaaccaagcaagttcatttatctttgctaaggatttagttcagtcagggcttcatttctattttggattttaataattatcttgagtttgtagcagcagtatgataaggagtgaatttgaaatctaggctatgaatgtttattgtatttcttacagttaactcctttaatctctctgcttcactatttttataaaaaaaggccaataactccagagtgcttttgaggattctggtacataaaataatacaaaggtctatatgaaaatgttaagttagtaacttaatacttctaatttgccaggaatttttaaatgtcattatatttgaataagcaaataaaaagacctttagaattgtaacccacagccatccttagacatggagacctttgctaggattcctcccca

SEQ ID NO: 203851 - DNA, 446 bp, Homo sapiens
gagttgggatggctgtgcatggcatttgtgagggttcctgtgatttctgtgttttctccccgtgaggggtccagggcccagggtggcagtggacagctgcagggatggtgctggggcatgcaggagctgacagtggtggctgagccccttttcagggggtctctgacagatgcctgctgaaacactgaggctactcctacccccgacagctctcagttaacaagtggttggaatgaaaattgtacagcctctatggaaaacagtagacagatttctcaatacaactgctttttgtgtgttaattttataccctgctgtagtcccagctactcgggaggctgaggcaggagaatggcgtgaacccgggaggcggagcttgcagtgagccgagattgcgccactgcagtccgcagtccggcctgggcgacagagcgagactccgtctc

SEQ ID NO: 203852 - DNA, 597 bp, Homo sapiens
  misc_feature (23)..(23): n is a, c, g, or t
agctcggggttgctgcctggccnaggccggcgcatgttggaacacagactctctgcccttccaccccaagcctggtgggcgagtgagtctgccccacaccagcacactgctctgccgttggtgggcacccgttggtgtgtgttgagctgggtgttgtacctcggtgtctgcgtggagaaatgcgaacagtgagtgccacagcacagccacggaatggtcgtcatcggcttcagaaggggaatgaaaggggcagcaccgtgggtgttgatgatctccgaggctgcctgtttagagcgtcccttccctgagatggaggcgtagcttcaccgtgtagtgtttaagctttaaaacgtgaaatgcagcgaggccgacagtgagtagtaggaagctcagaaatgggatgcccgcactgccttcagttcaccctccattgtccattgccgctggcatacccaggtcagcgcctgcaggcccctgtctcaaaagatgtggccggcttcatgtcccggtactgcctgaagcgtcacctcagcaccgctagcttcacactggccacacccacctccactcagcagtctccatgctgtagcccaaagc

SEQ ID NO: 203853 - DNA, 478 bp, Homo sapiens
ctggtgacaaaatatcttgtgtaaagttcaagggacagtgcgtcatatgttgttcctaggaggagggtagtggtgagggtgtttattataataatgtttgtgtattcggctatgaagaatagggcgaaggggcctgcggcgtattcgatgttgaagcctgagactagttcggactccccttcggcaaggtcatcatgtcaactaaaccttagcattttccaatctttaataaatgggaaggggagctgaacgcaaacatgattaaaaccacttcctagaactcagaggtgaaggcaccacaaaacattggctagtaggcaatatgatggattgttatcttttgtcaatcaacttgaaatgtttaggaaagactgtcaaaaaattcttaaaacatttcctcataatatagttggatttttaaaatctttgtactctttatttcaatgaataggcctgaatgacaaaatatggataaaca

SEQ ID NO: 203854 - DNA, 510 bp, Homo sapiens
ttttttgcctggccctgttacttacctctgggctctttccattttctttgatacctgaggatttattatttgatgttttgattcttcctgaatagacagagtgatttaaaaagaaatacatccaatcatttcattcctgtttctttatattcattgaatggctttttgctgctcttaggaaacaggaaaaggagctgcttcaacaaggcctccaagactgtagtgatctagctgggcacagtggctcacgcctgtaatctcagcattttgggaggctgagacaggtggatcatgaggtcaggagatcgagaccatcctggttaacacagtgaaaccccgtctatactaaaaatacagaaaattagctgggcgtggtggcgggcgcctgtagtcccagctactcaggaggctgagacaggagaatggcgtgaacctgggaggtggagttttcagtgagccaagattgcaccactgcactccaggctgggtgacagagcgagactccgtctc

SEQ ID NO: 203855 - DNA, 609 bp, Homo sapiens
acagcaacaggctaattgtgtttacataacacgagattgtttagctccagaacacatcagtgtcaaaacaccaaggttctgcacagcgacagcgacagtggggcaggaaagatgtcatccttctccaggaactcaggcagcatttcccaaggcccggaaaaaccccagcccacaaataggacatcagccctccagtatgtccacccacccagctggctgctgggcgcagccaggactctcagaatctgcctgtgtcgggctggccgtgggaataagccagattcaggtttaactgaggcacaaggtggggtccaggaagccgcttcggggctgcccatgcagccacagccacagggaggccccgagcagcctcccttccggagcttcccaccagcactcccacccagctgcctccgagaattctggaaccccaagcagaggtgcccagcacagggtaggccagcctggggctcagacttgtgggggtaggtactctccactcccttcttgggaacaacgtcctagccctggactctgtgtgcgaaccctcaggcccccgtccaagtctttgcaagctgggtccagagctggaagctgagggagagcagc

SEQ ID NO: 203856 - DNA, 444 bp, Homo sapiens
ctacccacagggtgccacagcacgcatgtctttcccagtagcaaaggcgctgtgtctcaaaagctggctatcttattcatttctgagtcaaactctagaccatgcttgcctcttcaggcacttggctctctcagcacaaatataacaggtctttgcactccaggcccttgccaagagtgaactctggaggcctgagccatgtggaatcaggcctgaagtgccctcctttaccctgtggcaccaaagcctgcttcagatggctgggccacatcctgccggtctgccaagaagagcttgggggcactctggccacaacagtcaagcatcctgggggcctccttcccattaaggccctcaggtttcgcacttatttccccagaacttatctgtgccttccacagcccacatggccccgggctggacttccaggggctttgttccctt

SEQ ID NO: 203857 - DNA, 247 bp, Homo sapiens
aacccttgtaattacatgggctcacccagatactgcaggataatcttgttttaaggtcagctgattagcaacattaattccatctgtactcttaattcccccttcctatgtaattatgcggtgtaacataggacatgagcagttggggggtcattactttggccaccactgtgatactttggccaccaccatgactattttgtgccaggtactgaggtaagcactggtgaattaaacatgaataaca

SEQ ID NO: 203858 - DNA, 401 bp, Homo sapiens
aatcataatgagagctcacatgtcattgggtgcttctgatgcaccccacacttgccaagtgctttattttacacagcttttctcatctgatcctcaaagtcacttatgagttaagtaccaataattttcttttcttttttttttttttaaagagacagggtctcactctccaggatcttgctttccagggcaacacctattgcccaggctggagtgcagtggcacagccagctcactgtaaccttgaactcctggctcaagcgatcctcctgcctcagcctcctgagcagttgggaggctgaggcaggagaattgcttgaatccctgggttacggaagttgcagtgagccgagatcacaccactgcactacagactgggtgacagaatgagactctgtctc

SEQ ID NO: 203859 - DNA, 3181 bp, Homo sapiens
ggtctggagcgcggccgccgctgtcactgttggtgcgggcgcgtcggggccgggccggggcactgtaaatggcggcggagggaggcggagcggcggccacgctcagcccagatcccccgaaactttaggttcgaagccccacaactttccgggaagcgctgccgctccggaggcgtggacggaaggggaagccgaggcgggaagtctgggggaatcggcagggagccggggagactcgaacccgcggcgggggcggagtccgccagtgcctcgcgcctccgcggcccccgcctctttctctgcaccctccccgcggccggagccggagccggagccggagccgtagtcgcagccgcagccgcagccgcgcgccgggcctcgcaggcagcggcgcggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttt

SEQ ID NO: 203860 - DNA, 1796 bp, Homo sapiens
tgttatttttattgttgtaatgttactttattttctaatattttctgtttgcggttggttgaatcctcagctgtggaacctacagatacagaaccacagatttggagggccacattgtatatgtactattttgtgacttattttgaatatttctgcatcattaagtattcattattttttctagactataacttgctttgtctactgtgtaaatatgccatgatttatttgtagttaattttttacagttaataacactaggatgaactgttagcctattagccaatctttgactatctctggcttgaaacagcatatcacttatatttgtttggagtagatagagcaaaaagtaaagaaatgattattattaaataggacatatcccatttatcagcagatggttacagtagttcagactcttttacttctgacccagaacagatcgggagcaatgtaactcgtcaaaggtcagtatttctgtcaatgaaaagcatgttaaactatcttgctgcgttttaatgtttaaaactatttagaaccaagcacaaatgattttgttctctgaaagctgttaggttactttttgatttatgtaaaagacaagtaattttgatcctttccaacttgaatagaaaaacaaaaagaaccctgactttctaaatggtatgttgtggaagctctaaaaagaggtgataacttcttgacgatagaagttttataagtcctttttgtacctaaacaacgagaatctgtcaagtaatacatgtatagccttatggtaagtaccaaaagaattctgtgttttaaaacaccatccaaaagcacagcccagtggtgggccacctccccaccctgaagttctgcgttacatataacctttcaggcacaaacaagaagggtgtgggatagggtggaggaggctagagatttgtctgcaagggctttaccatccactaaaagctgtgtgcaggacagaagcatctttctctcctcactttttgcacgtgttgagtatcattttgctgtgtgcccagtggatgtagcgaggatgcagaatctccaagcagcttagagtcagaaggctgcttgtcttcctttctgattcttcatgtagttcttcctgtgtttcttagcattctcagtcatcttggattttactctgctgtttattcccatatatgcagatcagattaccagaggccttggagactcttttcagaatatgaaagactttggtagcaaagaagtgaatctctagggcgagttgagtttgagcatagtcacctctaaaatgagatggcctctgcggacacatgaaagggtacttcagcttaccaaaatccagaacttaataggttgaaagctaaccatatctgaaagtagactttcctttatacaattattttttttcagactattattacttttaattgaatgggaaagcgtaacactaagtatgcagtctattatgaaatcatgttgacaactaagtttcttttcaaaatttttgaggccgagcacttctgtaatcctagcactttgggaggctaaggtgggcggatcacctgaagtcaggagttcgagaccagcctggccaacatggtgaaactccgtctctactaaaaatacaaaaattagccgggcatggtagcatgcgcctgtaatcccagttacttgggaggctgaagcaggagaatcgcttgaacccaggaggcggaggttgcagtgagccaaaatggtgtcactgcactccagcctgggcaacagagtgagactgtctcaaaaaaaaaaaa

SEQ ID NO: 203861 - DNA, 1675 bp, Homo sapiens
  misc_feature (1)..(3): n is a, c, g, or t
  misc_feature (233)..(233): n is a, c, g, or t
  misc_feature (1301)..(1301): n is a, c, g, or t
nnntacatatgtgtaaaatatgtgcacgtacataatagaatcatctttcaggggtcgcactggcaagtcgcactgacttgctttgttttgaacaaaactttgattcattaggatcacaaaatcagtacattaacatttgaatgttcaaagaagaatttgatgttattctttctttctttagtcaaggcatgcctctttagcatttttacttggtggacatttatatcacttanactttgctcctgtattgtgttttattttaactctgtaaggctttaaatctcttccatagagattgcaataaatcattactatacttttgattgtgaactcctcaccttacattacaagtgacccagaataaatataaaatgttgacggaaaaatagaaattactgaattttgttaaacctatgaaacacaacttgcagtgcaacctctgaattactttgctaaatcttctccagtgatcttttactccatctttctcatcatgctgacttgtctctcctctgtctgttcagcagtgggagacatttagtgaacgctcttcaagctcacaaactctgacccaatttgattctaacattgcaccagctgatcctgtaagtcaatcacttagcttgcttgtttgagattaattttattaacccaaatttccattcattatcgtttttagctgatatgcatgattcagtggagtgcttagagggaagtggcggcaggctttttggtttttgtgtgcttaatggtgggaaagacattttttgccattccttttttctagttattttgttgagagaaaactacgtttttaaaatctggtacatgtgtctagagaagcattttttgtgacaatctattttgttaaccttatcatttgctaattaagtgtatattttatatacatactgtttatttcagtgtagtgactctttatgtattatctgtatgcttacacatcatgtaatatgtcctacatatgtaactatttatgcaatgtcatcttttattttgacatgccaaatgacatggcttttatttaattagtatgttgagtcctgttagagagaatcaagttcagcaatacaagatgttggtcaaatattccgcttatgcaaaggagcctctgtcttgtcttcttgtggcttactgtgttgctttgaaaatgctacaaagttcatatcctgatttaaaaaataaattctgtccccatagagttaatttaatatatgctacacctgtcccttgggttttttgaaaaccttagctgttaatcgttcttctccctgttcacttcnctgctttttctttttctttctctctctgtcttttttttttttttaagacaaggatgtgctaataagcactttccaaaaagaaaagagggagtaagcagaaagtgaagaaatgtgtaaaggcagaatttttaaaatgagctgagtagaaagatatggagaaaatgacataagtcgttctttctagatgatctgatcaaagacagccagcatttattaattaaatgtaaaaatggtcttgtcatctaaagagattttgaagaagtggcatttaaagataaagtataccattagcagttaatgggcctttgatgtggtttgttttttgtttttgttttttgagttggagcctgggcaacagagcgagactccatctc

SEQ ID NO: 203862 - DNA, 876 bp, Homo sapiens
aaaaagaaattttgcttaataactttattaaaaaaattgttagccacataaaataatcagttgtttagggtacatcataaacagtgctatcttaatttattgtaacacttacatacttgagtgttgagaaaatgtcatgctaataagatcctttgctgcttagccaagtgtaaatgtttaaaaagaaaaaagctctgatatcagtagtatgaccaattatcatggggtgaattttgcaggtctcattcaggaacgtcgcctgataacactgcaccaccacctccccctccaaggccacagccctctcattctagatcatcatctttagatatgaatcggacctttacagtcaccacaggtaggggctagagaaccataatatacattatcatttaattttaaagttaatccaacacacatacacattttatttttgtttctattacatgtcttttaaaaatatttatctggtcgagtgtggttgctcatgcctgtaatcccagcactttgaggggcaggcagatcacttgaggttatgagttcgagaccagcctggccaacatggtgaaaccccatctctactaaaaatacaaaaattagccggatgtagtgatgcatgtctgtggtcccagctactcgggaggctgaggtgggagagtcccttgaacctgggaagcagaggttgcagtgagccaagattgcatcactgcactccagcctgggtgacagagtgagaccctgtctccaaaaaaaaaaaaaaaaattatctgaaggaaaattttggattaaaagacagcagatgagaggcaatttcttttcttaatgactacttaaagtgtgtttgagtgcaaataatgaagatgggaacctgagaga

SEQ ID NO: 203863 - DNA, 817 bp, Homo sapiens
aaaaagaaattttgcttaataactttattaaaaaaattgttagccacataaaataatcagttgtttagggtacatcataaacagtgctatcttaatttattgtaacacttacatacttgagtgttgagaaaatgtcatgctaataagatcctttgctgcttagccaagtgtaaatgtttagtctcattcaggaacgtcgcctgataacactgcaccaccacctccccctccaaggccacagccctctcattctagatcatcatctttagatatgaatcggacctttacagtcaccacaggtaggggctagagaaccataatatacattatcatttaattttaaagttaatccaacacacatacacattttatttttgtttctattacatgtcttttaaaaatatttatctggtcgagtgtggttgctcatgcctgtaatcccagcactttgaggggcaggcagatcacttgaggttatgagttcgagaccagcctggccaacatggtgaaaccccatctctactaaaaatacaaaaattagccggatgtagtgatgcatgtctgtggtcccagctactcgggaggctgaggtgggagagtcccttgaacctgggaagcagaggttgcagtgagccaagattgcatcactgcactccagcctgggtgacagagtgagaccctgtctccaaaaaaaaaaaaaaaaattatctgaaggaaaattttggattaaaagacagcagatgagaggcaatttcttttcttaatgactacttaaagtgtgtttgagtgcaaataatgaagatgggaacctgagaga

SEQ ID NO: 203864 - DNA, 506 bp, Homo sapiens
agagcaaatggcttaaagaaagcaaatggtgttgcaaagtgctaactatgaatgtcttcaaaaatgcttattattaatggaattcttgtcttaaagagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccattgcagtccgcagtccggcctgggcgacagagcgagactccgtctcaaaaaaaa

SEQ ID NO: 203865 - DNA, 2565 bp, Homo sapiens
tttttgagatggagtttccctcttgttgcccaggctggagtgctatggcatgatctcggctcactgcaacctctgcccccccgggttcaagtgattcttctgcctcagcctcctgagtagctgggattacaagcatgtgccaccacgcccggatcatggagctttgtggtgcaacaagacttggttattttggaagaagtcagttctacattgctttgaaacttgtagctgttgcccagtctggtttccctttaagagtggaaagtataaatacagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttt

SEQ ID NO: 203866 - DNA, 3100 bp, Homo sapiens
ggtctggagcgcggccgccgctgtcactgttggtgcgggcgcgtcggggccgggccggggcactgtaaatggcggcggagggaggcggagcggcggccacgctcagcccagatcccccgaaactttaggttcgaagccccacaactttccgggaagcgctgccgctccggaggcgtggacggaaggggaagccgaggcgggaagtctgggggaatcggcagggagccggggagactcgaacccgcggcgggggcggagtccgccagtgcctcgcgcctccgcggcccccgcctctttctctgcaccctccccgcggccggagccggagccggagccggagccgtagtcgcagccgcagccgcagccgcgcgccgggcctcgcaggcagcggcgcggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgaggatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttt

SEQ ID NO: 203867 - DNA, 3423 bp, Homo sapiens
ggtctggagcgcggccgccgctgtcactgttggtgcgggcgcgtcggggccgggccggggcactgtaaatggcggcggagggaggcggagcggcggccacgctcagcccagatcccccgaaactttaggttcgaagccccacaactttccgggaagcgctgccgctccggaggcgtggacggaaggggaagccgaggcgggaagtctgggggaatcggcagggagccggggagactcgaacccgcggcgggggcggagtccgccagtgcctcgcgcctccgcggcccccgcctctttctctgcaccctccccgcggccggagccggagccggagccggagccgtagtcgcagccgcagccgcagccgcgcgccgggcctcgcaggcagcggcgcggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgtttaaaaaaaaaaaagaaaaaaaaagacaaaaaaaaaaaaaaaaaagacacacaacaacaaaacaacaacgagacgaacagaaaaacgacgaagcacacgccgagaaaacaggaaacagccagcacaccgagaggagacagaacaagaaacagaaaacaaagaacgactcagggggcggggcgaggcagagaaggagagtgaccacgagtgcgggcgggcggcgacaccacagatagagagcgcg

SEQ ID NO: 203868 - DNA, 1479 bp, Homo sapiens
agaatttctctatttttaaattgcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttt

SEQ ID NO: 203869 - DNA, 1392 bp, Homo sapiens
tgggaactgataggtctcaatttggctgatgaagaagaagagtcataacttacccaggtttttaatttttgaagaactggcagtattgttgttaccttggttaaaatagaaaagttagggcagaggatgatgaagttatgttttagtcactgtgagtttagaatggtgaggaaaagtgaagtgttaagtgaaagggaaaatttggaagttttcatttgatacctaaacagcagtcagagatacacgaagaaaatcaagattgtttgctattatgggaataggcaggagtatgccaggagggcttcatgtaatagaggtaagaagcaaagtgagatctgatgaaaggctgtgagatttggtctttaggttacatacagaccatgtaacaagttagtacttgccttctaatacttaacaaacattcttagaaatctttatcatgtagtcacattcattcagcctatttcttctattaacaaagtgattatacagttactaaaaagaagaactttgtattcatgcaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttt

SEQ ID NO: 203870 - DNA, 3075 bp, Homo sapiens
ggtctggagcgcggccgccgctgtcactgttggtgcgggcgcgtcggggccgggccggggcactgtaaatggcggcggagggaggcggagcggcggccacgctcagcccagatcccccgaaactttaggttcgaagccccacaactttccgggaagcgctgccgctccggaggcgtggacggaaggggaagccgaggcgggaagtctgggggaatcggcagggagccggggagactcgaacccgcggcgggggcggagtccgccagtgcctcgcgcctccgcggcccccgcctctttctctgcaccctccccgcggccggagccggagccggagccggagccgtagtcgcagccgcagccgcagccgcgcgccgggcctcgcaggcagcggcgcggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttt

SEQ ID NO: 203871 - DNA, 3133 bp, Homo sapiens
ggtctggagcgcggccgccgctgtcactgttggtgcgggcgcgtcggggccgggccggggcactgtaaatggcggcggagggaggcggagcggcggccacgctcagcccagatcccccgaaactttaggttcgaagccccacaactttccgggaagcgctgccgctccggaggcgtggacggaaggggaagccgaggcgggaagtctgggggaatcggcagggagccggggagactcgaacccgcggcgggggcggagtccgccagtgcctcgcgcctccgcggcccccgcctctttctctgcaccctccccgcggccggagccggagccggagccggagccgtagtcgcagccgcagccgcagccgcgcgccgggcctcgcaggcagcggcgcggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaaatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttt

SEQ ID NO: 203872 - DNA, 2530 bp, Homo sapiens
ggtctggagcgcggccgccgctgtcactgttggtgcgggcgcgtcggggccgggccggggcactgtaaatggcggcggagggaggcggagcggcggccacgctcagcccagatcccccgaaactttaggttcgaagccccacaactttccgggaagcgctgccgctccggaggcgtggacggaaggggaagccgaggcgggaagtctgggggaatcggcagggagccggggagactcgaacccgcggcgggggcggagtccgccagtgcctcgcgcctccgcggcccccgcctctttctctgcaccctccccgcggccggagccggagccggagccggagccgtagtcgcagccgcagccgcagccgcgcgccgggcctcgcaggcagcggcgcggcgagcgcagccgggccccctcctcgcgacctccgggccctgttgctcgggcgcacctggcgcgtgtgaggccggggccggcgttttcgggaagctagcaggaggccgggccacgcgcagcccctgccggcccaggttcctggggccgggccccgagtagtgcatgcggggcggggcggccgtgagccggaggcgaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttt
